United States Patent 6,812,339 (POLYMORPHISMS IN KNOWN GENES ASSOCIATED WITH HUMAN DISEASE, METHODS OF DETECTION AND USES THEREOF) - sequence listing, part 58

SEQ ID NO: 15691 - DNA, 87039 bp, Human
  misc_feature (1)...(87039): n = A,T,C or G
aactgccagcattctcccgtgcactgccagcttgcttatctatgtttgtagctcaatttttcaggctgctctttgcaaaaaagaaataattttggggttgctttttgttcagaaagaagctctgctgaggactctcttaccttcactatctgcctaaataatttctttttggctcctgtatcaatagcactggtaccatttcagaattctggggaaagtcagggttactcaaataaatggcactcaaaaaattgttattcctttagaaaaaaacataattaagtcccttaactctcattatccaaaaatatagtttccagagtaaagagctaattgcaaataacaacaaactgctgcaagaatggttggaaaccatagatgtggtgaagaaggcctttctaagcaatatgcagatccagaggcaaaaaacagactgaagcactacataaaatttaaaattaaagtatgatgaaagagcagaaacaactaggcggcaactgagcaaaaatatttttcacatatgaaacagaaaaatataagatattcagaatgtatagagttcctacaaatccataagaaggcaaaaataaccaatagaaaaatggattaagaatatgaattggcgattcatacagtctataaatgccaataaacatataagaagctgcacaacctcatgagtaaccagaagcatcaataataaaggatagtgaggtatcattttatctccattaaactggcaaatttttttaaaagattgataatatccatcatggactagagcatagaaaaacttccaaattattttaattggttgagccattttggcagtacttatcaaaattaataacgtgcatagtcttcagatatatcccatgttgaaaaaactggtcagaaaaactccaacatgcacagaaagatatacacacaaggaacatcgacagttatggcagcattatttgtaataggggaaaggtgggaacaacataagtattcaccaatagggaaacgtttacataaaatggaacgatgaatatacataaattattccatggaagtcttcagccattaaatatgagatatattaggaaaaaaatgctagaaaaaaaatttaaaaaaagttgtagaaaagtcttgtccctatgatctcaattatatttaagaaatccaatccaattaagtatgtgcgcgtgcatactgtttgcatatgcattggaaggctctaaaaggttctttaccaaactgctatatgatttaatacctgcaaagccttggcctatgtctgacaaaacaggaagtgctatatgggttggctatttttgtgtataattatgcatttcttaatgataatgcattgctggattacttatgctactaaacgtaaacgtattggccaggcgcggtggctcacgcctctaatcccagcactttgggaggccgaggcaggcggatcacctgaggtcaggagtttgagaccagcctgaccaacatggagaaaccccgtctctactaaaaatacaaaattagccaggcgtggtagcccacgcctgtaatcccggctactcgggaggctggggcaggagaatcgcttgaacccgggaggcggaggttgcggtgaaccgagatcacgccattgcactacagcctgggcaacaaaagcgaaactccgtctcaaaaaaaaaaaaataaagtaaacgtattgcaatcattttaactctctgcgcccagctgatgaccaagtgtaaggcccgttcattactactttctccatcctgaatccagcagggagggtaataggacacaaggtaaacaattcttggaaaaactgcggcatcccacctgaccccgtccagcctcctgtcaaccagtgcgcaagtgcgagtaggcggtgcccagcgctccgccgccccgccctctgcggaggtgataacgacactgagcagcgacgcgcacttttgggacgcgcttgtgacccgccttccggaaggaagcggctaactatggcgaccgccacggagcagtgggttctggtggagatggtacaggcgctttacgaggtgggctccgcgccattagcggtccgcgaccacacccgggcccggggagggtgggaggacgcgtgtggatttgtggcctgagacctcggcgggactggctcggtcacgcccagactcggtgcctcttgctggaaggactgccgggagcttctagtcccagcggttgagtgtagggaggaacgggcgggggcgggggctgggactgagggtctcggtttgaattcttatgctccgggtcccctggaagctccggaaaggaacacgtgtaaggggacgcaggagacaggtctgcaaaaaccagagtttagacggacgataaaacggagtggtgaaaatgagtggaacaccttcgtctgggaaggtcctaaggaagtcagctctttggaactacggtacagttcgttggggaataaaattgtaataaattggagtttgtttttgtcgaaaagaaatcaagtgacttaggatttgtgaataaaaaatagtttgtcattcttctgcgtacatcagttttctgtcttataaagatacaactagtttagtcgatttttatttatttatttttgttttttttttttgagacggtgtttcgcacttgttgctcaagctggagtgcaagggcgtgatctcggctcactacaacctccgcctcccgggtttaagcgattctcctgcctcagcttcccaggtagctgagattacaggcatgtgccaccatgcccggccaattttttatttttattagagacggggtttctgcatgttggtcaggctggtctcgaactcccgacctcaggtgatccgcccgccttggcctcccaaagtgctgggattataggcttgagccactgcacctggccgtagacttttaaaggaagaatagttaagagttttttgaagcctagttatttcagatacataagataataagaaaccagaatgtcaatcttagtgttcattcatttaataactgagagtccccgtgctgtcttgcagagctattcattgggcactgaagaacttattttattttattttattttttaaagacagggtttcactctgtcgcccaggctagagtgcagtggtgcgatcagctcactgctgcgttgacctcccagactcaagcgatcctcccacctcagactcccgagtagctgggaccacataccaccatgcccaactaatctttttttttttttaatagagacgggggcttgctgtgttgcccagcctggcctcgaactcctggcctcaagtaatcctcctgctttggcctcccaaagtgctgggattacaggcatgagctaccacacccagctgcaactgaatttttaatttaacttaaatagccacgtgtaacttagtgactgtccacattggaccacacagatctagatgctagggatagtgcggtgaacaaataggcagaagtccctgtgcttaaagagcttacattcatttcaagtgaatttcactttacttttgatgatttaatatcaccaaacttaatatcaccgtctactggtaggggtaatgacagtgtcttccattgcaggacatactgggaattttatcttgaaacagcagagacagcagatgtggctctgtcttatgctcatgtattaagtgatgcccagtattaggttaactgtagtgacctaaaatgagccactaaaattgaatgatcttttttataaatgattttttaaagaaatggattattttctgttaaatgttgtttgctccctttttgaagactgacagtagtgtaacttctcattccccgaaactgtccaacagtgagacttgggagaactcctgtatgtaacatttcctgggaaggaaaagaagtggtgtttgtgatttttattaattcactagagagagagtttctcagcttttcttagggtgatttctttttggagtgggctcttaactagtggctggggcagatgtttgcttgctagaatccaactattgagaaaactaaaagggtatttagacttattcataaatgaattgtatttagggggatgagcaaattttaaaattcatcataaacttcttactcccaaatcctatgcgtgttgaatgtagaatttgagtagtcttgtatagtgtacccaaaaaagaaccactgaaattaaataatccgatggttaatattgggattctgtgttagattttatttatttatttatttgagacggagttttgctcctgttgcccaggctggagtgcagtggtgtgatctcggctcaccacaacctccacctcctgggttcaagcgattctcctgcctcagcctcccaagtagctgggattacaggtatgcgccaccagacccagctaattttgtatttttaatagagacagggtttctccatgttggtcaggctggtctcaaactcccgccctcaggtgatctgcccaccttggcctcccaaagtgctgggattacaagtatgagccaccacgcctggcctagattttatttttttaattttaatttttattcccaaagaagttttaaaagctaaaaatattaggggtttttcatgtgagggagaaattgcctgctattagaaatggggaaaggaatgaatagaaattaagggagcttcgaaagtaaattgttaagaataggctaaaagtcacaggaggcagtatatgcaggtgtagtaaattttatgtgcaggtgttagaagtgtatgtttcatatcttacttgtttttgactcactcttaggctcctgcttaccatcttattttggaagggattctgatcctctggataatcagacttcttttctctaagacttacaaattacaagaacgatctgatcttacagtcaaggtacgaaattaaatctctgttttaattattgggtatgtgattatagttgctatgtctttccagaaaggatttgtggtggctcaaccatgtgtgttaaagcattttctgtaatgtaaggaaatcaaggggaatgaattattagggtaggcaaaatatggggaaatctagaaataaagtcagtacccaaatgaagaccatattatggtcttggatactttgctaggagtaaacagcagtcttgcaaatagatggttagagggaagcatgggcaactactggagtttgaatattcataagtgttgtgtgagttgctgcagaatagcacaactatttctgaagtatgggataaagattcccctgtggtcttcttaaaggagagtcagagtagaaaagaatcctactcatacccatctcaaattgaatttttatgtgtatggtaaatcaaaaaagaattctgagcatagaagttaaattttcataaattgtcaagtcacccacaaaactacatggaaaagaacctctagctctagtgataaggaaagaggcgagggtggttagtgcacaaaactcacaagtgattgtttttattctagccacaacgagacatggtatttctagcagtgtattcactgtgacttttgcattgcagcagacaattttgatattgccgaagttgaagtaaagtgactgcgcctgaaaagcttcagggggtttgaataaggatagctataataacaagtgctatgtggcttacggaggaatgagtgataagtgattttaaatcagtttgtcttagacaaatagagcttgttataactattcctcataaggatagtatgaggaaggggtaggatatatattctattagggggctgaggatgagggtaagtcatatgataccgtagcctcctaactactgagctggcaatagagacttctatgtgggctttagggagtcataggtgaagttcgtataggggtatttttactataaaagccataatacatgctagtcatataaggttgttagatcagaagtttaatagttcttgattagtaaacattattattaggatatttagtgaacctgagctatttcaggtgtggatgagtgtaataagtaagggaagggatcctactagtgtgtaaaataagtatgagcttgcattaggcattctggttggttacctcagcaggtaataatgattagggtagggatgagtgtagcttcgaaaagaatgtaaagtatgactagttctgtggctgtaaatgctgtaatttaaaaaagttgtaggaaaattaatttggaaatacggagtttttttccataagggtgattcattagataggtgatgttggcctgctaggattataagaggtagtagtcaggctgtttggattagaagaggtgatgttaatgcgtcagaagaaaaagttaatgagaagttagatgaattattgtttggttgattaaaaaataatagggtaatgaggctgatgaataggctatgagtagctatattcagactatagagtttttggagagttatattgtaacagtataattgttggaataataatttttggcattggagtaaatttagattttgtacatagtctaggccttatgcgttggagattgagactaggaaagcaaggcctactgcggctttgcaggcagcaaatactaagaggataatgggtattatgaatcctagagtgaaatgcatgtttaaaattatgagtgtatttatgataaatattgatagtatgatgccttctaggcataatagagatggtattaggtgggatcgatagattagtactcccagcagtgctatggtatatgctaatataatgttaatataaataaatggcatttggtaaatatggtctatcataatctaatgagtcgaaatcatttaatttaaactatttaccagttcaactcaatctaatcctttttgggttcattcataaattaggcctaggattagaatggtaattagtagaagggttgtactgattattagtataaggttatttgtttgaagggctcatggcaggggtaggaataggacgatttctaatcgaataggagaaatgtgatggctactagaaagaattttatggagaagaggaggtgggtagaggttaatggatcaaatctacattcataaaggctggatttttctatgtaagtattaagttatgcaagtcaaaatgtaattactactaataatagagttaataaagtgtcagttattagggctagtgctaggttaattactctttttcagactttgtcgaaactagttgattggaagtcagtggtactgcttatactaaaagagtagtaggaccctcaccagtagatagagacacatgggaatagtcatacgacatctacaaagtgtcaatatcaagtggcgtctttaaagccaaaatggtggttggatgtaaaatgaattttttttttttgagacagagtttcgctcttgttgcccaggctggagtgcaatggcgcaatcttgcctcaccgcagcctccgcctcccaggttcaagcgattctcctgcctcagccttcccgagtagctgggattataggcatgtgccaccacgcccagcaaattttgtatttgtattagagacggggtttctccatgttggtcaggctggtctcgaactcccgacctcaggtgatgtgcccacctcggcctcccaaagtgctgggattacagggatgagccaccatgcccggcctaaaatgaaattttaattggcagagaaggcagatggtgagaattgttgatccaatagtaacatgaagtccatgaaagcctgtgactataaagaatgttgagctgtagattccatcagagataataaagggggcctcgaaatattctgagatttgtggaagggtgaaatagactcctaagaggattgtggtaagtagtgcttgaattgtttgtttttggttaccttctgttaggctgtgatgggctcaagtcactgaaactcctgatgcaagtaatatagacgtatttaggagaggtgcttctgaagggttcaggggaagaatacctgttgggggtcaatgtcctcctaattctggggtcggtgctaaactggagtgatagcatgcccagaaaaaaccggcgaagaaggatacttctgagataataggagcatcctgtatcggaggcctttttggacaattgctgtgtggtggccttggaatgtactttctcggacaatatcacgtcatcattgatatatagtcagtgtgttggttagtaggcctaaagttaaaagagtggtagaattaaagtgaaatcctatggttaggccagatgttattaggagagccgagagagctcctgttagtggtcaagggctaggtacaactatatggtaggcatgtgtctggtgggtcattatgtattatgcgaacaaagactaatagtgtgaagacataagcttgaataagagtgacagcgaacttgagaatagttagtagaattagaataataagaaatactgaagttgcagagacactaataattgataatattagcactgcactgtattttaattctttttctcctgtaggaaaaagaagaactgattgaagagtggcaaccagaacctcttgttcctcctgtcccaaaagaccatcctgctctcaactacaacatcgtttcagggtaaattgattttgctacctgaagtacttgtatttggcttcttgtagtaacctgcagtctatagtgctttatatgtagtagtcctttttttatctgaaacaaaacattttgaagttcccaggagtaacagctttagctcctgattttaaaaaatttattctagggatgatacaggcattttttaaaatctccaatttaagcattaatgtttgcccttttttccaagaatgcacacatgttaatatttccaatggtcgaacacttaaaatgaaaagcaacagacttctgctttttacccatctggttattttctgattttaaatttgtcgcacgttaccctcataattctagatactgtatagtatgcttaactaccatttgttgattcatcaactacagacaacacctgttgatccccacaatatgaattatggagcttccgctcacttatgcctctttcctccttgcttccagtgtctcatctattttttacttttcattctcttggctatctttgctatattgtatgtattttcattaattaagaaatacagtaagaatatagaaagttatcagatatagatatagatatcagacacctatatacctaccacccagaattaattggtgttaacattttgctatttttaattcaaacttacttttacaggtaaatacaatattacaaatgcatcttaagaaattccttcacatccatcacttactcttgcctctcatacggataactactgtcttgaagttggtgattgtgttttctttgcctatatttataattttaccatatatgcctgttgccataaaaatacttggtttattttaaaatgtgatacaagatattttcctgagtagtattgttctgattctgatctgatcaaacaggagcttctattctttacttctgtagatctcttcagtcttataaaacttttatatattctgaaatcaaacctaccaatcttttttttttgagacagagtctcgctctgtcgcccagtctggagtgtagtggcgcaatctcggctcactgcaagcttcgcctcccgggttcacgccattatcctgcctcagcctcccgaggagctgggactacaggcgcatgctgccatgcccggctaattttttgtatttttagtagagatggagtttcactgtgttagccaggatggtctcgatttcctgactttgtgatccgccggcctcggcctcccaaagtgctgggattacaggcgtgagccgccgcacctggcccaaatttaccaatcttttatagtttggtcttttgaagtcttagggaatcgtttcctaccctaaagatctaatttgattgttttccatatgatggtcagttgtctcagcattattagttgaataatccagtatttacctactgcttggaaatttcccttctttggtaagccagattcccttctaaagggtctatttctggcttttatttttattcattggatatattcgtatctccttataccagagactcattcatgtataccacagctttataataaacgttgattagaatgtttttctatctccgtgttcttcaaaattgtctagactattcttgacccttcttcactgtgagtttaggtttaggtgatcatatttaaccaaaaaaatgcatttgggttttttattagaagtgtgttgaatttatggattaatttaggaggcttggtatcttgctgatacttaatctcactacccatttacatggtatatattgcttgcatacttgggtcttttgttttctatagtaaagttgctggaagaggaggaggggaggaaagaggaggagaggaatgcacacatatgggtgtaggaggctcccttctgaagggaggctggaaggagaaagatgtggggctaggatgtgtggggcatgggtcagaggtcagaggcactgaaactgcagctgaatgagagcagcctcctttctcattaggtggaacccccaaaatgggggcaaggtcagtgggaagagccagggaagagttaggaattatggatatcaaattttactcaattcttggtgtgagagaaggtggagggacaggcaaaatgaggggcccaacagcacgtgggccgagtcagagtaagacgaggagctgggatccgtgaagtgtaggtggccaggggcagggagtctcagcaggtgtggagacagcaggggcaggctgggtgccactgcagtttgccatgtcttacttttttttttttttttttttgagacggagtcttgctttgtcaccaggctggagtgcagtggtgcgatctcggctcactgcaacctccacttcctgggttcaagccattctcctgcctcagcctctcgagtagctgagactacaggcacaagccaccatgcctgcctaatttttgtattttcagtagagacggagtttcaccatgttggccagaatgatctcaatctccttttttttaattaaaaagtaaactttaatgtcgaaaatgcagacttggggagggcagaaagatcacacacaaggctgtcacttcacacttggaaggttgcacagcagcgggcagagacgctcctcacttcccagatggtgagggggccgggcagaggcgctcctcacttcccagacggtgcaggggctgggcagaggcgctcctcccttacaaacggtgagggggccgggcagaggtgctcctcacttgccagacagggtggcggctgggcagaagtgctcctcacttcccagatgggacggcggccaggcagaggtgcttctcatttcccagatggtgaggaggccgggcagaggcactcctcacttcgcagacaggacggcggcaaggcagaggcgctcctcatttcccagacggtgaggaggccgggcagaggcactcctcacttcgcagacaggacggcggcaaggcagaggcgctccttacttcccagacagggcggcggctgggcagaggcactcctcacttcccgggctgtgaggcggccaggcagaggcactcgtcacttcccagagagggtgggggcctggcagaggcgctcctcactgcccagacggtgcggtggccaggcagaggcgctcctcacttcccagatggtggggcggctgggcagaggcgctcctcacttcccagatggtggagcagccgggcagaggcgctcctcacttcccagatggtacaggcagagatgctcctcaggtctcaatctcttgacctcctgatccacccgcctgggcctcccaaagtgctggattacaggcgtgggccaccacgcctgccctgctgtctcttctttctcctcctaagcagctctcttagtctcctgaattttgatgttctacttaacaacctcatgttcttacgcatgttgccctgctggaggcgtccttctctttgggaagcctgacccaccaacagtgcctcaggagatagacatggaagcttagccggtgggggcccctcatctctctcccacctcagttgcaggggaggggtcggttgcagctgcagcggtggccccgacagttttcttttgcgggacctgtggccggcagctctgggtggagaagacctacttgatccaagagctgcaggatccttgggctgcatgtcctcccccaccatcagcaagcctggagagctgggcaggtggtctttacccagcaccttcaaggccgccttctctggccacagggagcagcccggaactggggcagggagcactgttggaagtgggtcaggcttcccaaagggaaggatgcctccaacagggctgtgtgaactggcgactccatggcccttggagtagaaactcactgcatgcacctgggccttgtcagtctggttgttttctgtcaagctcttgaggtggacatttccctccaagggcctgggattgtaccaggaggaagtgaggtttccctgagtctccaggggcctagaggtggaggctgcttccccattgctacaggggccccttttattgtcctcctgcccctgggtctctacctggtctttcacctccgttgcttctttgggctcttctgccctcacctccatcttcgggagcctggctgggatcacctgctcatctaatgaaggaagttgaaggttaaacttgcctctgagacaagggatcctcacggggctgaggtgtccaaacatcctggagttgcgagcagacagcacgggtttcttccttgagggggggctccagaccacaggaggcaggaccctctgtggggtgcccgtgttccgagggataagacacagcctcataggggcgccatcccacctgactggaaaagaaggcccaagatgtcgctgacggttgaagaggagtgggaaacggccccagattcccggggcaggcacaggtgcaggagccgcggggtgagcccggccagctgggaaggcctcacggacaagacgagcaggttgccggtggcgtggccaggacctgcggtggaaccaggaacaaaatatgcttagtgagttgcccattttgagcgagttgtgcacagacgaaactaagggtcagaagcggagaggatactccgaagtcacccacttctctgtggccgggtgcacactgggcatctgggagtttatgacatcactatggggctggtgacagagccagggtgtgaaggagtgcttaggagcccagcgagggtgcctacaagaggagtcaaagggcaaagggtgagacccttccaccagtccccctggactctagcctcagggacgtcctgctcctgggggcaggtgtgtggccctggatgggcccccctgtggggctgttgggggtgcggggctgatccgccagagccatggcgcctggcccaggtgctggctggcacccagtggccctgtcttggacggccctgtcccccgggttacagggccagaacctggaagcagagcacaggaccagccagatcctgccaggctcccccggggcctttccagtgcctctgtgccgcctggagcaaggcccgccttctccatggctgccgtggcctcaagggccaccagccttgcttcgcaggtttccaaagagaggacgcggtgccctgacctgactggatgcgcctcttaccacatgcctccctggcaggcagggtctccgctttttacaaatttgcctgagaccattcctcaggtcattcaggtggtcatggcccagccaggctttgaacctgggctgtgcgattccacagctggcgttctggcctgtgtgcctcatgatcatggatacagcatctattcttattttttcctgtagttctggggtacttagcaccgtggcatatctgtaataagcacgtgcacacctcgaaggaggtcttcacttcagcatagaagttgaccatggcatgctctgggctccagtcttctacaaagatgtagggcaggaactaccagttgtcagcacagcaccatcccacattgctcttctaatggagcctttcaccccagatgttctttctcgtctgatgggaaggatccaagtatgtaaagattatgttctagatcagctttggtctgtcctaaaagaaatttgccagtggattattccatatggataaaagtcagtttctctggtcttcctggaatgtgtctagaaagcaaatacattatttacaagttcatagtagatcaatgtattggattaaaatatgacaaacataatttggtcattgtgagcatgccagctcggtcaactattcaccacacatgatgccctaaatataactctaggttttcttatgcccaagagagggacatactcttgggtgtctggactagggaaacatgtatgaaaaaccatttggccactctacatcttgttattggagaatcgaaaccatctatattcaaagatattattaaaaggtaagaagttaacttctgtcattttgttaattgttttctggttgttttgtagatcttttgtttctttttttattgtttgctttatggtttggtgagtttctgtactgataagctttgattcctttatttcattgacatatctggtgtaatttttttctctggttactctggagcttacatttaaaaatgtatagttatgatagactatttaaagctgataaaaattttgatcacacacgaacctgctatactacccccacatcccttgtcagtgcacaaaatttgtacttttttgccttaatttatattgttctgtattgggtgtttattaataactcattgtagatataaatatttttgactattttgatgttcagctttctcaagggtgatttgaaagattctaaagcattaatttcagtaatgtagaattctcagtttgaatatgaatttacttttaacagttaggtggatagtgtcctgtttttgcattagtattctttcacttgcgattgaagcacttgttaagcatttcttgtcaggctggtcttatggtgatgaattccataagcatttgcttgtctgggaaagactttatttctttaatttctgatgggtagctgtgctcagtacagtactctttgctgactgatttctcattagcactttgaatatatcatcctcatctttcctagccttcaaggtttctgctgtgaaaactgatagtctaatggagacttgcttatttgtgatctgatgcttctttcttgctaattttagaagtttttctttgtgtttgacttttgacaaattgattataatgtgccttagaaaaggcctttttgggttgaatatgtccctttaagcttcacggaactggatgtccgtatctctcccaagaattgggagattttcagctattgttttgttaaataagttttctgtgtctttgtctcttttctctgtttctcttctatattttcaaaatctgttatcttagtatcatggcacaagtctcatagactttctttgattctttttactctttttttctccttttttccctcagtctgggttatttcagaagtcctgtctgcaagttcagaaattcttttgtttgatctagtgtgccattgaagctgtcagtggtactttttaatttaattcattcaattcttcattcctaaggtttctgttggtttgttttcttttttcttttctctttttttttttttttttttttgagacggagtcttgctctgtcgcccaggctggagtgcagtggcacgatctcggctcactgcaagctccgcctcccaggttcacgccattctcctgcctcagcctccggagtagctgggactacaggcacccgccaccacgcccggctaattgtttgtatttttagtagagacagggtttcatcctgttagccaggatggtctagatctcctgacctcgtgatccgcccacctcggccttccaaagtgctgggattacaggtgtgagccaccacgcctggcctgtttgttttctttaatggtatctatgtctttgttgaatttctcattcaggctatggcttgtttttttttattattcgattaagttttctctctgtattcttttgtatctcattgaattttcttaagatcaatatttcaaattccttttaaggcaatttgaaaatttccatttatttagggtaactttgtgaagaattattgtgcaactttggtggtgtcaagtttcattgcattttcatgctttttatctcctatgtttatatttatgagactgttgacacggtcacctgttctaattgtatagagtggcttatgtagagaaagattttcacctggagatgtgtcttagggtgtcagttggatgggctgcatctgctttagttctaggaggacacagtagtgtaatatctgtgcttttctcttgcctgttttttttttttttcttttgctagtatccattttggtgatacctgtgagtgtcttggtgacctaggctgtaggagcatgtgcagtttgtttttctgctcaggactgggggctgggggagaaggcggcggtgtcaggaagctgcatgcctatctagtgactgtgttactgagtcacaggggttggtacaccagtttgagatgggactcccctggaaacactcgcctagctgtggattactggggctggtctgcaggtttgagatggggatcacctagaaacaccagggccagttggtgagcgcactgatggcacaataaatcagtaatcggtccacagttagagtgttgcagtcactaggatgtggaaggcaaacctctttgagagtttgtttctaggatatagacagcagtagctgctttcctggagaaggctgttgtaatgacagggtagcccctgggatggaaggaggcagtgaccactagttcatggaacagaatatactcagctatggcttggctttctagatggtgctatatgtgggctccttctctggggcagtatagccctgtgggcatcaagcagcttcctaaactaggctgctagagatggggtttcaccatgttggtcaggctggtctcaaactcctgacctctggtgatctgcccgcctcggcctcccaaagtgctgggatcacaggcgtgagcccccatacctgacctaccttttttttttttttgttaagaaacttgcttatgttgttctttattttcttcttgacttttttttccccaggtttccttacagtcatgcgtcacttaatgacgtagatacgttctgagaaatgtgttaggcaattccattgtcatgcaaacatcatagagtggacttacacagacctagatgtgtagtgtgtacctataacctggtacgcacctagactatatggtatagcctattgctcctaggtcacaaactatacagcatgttactctactgaatactctaggcagttgtagtaaaatggtatttgtgtatctaaatatatttaagtatagagaaggtacaatagggccaggcatgatggctcatgcctgcaatctcagcactttgggaggctgaggtgggcaggtcacttgagcccaggaatttgagaccagcctgggcaacatgacaaaaccccttctctaccaaagaatccaaaaaattaggtgggtgtggtaatataggcctatagtcccagctacttgggaggatgaggtgggaagatggcttgagcctgggaggtggaggttgcagtgaaacaagattgtgccactgtgctccatcctgggcaacagagccagaccctgtcttaaaaaaaaaaaaaaaaagtacagtaaaaatacagtattttactcttataggaccactgttgtatatgtggtccattttgtcaattgagatgttaaatggcacgcgactgtatatccattaattgtaggcgatttgagactggctctctgaaaacacatctacactcactgtgcccaggcctggaatagctcctgtcatgcctttgtgtggattaggggaaggtactcttcctccagcaagtgcagcagcctggtgcagaccttgggctgtggtgccgatccctgggtgcccctaacaggaccccagctcatgcagcaaccttgctctgccctttcttctggcagagttcagatataggataatgtgtccttagataatttagtggttatatttttatgacttcattagtattattcattagttgggccaatgttatgaggctatattttctttattggatacttttgttttccccagagttaatcatttttgtttggttacttgattggttctacagtggtctttatgttgtttgcctctaggagcataaaactccattcagaatgttcacacgttagttatctattagattcactttctttgttctttctcctgctccactcctgactggttgttatatgcagctgctacacagggtggccctggagtgtcccatcaccattagcttgagaatttcctttctctgttctgcattggctatttcctgtctcttggtttacagtagattatagatagatttcagagaagggtcatggaaggtgaatttttttttttgaaacctacacatcttaaaattttttatttttacccttttgcactgtactgattgttttatcagttttattgatctgttagacacttcctcaatatctggtgattgttaacatcccttcttttttttcaatatgcacaatatttttattgtcatcaagaacattatgtaaattgtttgcagaaactacaagaaaattgaaggttgttttgttgatagtgaaaggcaatggaagggcactgtggatcaataaggctgaggggcgagacaaagagggcaaaaatctttactgagctctcgggcgaggttcactggtccgcagggggagggccagggaagtcgcgctgtgccaaaggtgcagagcgcttttatggatgctgggtgaggagtgggcggggtaggggcgggataggttgagtttcgtgcttctgagtgtgacacgccctagtgggcatgcgcgttggtccgggtggcgggaacaggaaaggtgaacccggaaatgctgagtcagggtacccgatgtggctgtcaggatggcgggaataagcgaaaatgccaagtcagggtagccaagatggctgccgagatggcgggaaccggtgaatccgggaatgctgagtcagggtagccaagatggttaccgatcgccatcttggagtcttcaccggagtccaatcagattacattcagtgttacttttcttcaatttatgcaatacctatttacattcaatactgagttgacacaagagtaagcgaattaacttagatttttttcctttagacagaagccttattgatatataatctatttaccataaaatttaccattttgaagtgtaaggtttttttcctttaaacagcagctgtattgatacgtaatctatataccataaaatctgtcattttgaagtgtataattaagtggtttttagcatattcccagagttatacaactatcaccaccatctaattccaaaatatttttatcaccccaaaagaaatcccaaagccattagcagttacttcccactccttcctctgcccaggccttagcaaccatttatctactttatggacttgcctattctggacatttcacattaaaaggaataaacaatacttagcctttgtttctgggttctttcacttaacataatgttttcaggactcatccacattgtagcatgtatccgtacttcattttatcaccaaataatatttcagtgtatggatacacacattttgtttatacattaatcagttgatgcacaattgggttttttccctcgtaagagtatatgaaaaaataaaaaataataaaactgctatgaaataatgtgtacacatttttgcatgggcataatgttttaatttttcttggatatatacctaggagtaggattgctgtgtcatgtgataactctgtgtttaacattttgaggaacccccaaactgttttccaaagtggttgcatcattttatattcccactagctacatatgaggtttacaatttcttcacatccttagcaatgcttattattttctattttattgtagccatcctagtaggtgggaagtgggatcttatggttttaatttgcatttcccagataactaatgatgttgagcaccttttcatcggcttattggccatttgtatattttctttggagaaatgtctactttaatcacttagctgttttcaattgggggttctttctatcattaaaactgtaaaagttctttatatattttgaatcctagtcccttgtcagatatatgatttgcagattttttttttcattctgtgggattttattttacttctttgatagtgatctttgaaattcaaaagtttattttaatgatgtctgacttccctgtttttccttttgttgcttgtacttttttgtcatctgtaaaaactttggcttaatctaaggttatgaagatttactctttcctgtcttctaacagtttatagtttttgcccttacatttagtgtgtaattcaagttaatttttgtatatggtgtgaggtagaggcctatctttatctttttccaggtggatgtcaagttgtcctagcaccgtttgttgaaaagactatttcccttctgagttgtcttgttgaaaatcagttgaccataaatgtaaggatggtctattttcaagaatgacacatgaaaatggtcattgagagccctgttaaaatgggcttggctttttcttcagttttactgaggtataattgctaaataaaaattgtatatattcaagatgtataataagatgattttatatttatatatatatacacacacacacattgtgaaataatgaccacaatcaaattaacatatccatcaccacatttagttaccatttgtgttttagaggggtgaggatggggtgggctttttgactgaggggcttgcactaggataatcagacagggacctgttcgtttatttgaggggacccccaaacttagtatttatagtttttattctcttggctttgtgtttcccaggagaggagtcctctagtctattactttgcaggtaaaaagctgctttccaccatttgggagctgagttgaaggcaagaggcccagggtcttaccattcattatgtaactcacacctaatttttgtcttcagaacggcacccctgccttcactcattcttaggacttccagtttatacacagcctctccagagagcacttcttcagggtggaggaggggagtgactgcctgttgtctaggcacccagccagtcctcctgttgtcggcctttcccgttttccagtgtttaatggaagctggtgccccagtttgggagcatgtttcaggcgttgctgcttggcttttcactgctggcctaggcttgcctttctctttgatctctttgacttatcaaatacaacttatccatttgctttccagtttcccacattttgtcacctttctccttgttctggtctgggtgggtttagacctttaaactttgtaggcattttgcatttgctttctgagtgtgctttcagaagagatcaagggttgaggtgttttttaatgttagctgatattaagtggtatgaagaaatatcaaagcagggtcagtaaagagaggtagagttgctgcatatatttcttgttcatttcttttgactgctacatattcttctgtgtatacagccaccaaattttacttctccattttcctcatgatagacacctaaaccgcccccatttcccactgctgcaaagaatcctctgattaatattccctcatgaacctaatattcccttgaatttctctgggggtatagaaccaggaataggatactgatatatgcctgcctaattttcctgtaggacttttctgtgtcatctatggtcccctgagatagtatataggaattcaagttttccctacatctctgtttagcaatactgtttgctttggatttctcttaatgtttgagcctttgagcatcacttcatctactttttagctactggagtcttctgcttctttgaatgcctcttcatatcttttacctgtttttttactggattcccagtctttcttttgattagcgaaggttctgtataccttgtagattttaatccttagtcaatttttgagttagtactctgttacattgattctaagacacatactgtttttccctagtttaaaatctttgaagtggggatgaatcttaaagctgctgagagtcactgatgagtcattgtcagccaggaaggtagtttgtgacatggttgtcattgcttatgtaccagtgaacttcgtggtggcgggcttactgtcagcactccagttgaagtgtatgccctgctggtcaatgaggcaactgatagccggagaaatggccagacctgcagagcagaggcagaggatgacaaaaggctttgaagatctctttgtcagacttcctgttgcctttgggtagtatcagcttactttctagaaacatgtgatttaattggaaggacgataaaactatgaggttagttcaataggaaagttgcagcatcagaacttgagaatgggtgacagttaacatgtcagataatctcagaaatcatagtggagcatgctggtaagaaatgccaagacactgccaagagcaaggagaacatggtatgaaaacttgtggtatcagtgacttagaggagagggacagaactcagttaaagaggttttaggaatgtcttgacttacattttccttttcataagtacaaatgtagtgtaacaaaaatctgggtctaagaatgtataatagacctttgcattaagcataaactaaaaagctgcacatgacaagaaaacatcattgtattttaattgacactgtttctcttccttagtgatggataaaatacaattgatgacatcttagattcagtgaaatacaataaacctcttctctatcacccgtctgttaactttgtctttggtatctttcgttgaaccaaatttcttaattttgacttggtcagatgcatccatcttggccttacggtttgtattcttaaagacttggttaagaaatcatttcctaccctgaggtcccaaagacattcttccacattttgttatcttttctaaaataccttttagatttttaatatggctggaattcactttatacctggctgttcaactttatccgtagagaaaaatttgtgtgaaacctagtggtttgtggggtaactgctgtcattttccaggtatttgtatgtacacagttctcatgaattctagattctttcattggtctctgcctacctgcaaatattacagtatttgcttccttctggtaaagcacctcccggtttctaaattcagttagccattcctgaacttgtatccttctgtgtaattattgaagtttatagagctccattagaaatcctggtggaattttagttgtgattgcattgagtttgtagtttatcttggcaaaatgtaatatctttaaaatgttgagccatcccttcagctgaccatcgtatatcttatcatttattactgtctttatatttttcttgatactgtaaatactttgtattttgttacctttatttactattaattccaatggtttgttgatttcgttgagttttttatgtaaggtgatcatatcacctgctgataacagtgtgactcttctcagacgtgtgtgtgtgtgtgcacacttgtttattcacatttttggacttacagttttactggtatggcctttagtaatatgctgaatagtaaaaagataccaagcatccttgttttgttcatattcataaaagtaatggctctcttgtttcccagttaatatctgtaggttttaggtattatagtcttatcaattcgagaccatttcctccgatctagttttctaagagttttataaatagatgttgaacttcatcaaatgttatttctgcatctaagatcattgcatgacttttctttattatgttgtattttctgaaatttttacttcttatttaacttctattaatatatctcttaggtgtactctgttctttttctaacttagttgaacacttaatttacatttttaatcttttctagtattgattgacattctctttacaaaacaccctgagtgtaattcaggattcaggcttaaaaaaaggttttgaaagataataaagtacgtattccttattacagaaccactctcatgcagtctagggcagcatccccagaatagtttcattccattgagtaaataaaagcagtaaagagtttcatatatgtttaggacaggttttgctactgaatgaacttgctgcaaactttcaaaattgagtgtgaggcataatgaacttttctgtgtttaagcctataaattcccttctaagtactattccagctgtaggctatactttttttggggggagggaggatggagtcttgccctgttgtcaggctggagtgcagtggcgcaatctcggctcactgcaacctttgcctcccaggttcaagccattctcctgcctcagcctccccagtagctggaactacaggtgtgtgccaccacgcccagctaatttattattattattttttaatagagacagggtttcaccatgttggccaggatggtctcaatctcttgacctcgggtgatccacccgccttaacctcccaaagtgctggtattacaggcatgagtcactgcacccggcctgtaggctatacttctaatgtgtgttattcagacctaaatattttttaattttcttttttttctttgactaaagcataatgttttccttgagtttttgtcttctcagtaatttataatttattgctatgtgattaaaaaacatgttctggatgatagcttttctgaatgatttggctgctcttgttgacacttgctttatgtcttactttattgtaaattttgcaaatgttccacggctttatcacaaaaatttatattatatattccttttattcaaggtgtcttgtgtccattacatcaagcactttaattattattcaaatagttgacagtcttagccgttttctgtctggtatgtaaatgaatgagaaagaaagagacagtataaagatcagtattacccaccgtatggattcattctctgtctctgtttcgtttttaaattgtttagtttgaaggtgtgaaatgtatgtgggctcagcatttttacatcgttttgaatgtcccttatctctaacaaaaattatgttttaccttaaagtccatttgtctgatagcagtgtagctacaccagctatcatttagttattctgtgattaataggactctgttttcaattttactgtatcattgtgtgtagttcttttgtacataattggattttaatcctagtatcattttttaactgaggagtttaatctgtttacatttattttgattactaacttatttgtatagtaaacactaatatctgctgaaatatgaggtgattcacaattttcccagtagcatttaaaagagtttcttggccaatttgatatgtaaatttaaagggatgtataagaaatggccaaaaataatgttatttgatttattaatgtaattgcacatatatatttaaaatgtcattgtgcaaataatatattcaaaaatactgctctttcctttaccccatgcagcagttttattctaattcttcctaggcatcttggataccatattcatcattagaagcattgaaaaatttatgtttaaagtctgtcattttcacgtctgtctgaatacttggatgcataactttttgaatctgtgtatgttgctatccctcaaaattttacccaagtctcattcagtatttgtggttctacacttgaccccttacagggttgctttttgttgtggtctttaaaaggtttgcttacttggttgtatactgtttcattgtgaagtcccgctcccaggaatatgtattatgtgtgggaaataagtacaatatctgtgtcaaattattttacctccctttataaaaaacaaactgatttcttcaaaacacctaaaggtagcattgttagagatcattctggttgaagttgtaactaattagtagtgggtacagctgcatataataggaaacccaaacttagatggcttagggaaagtagaagtttatttgccctcacaagtggggagcaaggtagctagcgccacagatgattagggacccaggttaccatcctgtgttctgtccttgaggtgtgtgacttccattcataagtcaccttaagggaggatgtcaggcagatgggcagaaaagagtctccttctgggcctgtcagcttggttacggcaatgctggccacacctagttgcaggagcagctgacagaagtggtcttttgttccagggcagtggccttaattttttcatttcttttttttttcccttgcctttagtctgcttgatcaggttttcttgattagacttcccttattcttttcttctcctcatgcttaacataagtaattcctgtccaatttttttttgtttgttttttgagacagggtctcactctgttgcccaggctggaatgcagtggcaccgtctcagctcactgcagtgtctctctcccaggtgcaagggattctcctgcctccgcctctggagtagctgggattacaggcatgcaccaccacacccggctaatattttttgtatttttagtagagacagggtttcaccatgttggccaggctggtctcggactcctgacctcaagtgatccccctgctttggtgtcccaaagtgctgggattgcgggcatgagccaccttgccccaaatgttaattaatcttcctctcttccttactgagcagtacagggacttactagactcctacttcagttgttccccatccccactccccctttcttgatgtctgatatttgacctccacttattttgtatcctccaggattattatatttgagaatcaccttctttacctatttaccactttcttattgccagtctttaggtatttctttctttatccgtgcagcttctttgcgcttaaaatttctttttctaaaatatattctctattagattgttatgtagagattcagagaaggtaatctgtatctcttaatgagaaatgtttttattttacctccttggatgacagttagtgggtaacaggttctaagtggatcattatttgccctgcagccttggagaatttcttcatcatggcctggcctgtgttatggggagactgtgtcagtctaattattgttcatcttctgttttttctagtggctttcacaattatttttctctaaaattctacagtttcactgtcatgtgtcttcttgtaatttattcatatttatcctacttgggattcatttttgtacttcagtctgtggatttctgtctcccatgaattctgggaattttttagcttttatctgttcaaacattgtctctcacttttttcctccagtttttccctgtagagctaatgtttagtgtacttttaaccttcatatcctctacgttcagtatgtactctttcatatttttgcatctcttggtaatctcagctctgtctttcatttttctgcagtgtctgatggggtatttaatctatcttttagatttctaattttattggctcttagattttatttctggaagttatatttgactatttagcaagttagcctgtccttttttgtttttgtttttgagatagaattttgttcttcctgagcaggctggagtgcagtggcacaatctcgactcactgcaacctctgcctcctgggttcaagcgattctcctgctttagcctccccagtagctggtattataggcatgcgccaccatgcctagcttatttttttgtattattactagagatggggtctcaccatgttggtcaggctggtcttgaactcctgacctcaggtaatctgctcgcctcggcctcccaaagtgctgggattacaggtgtgagccaccacgcccagcccagcctgtccttttcttagtaactttttaacctttccttatgtttatgctcttgggagcactttctagtgtccagcgtctcgcgttcttgggcagtggcccttctgcatgtcttgtatcctgactctcactcatggtggggttgtggtttttgattgggaaagttgttttctctcttttgagtcctctcaggtctcgattgtggagatgtctttctggttggttttacttgcttctgcagcataccctataagattttaggttccaggattcctgtatcaagtgcccattatgacctattcctgctagcctgcatggggcacaggtctgagacttccatttctcaccggaaactttgttccttcgctactccaagtgctggacagaaatagtatccctacatcacatcatgctgccttctgatagcttttgagctgtggttaagtgttttggatatacttgttcttaatcatttgttttctgtgtattacagtttttatagaatggtctcaacgtttatggcacctttggtacatgggtggtctatctcggtatttgtttgttgtttgttttttgtttttaatctttttgtgactgccaatacctgactatgaaatcagggaggacttaggaaacttaaggaaaccttgagaagtaagaacctgaataacatgataaaatcagaatcacagttgaggaggtgagtggcactggatttgaaagagaagcccggagggcagccaagatagccgaataggaacagctccggtctacagctcccagcgtgagcgacgcagaagacgggtgatttctgcatttccatctgaggtactgggttcatctcactagggagtgccagacagtgggcgcaggacagtgggtgcagcgcaccatgtgcgagctgaagcagggtgaggcattgccttacttgggaagcgcaaggggtcagggagttccctttcctagtcaaagaaaggggtgacagacggcacctgaaaaattgggtcactcccaccctaatactgcgcttttccgacacgcttaaaaaacggcccaccaggagattatatccctcacctggctcggagggtcctacgcccacacagtctcgctgattgctagcacagcaatctgagatcaaactgcaaggcggcagcgaggccgggagaggggcgcccgccattgcccaggcttgcttaggtaaacaaagcagccgggaagctcgaactgggtggagcccaccacagctcaaggaggtctgcctgcctctgtaggctccacctctgggggcagggcacagacaaacaaaaagacagcagtaacctctgcagacttaaatgtccctgtctaacagctttgaagagagcagtggttctcccagcacgcagctggagatctgagaacgggcagactgcctcctcaagtgggtccctgacccctgacccctgagcagcctaactgggaggcaccccccagtaggggcagactgacacctcacacggctgggtactcctctgagacaaaacttccagaggaacgatcagacagcagcattcccggttcacgaaaatccgctgttctgcagccactgctgctgatagccaggcaaatagggtctggagtggacctctagcaaactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagagcagaaaaactggaaactctaaaaagcagagagcctctcctcctccaaaggaacgcagttcctcacaagcaatggaacaaagctggatggagaatgactttgacgagttgagagaagaaggcttcagacgatcaaactactctgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactatgtgaagaatgcagaagcctcaggagctgatgcgatcaactggaagaaagggtatcagcgatggaagatgaaatgaatgaaatgaagtgagaagggaagtttagagaaaaaagaataaaaagaaacaaacaaagcctccaagaaatatgggactatgtgaaaagaccaaatctacgtctgattggtgcacctgaaagtgacggggagaatggaaccaagttggaaaacactctgcaggatattatccaggagaacttccccaatctagcaaggcaggccaacattcagattcaggaaatacagagaacaccacaaagatactccttgagaagagcaactccaagacacataattgtcagattcaccaaagttgaaatgaaggaaaaaatgttaagggcagccagagagaaaggttgggttacccacaaagggaagcccatcagactaacagctgatctctcagcagaaactctacaagccagaagagagtggggaccaatattcaacattcttaaagaaaagaattttcaacccagaatttcatatccagccaaactaagcttcgtaagtgaaggagaaataaaatactttacagacaagcaaatgctgagagattttgtcaccaccaggcctgccctaaaagagctcctgaaggaagcattaaacatggaaaggaacaaccggtaccagtcactgcaaaatcatgccaaaatgtaaagaccatccagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgcattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagaccaaaagagacaaagaaggccattacataatggtaaagggatcaattcaacaagaagagctaactatcctaaatatatatgcacccaatacaggagcacccagaatcataaagcaagtcctgagtgacctacaaagagacttagactcccacacattaataatgggagactttaacaccccactgtcaacattagacagatcaacgagacagaaagtcaacaaggatacccaggaattgaactgagctctgcaccaaggggacctaacagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacactacataccaggatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctcgacacatacacccttccaagactaaaccaggaagaagttgaatctctgaatagaccaataacaagctctgaaattgtggcaataatcaatagcttaccaaccaaaaagagtccaggaccagatggattcacagccgaattctaccagaggtacaaggaagaactggtaccattccttctgaaactattccaatcaatagaaaaagagagaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttgtccaccatgatcaagtgggcttcatccctgggatgcaaggctggttcaatatatgcaaatcaataaatgtaatccagcatataaacagaaccaaagacaaaaactacatgattatctcaatagatgcagaaaaggcctttgacaaaattcaacaaccttcatgctgaaaactctcaataaattaggtattgatgggacgtatctcaaaataataagagctatctatgacagacccacagccaatatcatgctgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattccttcaaagagaatgaaatacctaggaatccaacttacaagggacatgaaggaccccttcaaggagaactacaaaccactgctcaaggaaataaaagaggatacaaacaaatggaagaacattccatgctcatgggtaggaagaatcaatattgtgaaaatggccatacttccccaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccacatatctacaactatctgatctttgacaaacctgagaaaatcaagcattggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattactattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaagaggcaacctacaaaatgggagaaaattttcacaacctactcatctgacaaagggctaatatccagaatctacaatgaactcaaacaaatttacaagaaaaaaacaaacaatcccatcaaaaagtgggcaaaggacatgaacagacacttctcaaaagaagacatgtatgcagccaaaaaacacatgaaaaaatgctcaccatcactggccatgagagaaatgcaaatcaaaaccataatgagataccatctcacaccagttagaatggcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattggggcactattcacaatagcaaagacttggaaccaacccaaatgtccgacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacactgagaacacatggacacaggaaggggaacatcacactctggggactgttgtggggtggggggagggggagggatagcattaggagatatacctaatgctaaatgacaagttaatgggtgcagcacaccagcatgtcacatgtatagatatgtaactaacctgcacattgtgcacatgtaccctaaaacttagagtataataataataaaataaaataaaatagagaagcccttgaagccttagggaagaagaaagaaaatatttggagagcacctcttatgagccaggcactttcataatagcaatttccctgagaggtagactctcccctactttaatgatgaagaaactgagaatcacagaggtcagtgatgtccctaagcttctgaatcgtcaatagccataatacagaggggatctctctgacagactctataacccatggttttttcactgagtcttcttgccttttttataagttagttcgctttcatgaatttacttcaagttgtcattcttttcttttcctggtttcccagcatctgtgttttctcaaggatgaccaatgctgttaaaaggtatcaatgagaatagtgtttctccattttttctggctacagtgcattttatagagcaacccagtacatggaccagtacagatacatagtcccatcactcaccctgtgccatggttctgatattttcttttccgttctattttgttttactgtttcctctggttaaaataggctgattgtgaccaactaacttggtctcacagccctttaacagtttgcaacccataatttgagcccatgattttgaaacatggctcatggctcgaatatagatcagcagagggcttaacggaagtaccttcaggagcccattctcctgtcccagccgggctcatatccggctccagtgtagctgccacccacattctccccgctccccaggagtgtgaggattcctcttcaacagcattccagcgttaactttagacattgggaacatatcccacttactctttagtggcttcctatacatgacatttctttttaagccgtttaactatgcaagatcataactcactctgcctattcttgcctttgatcttattttatattttcttcctgtttggcttattccagatttttctgagatactttatttagcagcttcattcttaagcgagttttaaaaccaaagcatttaagatttgccattcattcatcttggaattctagcttatttttcttttttattttcatagtacaggtattttattaaaaataaaattaatggaaaaatatcttatttttaatgtaccatgctctaatattacttcttaaaaacaagaaatcaaagaccagtatgcaaatagggtaggatgacaacactatgttgttgtgcctaccaccaaggtaatatgatagcatgtaacatgaatgtgtaattgacatgtaccactctatctcttccctagccctccaagccacaaaactgtggtgaatggaaaagaatgtataaacttcgcctcatttaattttcttggattgttggataaccctagggttaaggtgagtagcacatattgctgaagtggacagataacattactgatttaagaaactagacataaaagacaaaggcaggctgggcgtggtggatcacttcaggtcaggagtttaagaccagcctggccaacatggtgaaaccccatctctaccaaaaaatacaaaaattagcagggcatggtggcacatgcctgtagtcccagctacttgggaggctgaggtgggagaatttcttgggcccaggaggtggaggttgcagtgagccaagatggtgccactgcactccagcctgggcaacagggcgagactctatctccaaaaaaaagaaaaaaaatcatagtattggaaagcgctatgcaagtttttcccattactttttgtctgacagagttgtgagcgggacctagacagagagaggcaagagtctcttatgtggctcagtgttaggcagcaaccacagaactgaacaggccagacctagagaatagttggagaagggtctaggaaattgctctctctcctattgggattgtgggctaacaggcattttccaggaaagacttggcccacaaatgcagaaaagttaaccaggttttgagaatcaggctagtataacttttccatattttaagtcatatactcagtctttacacctgtctcttctttatattctgttagagttggaggaggaaggaaggagctctgtgggttaaagaataggaaatgtttgttttgaactcttaaagataaattattaaagtataattcttgtacttcaataaaggcagcagctttagcatctctaaagaagtatggcgtggggacttgtggacccagaggattttatggcacatttggtaagtttttgttgtgttctctttgagactactgctttcaatagttaagattcaattttaggctgggcatggtggctcacacctgtactcccagcactttggggaggctgaggtgggaggattccttgagcccaggaatttgataccagcatgggcaatatagggagaccctgtctctacaaaaaataataaaattagccgggcatggtgggctcatcctcgtgtgcatgtgtggggattgcagcgtgaggaacgagtgcagagcagcagtactctttatgcaggggagatggcctcatacttctgcccacagtccactgatgagagcggaacccctgccatgactagccacgcagggggctgagaaacagctctaggaagaaagtggagagcagattgcctggggtggagggaggggggataaacagtgtagttttttatctttctagaatgaagatgaaggatcattgatttccttgtgtatggataatccgggaacaggccaactaaatatttgatgaatgtatgatttcaaatacagtgaattccctgggagtcatcaaagaagaccggcattttatggttgtttttattaagtgtatattctttgctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaatgaatttattgctggaaatagcattttggcttataaaatgacacagtgtggggaaagtagagcaagggaaatatcttccatcttccatccttgtttccatttctggatctttttgtgtttttttactttaacagttaagttttttacttttgtgattttttaatgtaagggagcaccttatgttatccctaagctagtttggtgattacattatttgtcttggaaacagataaggagaagtagtgtccaggaatcctacagctggaagtgatctttaaaatctttagttctaaccctaaaattagaaattggccaggtttagtggctcatgcctgtaatcctaacactttgggaggccaagaagggaagattgcttgagcctaggcatatgagactagcctgggcaatgtagtgagaccccgtgtttacaagaaataaaaataaacctggcactagcgtgaacctgtagtcccagctacacaggtggcggaggcaggaggatcccttgatcctaggaggttgaggctgtaatgagccgtgttcacaccactgcaattcagcctggatgacagagtgagaccatctcaaaaatagtaataataataatataaaccaagtatcctgacttccattcttgatggcaagtttgaagaaataagctcatatcagagcctcccactttcctctagtctaatgcaaatgggttgtttgcttggtttttgattggtagggaattattttcttggcaggtattagaaaactagaaaaggcacattttatggggttgttgattgtaatctgatgaaagctttctgtgactgcttgctgaggtaaaggaattgtttttgtaggtaggtacggaggagagcagcagcttgttggtattagatatcagggagtttttgctgtatttttctaggaagtaaagaagttgtttgggagggtaaaggtggggatcattgaaagaggttcagaggtgtagggagatgggggaggttgctgagtcagctggcagggcagggacagctgtgtagtaggaggaagagaaggaaatacatagccaacaatctctggctaaggaaggattggagatggtgaggagggagtgggtgaggttgatggtttgctggagataattagatggaggggtagagggtggcaagggaatgggagtgagacaaagagtaagtataaaagaaaagaacttcatcagggtggaagaattggagagtaccttgccacagaaggtcatctgtccattctgagagagttaagggtggcagcttgagggtgacaccacgagatatcagctacaatggtctggagtaaaagcgtgaactggtagtatagacaaaagcagggcatttagaagtacgtgagaatggttagtagggacataagtagacagagtttaaatactggggtgactgtgtaaaggcctactgtaaataaaaggtatacagggttattgttctttttcaggaatgtgggtaagtttaagggaagtgggggagagtacttgcgacttcaggaggaggcagaggagctaggctggtcgtctgatgggcacagttttatcctggagcgatgaacccagtggggaggattctgcagacgactgtggttggggtactatagacgaccaggtaaggtcctgtccaccgaggttctagagtttgaggggtcaggttcttaacaagaactgaccgtccggctagggtgtctttatatggctgggtatctggagtaggtaaaaggaaattggcagcttagtggatttcctgtctagcctgttgaaggactggaagataatcaccaagaggggtggtgtctgaaataaggttgggacccagcagaaaggtgcggccgtgtaagagttcaaatggactgtacccggtgggttcccagggtgtggctcgaattcggaggagtgcaaggggtaggagagtggtccagtcttttttaagctggagggtaagtttagtaaggtgtgtttttaaaaggtccttggctttttctacttttccagagaactgagggtgatatggggcatgaagattccattgaataccgagggcttgggaaactgcttgagtgatttggctgatgaagaccagcccattatcagactgtatggaagtagggagaccaaaccggggaattatgtctgttagaagaaggaaataactgcagtggccttttcagccttcagaccccgtgggaaaagcctcaacccatctgatgaaggtgtcgacccaaaccaggaggtatttgagtttccagacacggggcataagagtagagtcaatttgccaatcttgagcagggataaattgtcgtgcttgatgcataaggaaaggaggaggtttaagaaagccttgatggggtagtagagtggcattatagcccattgagaggtgattgttttgaggatggatttccaggctggaaaagaaatgagaggttctaaaaggtgggttaaagatttatatcctacatggaagtggtcatcaaaggaggagaggatagagtaagcttgagaggcagggagaaggagctttccatgatctaaaaaccagttgccttgagtgggaagtgactggtagtttaaggtttcagaaggagagtaataggagtgatagatgagaaggagaaatattggccactgggagcagatactggggagtttgctgtttctttggctgttttattggcataggtgtttccttgggcaatgggatcagaggttttttggtgtcctttgcagtggattactctggctttggctggaaggagggcagctttaaggagggctttattaagggggcattgataatagaggatccttgtgtagtgagaaaacctctttctgcccagttgacagggtggcggtggaggatgtgaagggcgtatttagagtcaattagatattaacatgcagtcctttgccaagagttagggcatgagttagtgctattaattcagcttgttgagaggttgtaaatggggagagtgcagcagtttcagtgatagatgagtgagacacaatggcctatccagcttttcctggtgttaatcaactggtttttgaagaactgccatcaataaaccaagtgtggtctgggtcagggacaggaaaaagggaaatatggggaaaaggagaggaggctatgtggattaaggaaatacagttgtgtggattaggatttgtagtgggtagtaagtgagaggccgggttgaagtcctgtccaaaggcaatggtccccatgagattttcaataaagagtgaatagagctggaggaggtggggagccgagagtatgttttatatgtgaagaggaaactaagtcttggaggttgtgagtgctataaaaggtgagtggggcatagcctgtgattttgagagactctaagagtataagggctgtggctgctgtggcatgcaggcatgacggccagcccaggactgtaagattaagctgtttgaatacaaaggctactggtcacaggcctggttcctgagtaagaattcctacagcgcagccctgcgtttttgctgtgtggagaggaaggagggttgggaggagtcgggaagcgcttgagtaggggttgcctctagggccttttttagagtaaaaggaggggcgagggaaggatttaggatctgtgggttcagctaagtttccttttgtgagtttatagagtggtttggttaggatggcaaaacctggtatccaaaggcagaagtatccaacaacgtctaagaaggagaggagtagttgtttggtggtggggattggaatttggagattagctgaatacggtctgctggaagtgcacacctatgttggtggaggattataccaagataagtagaaatttgagctttggagggggatactctgtaccccttggagtagaggtgttgaagaagcaggatagtgtcttgctgggaggattggtaagaggggctgcaaagaagaaggtcatccacatattgaatgagatgggaaacaaatggacgaaaagaaagcaggtcacgggagagggcctggctaaagtagtgtgggctgtctctgaaaccttagggcaggacggtccaggtgagttgttgggactggtgggtgtcagggtcagtccaagtaaaggcaaaaaggggctgggaagagggatgtaaggggatggtaaagaaggcatctttgaggtcaataacagaataatgagttgtggaaggcggtattgaggataggagagtataagggttaggcatgacaggatgaatggggaggacaatctgattgatgaaacgaaggtcttggactagcctgtaggatttatctggtttttgaataggtaggatgggagagttgtaaggggagttggtagggactaagaggccatgctgtagtagacaggtaataacaggctttaggccccttaaagtctgttgtgggatggggtattggcattgagcaggataagggtggccatgtttcaatgggatgataaggggtgaatgatcagttgcaggcgaaggagtggaggtatcccatactttagggttaaggtggggagatgaaaggagaggttgcgagggaggtttggaattggataaaagggtagctctgagatgtggctgtagtccaggaatagtcagggaggaggataatttagttaaaatatcttggtctaataaggggactgggcaggtggggataactaggaaggagcgcataaaggagtgttgcctgatttggtaccagagttggggagttttaaggggtttagaagcttggccgtcaatatgcacaacagttgtgggggcaagggaaacaggcccttgaaaagaaggtaacgtggagtgggtagcccccgtatcgattaagaaggggacggacttaccctccactgtaagagttacccgaagcttggcgtctgtgatggtccagggggcctccgagatattcgggcaacgtcagtcttcagccgccaagccgaggagatctgggaaggagtcggtcatttcgggtttgtactccaggagctccaggattggtgatgagagtcagacagtctgacttccagtgagggcccacacaggggcatggcttagaaggaatcccgggccgtgggcattccttggcccagtggccaggtttttgacatttgaagcaaggtcccagaggggcagttaaacgctgcggtttgtacgccttgaagtttttgcaggtaggcggtgctgctggggtttgttttaaggtggaggcaagcatttgtcattctgaaaggcgcgctgccgcctggcagcctcttccctattattgaacaccttgaaggcagggttgattaattcctgttatagggtttgagggccagactctaatttttgaagtttctttctaatattaggagctgactgggtaataaaatgcatgttaagaataaggcggccttctgtcccttcagggtttggtgctgtatatcgcctgagggtggcagctagatgggccataaactgagctgggttttcacctttgttctcagtggtctcctttagtttgtcataattcacggctttatatgcagctttctgaagcccttgaactaaacaagagatcatgtagtcctgcctggctatgccttgggcccctgcctggtaggtcctttggggccttcacgggtactgccctagtgcctggccttggaggccaggctcaaggcgccagcagtcatcagcataagattgagctagggtccaaagtgaagatgacatttaagtcattccaagtgggattataggactgtgttaagtattggaattcttgtatatatttgagtagggtctgacggaaaagagcctgaatgctgactgatttgggaaaggtcagatatagagaaagggatgtgaacctggacttttccttcggctcctgccacctctcaaaggggaaattgctgggcaggggcatgggggtcggcttcagggtcaaattgtaagccagagcaggtgtgaggagggatggtaatgggagggacgtaaaggggtggcttgtgggtagaactcggttctgagggggaattagggccaggttcggataggtgggttggggggagaaagattgaaggggttaacaggtaaagaggagtcagcatccccagtggaagaaggagaggtagatggaagggagataaggaaaatttgggatggaccacattgggagcagagactagggagagatcatagtaaaaaatgcctggatgtagggtacctcagaccatttgcccattttgcaaccgaagttgtctaagtcccgcaaaatagagaaattgaaagtgctgttttctgtccgctgagagccattgtctaatttatattggggccaggccgtgttacagaaaaaaaaaattagacgtttaggctttagattgggtgaaagctaagaggtttgaggtttttgaggacagaagccagtggggaagatggagggtgggaggttgcccatgttagaactgggaaagtttgaggggaaagaaagagacaaggaaaagagcaaccactagcatcctcagtgggcatccccaatggaggtcccgggttgtgtggctggcgaatggccaaggctggcatccctggcattcaccaaacactgagggaagactgtcttcccaagaagagtccgtgaccaacgttggattttggaaacatggataagaggaaggttccttgtctcaattttgaggagagaaaaagagggagagagatgaggagagaccgaggcagcttacccgatccgtagacagaggtgggagtgttcgcgggggctggtctgaggtcctgaggtcgagggaagtctctttgatggaagagcgtggggaggataggggagaggtctcccagagagagttcccctatcccgggctttcggcaccgaatgttatgcatgcgtccaattgaagagacaacctgaacaggctaagtgtgagcaacaaggctgtttattcactcgcgtgcaagtgagctaagtatgaaaagggagtcagcagagggtggtgggattggagatggttttataggttaggggtaggcaatggaaagttacagttaggggctggattttgcaggtaggggaagaatgtcacaaggtacattatcacaaggttacagagcacagtgtcatgtgtcatgaggttgattgatcagttagggtagagcctgttacaatggtagaatgccccaaggctggctaatcagctaagacaggtactagccgtttttcttcttttgtggttttcctgttgtcccagattttctggctgcaggacaccttctggatgtgtacgtgtgggtcacaggggtcacgatggcttgaccatggcgcagcttggtcaggggaccttacaatttggtcataaaattcctagatctgccacttcctcttaccagtcatgggatcatggttttctcaggtgtaagtgggaacaatcattgcttgcatggctttagaacactttgctaaggatcacataagataccgcatgtgaaaacatgaaaaacatttggctctgtatgttccagtgagtacctaagggctatcacttatactcttaagaagaaaaattgtgcatgtctctagggatatttttgtgtgtgtgttgttgtggttgagacggagtttcactcttgttgcccaagctggagtgcgatggcgtgatcttggctcactgcaacctccgcctcctgggttcaggcgattctcctgcctcagcctcccaggtagctgggattacaggcatgcgccaccatgcccaactaatttttttttttttttttttttttagtagagatagggtttctccgttttggtcaggctggtcccaaactcctgacctcaggtgatcctcctgcctcggcctcccgaagtgctgggattacaggtgtgagccgccacacctggcctctagggatttttttttttttaaggacagtatgtatgcaaaaatatgaaggccttaagagaaaatgtagtttgtttctaaacgtcctaaagtcagctattttatggtgttctctctggaaaacaaccaggaaggccgtaatctctcctccttgtaagtgagaagctgaacaagtggctcttattggaagatagtcttaacaattcagaattcacatagctttattagaagattgcctaagtgtgaccaggtttttgcttttaaaataaaaccttttcttttattctacaagtattaatgtaattaaacaaactcttaaatagcatattgcttgttccatgccaggcagtgttctaagtgttttatcagcattaacttgtgcagtcatcctactaacccttgaggaaggtaggactatcccccctatttgacagaggaaggcaccaaggctgcccagggctgaacccccagacctaactacaatctgagctctgtgatgaccgagatagtgaggcctcctgtccctgaggttctggtgagggagccagacaggcagataagcaagtgcaagaaagtgctgagggctgtgaggtgtgcggaggcattctaggacacctccctctatggtcacttctctgccgtgtttaatactaacagtgaattgtagaatatagtactttagttttattccatgcaaatctacagctccagttagtgaaatggatcatacacacagaagatatggacatcaaaagttgaagaaaagtgagtgcccttgtagttttcctgcttgctgccttctcctcccttaggttgagagtttcttcgttgcacaaaggagcatcaagagaaacaagttcttcagttacccatatttacctgtcacaaaacctgctttgcaaggctgacatcagctaaaacccagtgtcttctgatagaaggaaaagactagtctttttgaacttttgggactatgctagaaccagtaagtcattgatttattgttgagagattcttcttcccacttatggcaactgtatataaacagttacgagtatacctaatgatgggaagatttgtaacatgctgattttcatcaactgggtaactcactctaaagtcctgaaacagggttatactcagttttacattctcatcattcattgatgaaaggagtcatttagagctaagaagtctacagaatgatttaaaatcccttttgtggttagcaaaaataatttgtatacatagcatgtttttctttttgaaatggagataccaaatgaaagcaaaccactgttgcctgagttgtccttctggctgaactgtgaaggtttgtggcagatactttcaattagaagcaccattatactttgaaggaggcctcctacctgggaacgtgagaggtggcaaagtgatggcgctcagagaacagtaatgaggatgagaaggaagacatacccaagagtaacccatgctcagctacttggctgttttcctctttcttgctagattttgcctgaaaccttttctgatagcatctctcctagagggcggctgtcagatacagggaatcacggccttggatttcatgtgatcgtagtgtcagaggtcttatactcgaagatcacctgggatacgttcttctaaactctgtgtgttgttgtaaagtcctacgtttatttaatgttggtgtaatgaaaagtgtcctttttataaaataactataaccaattggtaatggaaatcaaatgatattgactgtgttaacgtacaaataggaagaagcatgcctcatattttatcactatttgataggaatggaattaatagttcattttaacagttttgtaacgttctttaggaagtctgtaaatatactgcctcctgccaggccgtcagccctctctgctgcccctagctcaggaatgcccagaccgcctgccattgcctgtgcttgggttctcatcagtagacacatcacggctcactcatcctgggtctcaaaatccaactctgtggcctctgatttccctcctttctcccatagcgctctaagactggaggggcctggcttcttcgagcgctctccacacagggcctgtggtgaaactctgttatctagtcctccagggttgggtcctgccatagttaaaagagctaagggaattttttaaaatccctttccctccttgataatgtctcattttaaggctgttttaaagttttaagattctaagctggccagtggcctatttattctaagcatcactggtcctccgtccgagggcatgaagcctcatggttcagtctgagaggtaaaaggctgtaaggagccatgatttaagaggaaaataaaacatgtcagtctaataattataatttatcctcactattatgtcaacatcctccttacagtgcatctataaaaggactatatttccttttgtactataaatttgaattcttcattacacttacaagaaattcagacagaatcccagccccagaaagtgatgggaggtgccactactaaatgctgacacagattgttagaggagtggttactggagttctagtaagtgtcaccttcttgatgcaaagtatacagggttctttttgctaaaatgcaaacagacattaataagttaacatcaaacattggtgagacctcaatggttttggtcaaggacagttaatgcagggaaacttggtaggccttgaagtcttacagtagagtgatatcaaagcataaccagaagttggaactgccccagtaacacattttgcagatagatgcgtagctgatttagttcatgtattttagaagttgtatgggcctagaattattttaatagatcttgtataatctatcatttaaaaacaattccattttggccataaggtgaaagtattgataattatactgcttgtgttcttttatttgttctttagtagagaaaaagaattataaggcagtttaaccatttaacttttttaactgaaatagatgttcatttggatttggaagaccgcctggcaaaatttatgaagacagaagaagccattatatactcatatggatttgccaccatagccagtgctattcctgcttactctaaaagaggggacattgtttttgtgtaagtaaactttacgtagttttctaatagcagttcctttgaaataatactgactgtcttagagaaatacttcattagaagttatctgcataaaataatgctgctttttgtttttcaagaaatagtcacctcaccaaaggtttcaaaatttgtgaaaccttcacttaaaagatgcttaacggtgtctatagtcatttatctgccatggtaattatttattgatgtccagatgaggacagctatctgccttctttgtgcagctctgtggctgtgtggtatcctagtctgtggtcaccacctcacgttgtcagtcagactgcccggcaaagtctctccatgtctcatcacccattcaccccgtcacctggtctcagctgatcttgcttcctaccttattaaggatagaggagccgtgacttggacacttctttgactacccacaagtggatcttcacactcgcgtgcctgtgctgaatgcatgctaccgaggtttactgtgaagggcagggtacagccaagcaagggctggcaggccccaggcagctggttaaaccagtcagaagcatctgctgccccaagccaagccctgtcgtcctatgagtggactaaaatttggtctcaaattgactttaatttcctcttctctgttttttttttttttgtgtgtgagatggagtctcactttgtcaccacggctggagtgcaatggcgcaatcttggctcactgcaacctccgcctcccaagttcaagcaattctcctgcctcagtctcctgagtagctgggattacaggcatgcgccaccatgcctggctaattttttgtattttcagtagagacagggttttaccgtgttggccaggctggtctcaaactcctgacctcaggtgatccacctgcctcggcctcccaaagtgctaggattacaggcgtgagccaccgcacctggcctttttttatttttattttttaattttttttattttgagatggagtttcactcttgtcgcccaggctgaagtgcagtggagtgatcttggctcacagcaagctccgcctcccgggttcaagcaattctcttacctcagcctctcaagtagctaggaccacaggcacccaccaccaaacctagctaattttttgtatttttagtagagatggggtttcaccatgttggccaggctggtcttgaactcctgggattacaggcgtgagccactgtgcctggcctcctcttttcctttttaacatcacagccagagtaatctttttaaaatgtaaatcctattttgtcacattttatttaatacaatttagagcttctattgttcctaaaataaagacccaagtcctttgtatgatcttgtgagctctgcatcactttttcaggctgattttgtaccattttccctgaggtgtttaagctgtagccttgccagccctgtatgctagtgtcctctcaccttggggcccacgcacatgctctttctgactagaacactgttcctcctcccttctcctacttaaccttctcatccttcacatacgtcacctctgcagggaggccgtcccacacctcagagcaggtcaagacccctgctgcatgtggacaaaatcttacagccagagagaatttattgttcttgtttatccatgctcacacgagcactcaaactgcctgtcaaggtcaccctgcttctcaagcctccctcccacacacagacacacacactctctcacacgcaccctgctctgctcatttgcttcatacttactgtacttttcttttgtagagcttgtaacagtttataattttatatctgtgtggttatttgcttctgtttcttgctgggagcccattacttagaatagtatttatcatttagtaatggtcaataaacagtagttcagtaaatgaatgaaaggaagctggagctcagaataggggccagataactgtgttgcagagcctggcatccctcaagccctgcactggcctcttgcttaccactcaccgttggaacgcttgtgcagcgacagaaccttctatcataattactacagagctgactctacctggggcttctgcagtacatgtgacccattcctcactatagccctacagcagtctaggagcactacagcaaatgtcctgggtctaagtagtatactaatgtgaccataaaaatgaatatttttattaatttttggcaaatagtttaaaaaataatgtgaaagactcatcactaactgaagcgccattgacttaaacagtgtttctaggtttttagtaaaagcagagttacagacagctgcagtgtcattcagtgtcactttatacacaagcaccccactataaattcttttaaagtccagaaaaagttgatggttactggtgaactcctatgcttcctttgataaatactacattgtgtttttttttttaactgctaggaaacataggctaaattcacttccatgtgttatgcccagtgtcttaaaatttccatttccagtgagttgctaacctgtttattctgctacgtaattttaaatactctacctgaaatgtgtttgaatgtaggagtgctagaggtaaacatggtgtttggtaaattggttttgataaatttgtcaggcatagacactgtgtgatgcttcatttccttcctttcagtaaacagtgttaatgctttgccaatagtggggctcagcacagtggtcattcatggacttaagtctgtcctatcactccactaagtatgtgttcatgctgcttcacagatctttttaaaattaaactttttacattcagataattgtagattcaaaagcacttgtaagaaataatatagaaatcctttgtactttttactaagtctcttccagtgaggacctcttgcaaaacgaacagtttcacagccaggatattgactttgtcattgtcaagatgcagaacatttctgtcgccacagggatccttcatgttgccacatccacattcctcccatctgcccactccttaactcctggcaaccactaatctgttctgtttgttaattttgttattttaagaattttatacaaatggaatcatccagtaggcaacactttggggttggcttttttcatttagcgtaattctctgatggttcatccaagttgttgcttgtatccagagttggttccttttgattgatgagtattactccatggcatgaaggtaccactgttattgaagttaccttttaaagacatctgagttgttgccagctttgtgctgttataaaaaaaaagctgctctaaacattcatgtacattcatgctatgtgagcataagtttttatttctgtggaatacatgccaaggaatgcagttgctatgtttatagtattgcatagtttttaaaggaactcctaaactattttccaaagtgtctataccattttatgttcccatcagcaagatatgaatgatcaaggttctccacatcttcagaagcatttggtgttatcactacttttttagccagtctgataggtgtatagaaaaatttatatttttctgatggctaatgatgttgaacatccattcatgtgcatatttgccatctcttcagtgaaatgtcttttcatgtccattttctagttgtatgatttgtttttatactaatgagttttgagagttctttatacattctagatcatagttctttatcagatatgtggtttgcaaatacaaattttgatgtccacgtattcattgctaaaatatagaaatgaagtggattttttgtgtgctgagcttgtatcctgcaaccttgccaaactcacttaattagctctaggaactgtttttctagattgcttaggattttccatgtagacagtcgtcatgtcatctgtaaatagttttatttattttctaatctacttactttttattcccttttattgccttattgcactggcaagaacttccaggactgtgttaaaagtagtaagagaagacattcttgccctattcctgatattagaaagcgtttactctttcaccaataagtataatgttacgtgcagatttcttacagatgctctttattacattcactttcctgcacctcatcttttttttctgagcattttcattgcaaatcaatgtgaatttggttggtcaactactttttctgtattggttgatatgatcatgtgatttttcttttttagtctcttaatgtggtggataacattgatttattttcaaatattgaaccagccttgcatacctgaaataaataccacttggttatggggtataattttttttttataaaaagctaaattcgatttgccagtcttttgttaaggattttgaatctgtgttcatgagggagattgtcctataatacactttttttgatacttactttggttttggtagcagaataacacttcacagaatcaattgggaagcgttctatcttctattttgtggagctatttgtatagaattacttttaattatttaattgtttggtagaattctcccatgaaaccatctgggcctggagagatttcttttttgcaagtatcttaattctgaattcagtttccttagtagttatcaggctattcaaattatctgtcatattgagtgaattgaggtagtttgtgtttttcaaggaattggtccatttcttaaaagttgtcagatgtacatgtgtggtgctgttcatggtattcccgtattattctgatgtctgcagagtccacagttatataccttgtttcactcctggtattggtaatttgtgccttttctcctgttttctttgtcagtcttgttagaggtctgtcaattttattgatcttttgaaagaatcagctctttgtttcattgtttttctctattgtatttttattgtcagttccattgattgatttctcctattatttcctgccttctgctgacgtttggtttattttgttctttttcttgatttggaggtaagagcttaaattattaatttgaaactttttctcttttcttgaatgttcatttagtgcaatgaattgccctctcaacactactttagttgtgtctcacaaattttgatgtgttgtgttttcatttgtatttagttcatttttgttttgttttaagaaatagggtgtcattattttgctctggttggccttgaactcctgggctcaatggattcttttgcttcagcctcctgggtagttgggactacaaaaacacaccactatgcccagcttacactttccctttgacctatggattatttagaagtgtattgtttacttttcaggtgtttggggactttaaatttgttgtagtttggtttatggctaatacggtagtctattttggaatatcttatatgggcacttaaaaaatgtgtattctgctgctgtttggtggagtgttctataaatgtcaagtctttttggttgatggtgtttttgggttcttctgtcttggtgattttctgtctagttcttctatcagttgttgaaggataatgaagtttccaactgtaattgtgggtttgtctatttctttcagttttatcagtggttgcatctcaaatttagcttttttgtttagttcatatttaggattactaagttttcttgatgaattgacccttttagcgtttcataatgttcttctctgtctctgataattttccactttttgtgtatgtgctgccaaagcaaacactctgataattttctttcttccaaagtttactttgtcagataccctttttattattttttatattacatagttgtgtgtataaatctgtattttttactacctatattattatatttgtagtgagtttcttacagacagcatatagttgggtcatgttatttaatttattctacctgcctgtctttaaatcatgtatttgtacatttacatttaatgtaattattgacatagtagagtttaagtctgttaaaacaaagtctgccattttgctttttgtttcttgtttgttcactctactttgtgtttctctattttctcttttctgcctttctgtgggctaattgaacatgtttttagaatttactttttctttgtatagctttttttagtcattactctgagtgttacattacacatatattataatagactactggtgtcattgtaccaattcaagtgtagaaacttttaccttcctttacattcctttatttgcctcatttacattataattgttttaaatatttcctgtacatacagtgagaaccacatcagtgttttaatttttgctttaactgtccaaaataatttagaagactccagaggagaaaaaaagcctagtgtatttgcccatattttttacttactgtgctccttcctccttcctgataatctaacagtattcttttatggcttttttcctatttagaaggcttcctttggccatttctttagggtaggtctgctagtgacaaatattcttcatttttcttaactgagaatgtcttgatttcaccttcattcctaaaggatatttttgctggttataggattctgggttgacagttattttctttcggcattagaaacacattgtgatgctttttttctggtgtctggtttctgatgaaaaatctcccgtcattcaaattgtttttctctatgtataaggtgtcatttttctctggctgctttcaagattttttttgtcatttgttttcagaagtcatctatgatgtgccttggcaactatttgtttgcattagtccgtatggattttgctcagcttctttaatctgtagatttaaaccacttgacaaatttgggaagtttttagccattatttatttgaatacttttttagctccccacctctttctcttcttctggaattccaatgacacaaatgttacgtcttttattataatcccatgggtccctgagactctgttcatttctttctagtctattttcttcctgttgtgctcagtgaatgatttcttttttctttgttttttttttttttgagacagagtctcgctctgtcacccaggctggaatgcagtggcgccatcttgactcactgcaagctccgcctctcgggttcacaccattctcctgcctcagcctcccgagtaacccggactacaggcacccaccaccacgccaagctaattttttttttttttttttttaagtagagatggggtttcaccatgttagccaggatggtctcgatctcctgacctcgtgatccacccgccttggcctcccaaagtgctgggattacaggcatgggccactgcgcccggctgtcagtgaataatttctattgcttgtctcagttcactgatccttcctctgcctccattctgctgctgagcccatccactaagcttcttattttagtaatttagtttttcagttctgatatctctgtaggactcttctttgtatcttccatttcatcactgaggctttttattatttcatttgcttcaggtgtcttcatggtggctcattaaaatatttttatcgtggctgctctaaaattgttgtaagataatcttgatatctctgtcatctcactattggcatttgttgtttcattctacttgatatcttctggttcttgatataagggatatttgatggaaacctagacactttcatattgtgccgctgtagtccatgtctagtttaagccatctcttttatttggctttctctgacatgattccaacaggggaaggggctaggggactgctgcctcatactgccaggaggaggaacaattcaggggccctactcggcctccattgacatcgttgggggtttctttgttgctgctgggtgatgctaatagtcctgactctccactcgccctcctgtgacactgcccaggaggagatggggagggtgcccactactcccaagtgcaggtggaagttagggctctccatgtgttctttgctgacaccacagtgggggtggagggggtccacttgttaccaactgataggaataaaaggctcagcttcctacttggccttccctgacaacaccctaggaggtgtgtcgccttgttacagcctctcgagggtcaaagtctaagttcccttctcagcctttgctgacatagatggggctgggtacccctcatttttttctgtggtgtttggctacagtagaatagtcattgtctaaaagttttctgtctagctgggctgccagtattacttctcagggcaaaataatggcagagtaatgtgtcagtcatatcagagatgccactgatggtgaggcacaccagtattttatgtttcttagaaagagaaaagtatgtgaataaactgatatgtcatccatagtaagatgcatgctaatttcagagagattaatatatagtgagagtgtgcttcttggaatagattaaatatggtagttatgtgaaaaggactcatggatgaagagcaaacaatgatgtataaatattcaaacatgttttatttatttgctatgctcatgttaacaatcagtgattggtcagcttacaaaaacaagcattcctttttgagaatgttgacaagaccctttaaacccaatttggtggatctcttttccttgcagagatagagctgcctgctttgctattcagaaaggattacaggcatcccgtagtgacattaagttatttaagcataatgacatggctgacctcgagcgactactaaaagaacaagagatcgaagatcaaaaggtatgattcttttgaagaaaattatacagttcttttgtactttctaaccagctaaattatatatgaaatggtaatttgtcatgaaaacttgcctgtggatcacatttggatattaaggtgttcctgcttattaaatgtacttggtgttggagagccaagtctgattgtaattgccttgtcattgccgtaattacatatagcaaattggagggaggtaatccaagcagctttctgagagatcaagagaggctgaaaaacagcatgtgcttagtgaggcagggagatgtctactcatagctgggcataatgacaccaaaacttactaggcctttaatgacatgtacctagtgaattcagaataggcttattcataccagaataaatcatgtatcaattacatgaggaaagaatggcagcaagcttattatattaatatatgaacaaagtgaagccctttctccccaccccacctgtatcctgctctgagcagctactgcctgtgggaaatgactgcccctaacatggtctccttccagcttgcagccctgttttcagctgtttcctctcgagaacctaacataacccaggtgatggtggtttggaagtagctccttggtgttctgattagggtgaaacagaggaagtgtgttcagagcatcattgttaaaattacaatttattttcccctgatgacatgggtaagtaaagtagctcaggtctgtggttctgagcaggacaccatgatgtgtgtcttcatctcagacacagtttcaagtggactttgccagtgcaactcagtcataactagaataaatgataaaaatgctcatcacatttcttaattttgtgtattttgtgttaattttcaattttccaaatatttgcattattcatttaggattctgtcatctttgtttaggtgtcagcctaagtgcatcacttcatgaatatacacattctcatgatgaatatgcatgatcttgccattttatactaactctgctctaggctaacatttcacatttacacaatttagaaaaatctataggcaaaatctgaaaacagcccattccactgattaatttcttttacaaagtataaaaagatgtttcttatgatgatgcagtaatagaaagctagtctgttttcagtactagaactgcagtctgctgccatttgttttgcctagtattgtataaatttggaaaacatcagattcaagttttgtatgtgctctttttctacaagatctgtaagccatagaacttttttttaaatgagcaacaagaagtaaaattaaatatcttgaaacttatttctactttataatttttacttttttactaatttatatttttcttgctgagagcaggctttctaagtaactctacattttggtttttagaaatattcattttcagtttcattttcacataaataatctggtcgttaacactttgaatgttttctttgtccattttccaagcgccatggttcatgaattgttttttatcccctttcctacagggttcccataatggtcagtggatatgaacagtagttcataaaaggaatacacataactatgaacaagtgaaaaatagcctggcctcactaataattaaggagattaggctaggagttttgcctgttaaattagggcatgtttttaatagtaatagtcagtgctaacacagatgtggtgagacaaagagtgttcctatgacactggaaggagtttaaattggcactgcctttctggaaggcaaatgggcagatacattccaggatccaagtaattccatgccctttgacccattcctgtggtgctgtctttaaaaacttacgagaaatgatgtcacattttgaaggatattcatattgtgatatgaaaaagcaaatgaaggaaacaactaaatccaacattagggaaataagtagtttatggtatactcacaggcagaacgtctccattaaaatcatgtaatccgaaataatttagaaatgctcacagcataatgtttttaaaatcaggtcctaaaactacagtaaaatcctgattctgaacaaagtaatttatatgtttatacaagaaagacaaaaattatcaccgtgtggtatgattagctgatttatttaattgttttttgtactttttccatttcccaagaatcctacattgaatatttttaaatctaagnnnnnnnnnnnnnnnnnnnnnnnnnnnnnnnnnnnnnnnnnnnnnnnnnggtagcatgccctgtgtagaaattagggtggcatctcttcatccatcacttctaacatattgctagctccccagctttcagttgtgagttgacagagtaaagatgattgagcaacatcagtgatatgtactttttattcctcaacaaactttttttttagtgctactgctgtgggttgtaaaataccccttaaagcattgctctgatactttctaattctgatcatttctaattgtccattggagcagaaacttagaggcaagagatctctgagtaagaaggtaatggcaaactctatctgtggatctcagtattttttgcagtcccacacacctgaaccatgtacagtttcatacatgtgggagatttattagtgacttgctctgagcagagtgtgtgaaggtgtgtgttttttgaaaagatctctgccgggcgtggtggctcaaagctgtaatcccagcagtttgagaggccgaggtcagtaatcaagaggtcaggagttcaagaccagcctggccaacatggtgaaaccccatctctactaaaaatacaaaaatcagctgagcgtggtggcgggtgcctgtaatcccagctactcgggaggctgaggcagagaattgcttgaaccctggaggcggaggttgcagcgagcagagatggcgccactgcactcccacctgggtgacagtgagactccatctcaaaaaaaagaaaaggagacctctctaccccaccacctgggaacatcattggacaagctcatagtcaaattttacttgatccgataatacatcagtggggagtgaggagggaacagggttgcccctttttttgggaggtgaaggaaaacggtttgagttttttaactttttgttatggaaaaatgccaacatataagaaggaaacacagtggtatagtgaagccccctgtacccttctcccagctttgttatcagcattacatcattcttgtgccatctgttcctcaccccatcttcatgatgatgaccttcattatagttgttttgggtaaaattgacagacattgaatcacatgaatgcagccatacaattttgaccagtgattatacccatgtaacccaggaatgtcagccccattatgatgtaaaacattcccatttctttagaaagtcccttaggccccttcccagttggaggtttggagggttttgtttgtgttttaatattctcagagggcctaattagtttgtgtgtgtggcgggtcacctagctaatgctgtgagctgaaaaacgtctgagagaagatagtactgttgttcatctcaaaataacccatcacaaacactgagctttcaattcattcagaatatttttttaggaataaatcttgtaaggtgaaagtgctggggaatatgtaacagatcttgtcttcagagttactgaaatgtaagatgtctgctttttctcttttaaagaatcctcgcaaggctcgtgtaactcggcgtttcattgtagtagaaggattgtatatgaatactggaactatttgtcctcttccagaattggtaagcaaccatgttcagctgtaattttaatatttggactatttgacagatgtgccttttgtttatgaccgcttttagtgtataacgtctgcgttgctttgcgcattaggcctcataagcatattttgctcagatcagggaagaagaacaacactgaatgccagtgctggccttcaaagagtaatcaagactgctctgttgcccaggctggagtgcagtggtgtgaacacagctcactgcagccttaccctcctgggctcaagtgatccttccaccttagctttctgagttagctgggactacaggcacatgccaccacacctggctgatttttcccttttttgtggagtaggggtctcactgcgttacccaggctgttctcaaactcttgggctcaagcgatcctcctgcctcagcctgccaaagtgctggtattacaggtatgagccaccacacctggccaaaacttagctttagctttttttttctcccccgcaagacagtcttgccctgtcgtcaggctggagtgcagtggcgccatcttggctcactgcaacctcctccccgaggttcaagcagttctcctgcctcagcctcccgagtagctggaactataggcgtgcgcagacacccccagctaatttttgtatttttagtagagacggggtttcaccatgtcggctaggatggtctcaatctcttgacctcatgatctgcccgcctgggcctcccaaaatgctgggattacaggcatgagccactgagtcggccatacgtagcttttaagatccagctttatttaggtgaaatcaacgtataaaatacacctactttaagggtaaagtttgataagttttgacagatgtatatacatctgtatcactgcagccatccaccaccacagtcaagatacggaatatttttatgtaagacaatgtttatccagaaagaaaactttatccagaaagcttcctgatgcctcttggtagtgagtacccatgttggccccagacagccattaatctactttctattcctgtagattagttttaccttttgtagaattgcatatgaatgaaagcatagcttgcttttttgtttttttgtgttttgttttttgtttgagatggagtttcacttatgttgcccaggctggagtgcaatggcacgatctcggctcaccgcaacctctggctcctgggttcaagtgattctcctgcctcagcctcccaggtagctgggattacaagcatgtgccaccatgcccggctaattttgtatttttagtagagacaaggtttcttcatgttggtcaggctggtcttgaactcccaacctcaggtgatccaccctccttggcctcccaaagtgctgagattacaggcgtgagccaccacgcatggccaaaacttagctttttaatagtgaaagcagcataactgtttttagaaaccatgaccattgagatttcctttattgaggtgaaattcacataacacaaaattaaccaatttaaattgtacaggacagtgacatttattacatttaccatgtgtgcaaccatcaactttaggtcaaaaaccttttcatgactcacgaagaagacctcaaacccattaaacagtcactccccattttcttctccctctagctcccagcaactaccaatctgctttctgtctctatggatttaccttttctggttatttcctataaatggcatcatataatatatgaccttttctttctggcttcattcacttgatgtttttaaagttcattaacattgtataccatgtatcagtatttcatacctttttaatgctgagttatagtccattgcatggataataccacgttttgttttatatgttcatccacagatggatatttgggttctttctacctttttgctattgcaaatagtgctgttgtgaacatttgtgtacaggtatttgtttgaattcctgttttcagttcttttatgtatatatctagcagggtaattgctggattatatggtaattctgtgtttaacttaataaggaactgacatactgttttcaacagcgattgcaccattttacattcctatcagctatataccagggttacagtttctctacatctttgtcagcacttatattttccagggttttttgttggtttgttttagccaccctagtgagcatgaggtagtatctcactgtggttttgatcctgtttcccccaaatggctaatgatgctgagcctcttttcttgtttttttttttgtttgtttgtttgtttggccatgcgtatacctttggagacatatctattcaggtgctttgcccattttttaaattgggttgtttttttgtttttaaaagaattccttgtatattctggatactagatgtttatcagatacatgatttgcaaatattttctcctattttgtgggggtttgtttcatttatttgatactgtcctttgacacacagtttttaaaaattttgatgatgtccagtttatgtgttttgttgttgcttgtgcttttgtgttttattttaaaatctttgtttaatctggccgggcacggtggctcacgcctgtaatcccagcactttgggaggccgaggcaggtgaatcatttgaggtcaggagttcgagaccagcctggccaacatggtaaaaccccgtctctactaaaaatacaaaaaaattagccgggtgtggtggtacacgcctgtaatcccagctactcgggaggctgaggcaggagaattgcttgaacctgggatgtggaggttgcagtgagccgagatcacgccagtgcactccagcctgggcaacagagcgagactctgtctcaaaaaaaaaaaaataataataataatctttgtttaatccaaaattatcaagatttattgctatgtttccccctaagagtttatagttttcagtcttacatttaggtctgtagttcatttgagttcatttttgcgtatgcgttgatgaagaggtccaattttattctttcacaagtggttatccagttttgcctgcatcatttgtttaatgtttccccattgactggtcttggcacccttgttgaaattaattgaccatagatgtatgggtttatttctagactctattctgtttcattcttctatatatctgtcctatgccagtaccacactgtgtcaattattgtagctttgtagtgagttttgaaatcaggacatgtgagttcaactttgttctttttcaaaattattttagctatttggggtctcttgaaattccatttgaattttaggattagcttttccatttctgtaaaaagtattgttgggattttggtggggattgcattgaatatgtagtcacattgggaagtattaccatcttaatgatattaagtcttccagtccatgaacttgggatttttccatctatttagatatttccttcagcaatgttttgtgatttttagtatatacgtcctgcacctctttggttaaatttatcactaagtatttgatttttttattctactataaatggaattgtttccttaatttcctttttagattgtttactgctatttatagaaatacaacagatatttgtgtattgcttttgcataatgtaacttctgctgaatttattagctcaaataatacttttgtggatcttattctatgtataagattacaccatctgtgaatagagataattttacttgtttcttttcaatttggatgccctttatctttcttgcctgattgccctggctaggacctcgactacagtgttgactacaggtggcgaaaatgagcatctttgtcttgttcctgatcttataaggaaagctttcagtcttctaccattgagtatgatggtagctgtgagttttttataataaccttttatcaggttgaggaagttccttcccatttttaatttattgagtgttttatcatgagaggttgttggattttgtcaaattttttttctgcatttattgggatgatcatgtggggtttttccccctacattcttctaatgtgtatgtaatacatatttgatttttccatgttgaaccaccattgcattcggccattgagattttaatctaggagtctattaattgaataaggattcaaaataagggttccatatgttgtttttaaatgttttcactatttctgaggaaatctaaatatattttaagtatcaatagaagagatgtatttgttttcttctttttgtttttgtaagagtgtcaatggttgatagaataatgggagggaggtagtgaaccagaagatactaggacgtatattatagggctacagtaatgaagcagtgctaatggacagatacgaaactaaagatgaagtgtaggaacagctcaagtgtagataagcactgaagctgggcatggtggctcacacctttaatcccaacactttgggtggcggaggtaggagaatcacttgagcccaggaggtcaaggctgcagtgagccatgatcctaccactgcactctagcctgggtggcagagcaagactctgtctcaaaaaaaaaaaaaaaaaaatcagtattgtgctgtcttttgttaagtgaatcattttagaccatctaaaggacaattgattctcatcattcaccctacttatattctataaagttgccatgaacactggaataagaaatactaaactattgctgctagggcaaataatagggttaggttcctctgagcctctggttacaacattttcatcaaccagttgacacaaaacttgctttatgtgtatttttgtttaaaggtgtcttatttaatgtctgttgattcattgcactaccactcatgcctgaacaaagcttctctaacacacaaattttctccataagggacatcacagcactaggagtaatagacggcactttagcatgacacttgggggcgactctaaatagcaaaatcaccaacaaaaagcacagaagtccaaaaaagtggcagtaaataggccatgaaaagggtagttgttcacaggatcagagctgaaacagtcgcctgttcaccctcacctgggaaaacacgtgtcaggtaattcaaattcttcactgctctgcacatgcacatatccgtgatgacaggaaaaaagtattgatatggaggttgcaaataagttttaataagtagatgaatttgcacatatagaattcacaagtattgagagtcagctgtacatactttttaatcttaatttttttctccataatatgttctatatggtgctaatcattagtattttaacgtttatataacacttaggttaagttaaaatacaaatacaaagcaagaatcttcctggaggaaagcctttcatttggagtcctaggagagcatggccgaggagtcactgaacactatggaatcaatgtaagttccccttttttaagaacgtttcccctcttataggagacatgtagttccattctgctaggcctatatttttataggcacaagacagtgttccttatcagtttgaagggtcacgaaactttggtgtctgtcacctcagtgagcccaggatgagtctagtcagccagaccagggaaccccatcttccttctgcacttataaactcggagtgggtagtcatggtttgtgctctgtttgcaaagtttcattcgaatagacttttagtgtctcttctctagaaatggttaaattttgccttccaattatttcttaaaatcattaggaatttcctgagtggtcttttcagaagtattcatgacggcagagaaaggatactgtttctggtgtttaaaaatctgtattctatataatgtgtttgtgggaggtagatacagttacgcgtgcgtgcgtgtgtgtgtgcatgtgtgtgtgtgtcagaaacaccactggcatgcattcagcaaaacctcttaaagtcccaaacagaatgaggtgtcatgtttccttttctgagggaaatggacccagactgcccgcagtgcctagtgggttttgctcctggagcctcagggcagaggaagtcagccagtcttgaacagctgtcttaccaaccaccatgggaagagttacagaaagctttttctccaaaacatgcgcataagagctgtgcaacctgtgttacagagttgaactataaaacgtaaaattgccttacattatcgacatcccgctaaccatatagtcccagagaaaaatgtaaagcagagtgaatatcccgggaggttggatggaagcacctcctccaaggcagactgacattcagcagttacatgcaccgaggaggtaaatggaataaatggaaagataaatggaagtgtaattcaagcagatttagcagtacactacagccttttttaaggcatgaaaatttttatggaggaaaaaacttgaacttcactgttgtagttttgtgaatgcttccagcagttgtcactttgggaaatactgtgaggaaatactcacaagcgcctgagagtagagagcagaatgtacgggctttatttggatcctgattcaaacaaatgctgttaaaagaaaatttggtgagacaatcagagatatctgaacactgaatatttgaatatatttaacatcaaatttaaacttaacatttaaaaattgttaatgtcttaagtatgatactagttttgtgattatgttttgagagagtttttatcttttagaaatacacagtgcaatgtttatagatgaaaccccatgaagtctgggactcactacaaagaaatgatgagggtggtaggggatataggtgaagcaaggttgtccttgagttgataatgtttgaatctgggtgatggggattctttgttctgttctactttgttcaggcttgaaatttttcataatgaaaggtttaaacatgctttttaaaaagggcaggagtgcagagtttctcaaaactctgctggatctatgaaacactaaggaaaacactagctgtgttctgacaatccattaacatggccatcagtaagtaatgattgaatgcctactgtgtgcccagaatggaacttggtgctgagggctggacccaaagatgaggaccgaaggagttctgagtggtcagaaagatgtaggactcaaagcccattaggtcattttagagcacattaggttcttctgctgtccagttggtcaaagattccatcgccatgacgtttggataaattgacttatgaaatgctgagaggcaaactgaatacaagaataaagtgctcaaaacttcgatagactttttatttatctcagtgcatcccatgaggaaggccagctagaccactgttttagcgaggaaatagtcttattttgtacctgtgactacttttaatatcgaacagctttgggttttattttcttataatttatttgtctttgctgtgagttaatttgtcatgtataatgaaatggtaaaaatgtataaaatgagacagtttcagatgggccatgagactacagttcattcagcgatagatgttatatggtttattttttattttcatgtagataggtagtttgaatccagatattaacagacagtttaatgctgttaaattttgtctctaggcttgaagttggccttttttttctttaaactgtggaataactgtcactcctccttttccggcagattgatgatattgatcttatcagtgccaacatggagaatgcacttgcttctattggaggtttctgctgtggcaggtcttttgtaattgaccatcaggtgggttctttttaaaaacaggagctaaaactgaaactaatttctccattggtcacctcaaaatataattttgaaatacgaaattttacttagtttatcacacaatttttatttaaatgtcaatttttaaagaatcactcaaaatatttctatttagaaatgatctcacatttaacaaaaagtcttgttgctgttacacgtataatgtttatttatggctggatcttacccccctcaccacatgtacacactgttcagtagttgttctagagaactggtgcctttcaaatgtttacctagaaaggacagagaatgtgtatatgtcttcatttgtttcttctcagcgactttccggccagggatactgcttttcagcttcgttacctcccctgttagctgctgcagcaattgaggccctcaacatcatggaagagaatccaggtataaccctttaaaaacccaaggaatcaaagagatttcaggttacgttagttgtgttactgatttacttactggagaaattatttgccagacaaaactggtttgcagttacattatatggcattcataggaagaatggcagtgaagaagctattcctgccccaaggacttggggtcagagcttttctcctgtgcttggggccagagccagagccaaagcaaggctagctcagatagtgggtggagatgctgggaggacgaggggctctcagccagttctgggcctaaacgttccattggtgtaaataagccagtctttatttggttaatagttttttgagaaatcagctgaagcatgctgcttttttatctgtgcaattttataaatattgtgagttttcacctttagcctttgaatcatcagttggtactgaggccaagccgggtttaccagcaaagaacttactcagtgggaaaaataaaaagtctactaagaatttaaaatgtggcctttggctatgacagtgccacctttgcaaagcttaaaacggaaagggagcagcaggccctacccggtacagtatttctgaatcttcatcactgatactaattcagagaaccagaaaatgtgtgtctctgtgctcattcatatgcttgcttctcagatggcctggcacgcctaccttctgatcagatactttagttttgggattttccttgaataaaaaaggaaaatatcaagaaaagattgtaaaaattactttactatagttgattttttaccaaattgtttaggataaagaaataagcaataaatttgtaccctttgattcttagccagattaggatcttgatgagaacaagaggcattgattgttcttgaaagcatcattccaggtttgttgaaagtgggatactgaggtgagaaggggccagttagcacgcaccagagacaaagcttgggccttcaggggagtatgggttcttggctctgttagtatgtagaaggatttgtagcattttaaattgatgaacttgatctgggtcttcaaaaatatttttaggttagtactatcataagtttcaaatagactctcaaacgtatttttttcatctaggtatttttgcagtgttgaaggaaaagtgcggacaaattcataaagctttacaagggtgagttttatatattttcaaccaacataaagtttatctgcaccacacttaacaactaatggaaagttttaaatttctaggcttgggtcagtttgaccagattgcagctaagaaaccaaaaacttagttcactcacattggtttatttgtgtaaaaccagatcatctgttttaaagaatcgtgactttgtttttctgaaaatgaaacaaactcattaataaaatattacagcagtacagaagatagaaagatgaaaataacaacccaacatcttaccaccagaaataaccagggtaaacactgaagcatctctccatgtctgcacacacagggatgccattatatattatgtaattagatgactgggttcataccatctgtgttactttttaataaattactaagttttaacacaagaaaaagaaacaagtgaaattttatcagtgttttttttttttttttttttttactacacaagagtcactttttttttttttattatactttaagttttagggtacatatgcacattgtgaggttagttacatatgtatacatgtgccatgctggtgtgctgcacccactaacttgtcatctagaagagtcactctttaagattcctctgtagttaaaaaaaaaaaaaaatggaggttggtgatatctccaggcacatttctggtcttatataaagtgatttcacattgcccgaggtctttctttttgcctttcctaaggttaaacatgctttcttggtcatgaaagtcctatctgtgttccggatatggaaactggagacttaactgaaagaaaaggacaattgataaatgagtacatcacagctgttccagataaagaaggggcagagacattaaagttctgggtgtgtctgtgtgatagtaacagcagttcttgcatgatttatggtagagagatatatttgtattggttccagttccattggtttgtgaaatattaatatgccaacacagcctagcatattggagtcactggaaatgcatcagtgctagccttacatgcctttcactctatggtgttaacctgcctttttctaagtctaatctccacttaccccagctgtatcacactttttctttccaaaattcctaatcctctgtcttcactcccctcacttttagctaacagcctggccttatgctgtcacttgggactctgtcatatttcctgacaaatctacacacctgtgggtatctgaaccagtcttccctcctgtagaccagtaaatgttgctccaactaccacaggccctttttttaaggactgagtgcctttgcttgtccctgctactttgtcatcagcctgtcccctttcttgtgttatttgattagcagtcatgtccactttaaattcctcttgcctgtcacctgacgtttccctctgcaactccccatgtctttgctcctctcagtagctatcatctccacgtcttcacttacactggcagctctgagacctggcttctgctactgcccttcgcctggactgtttttgtggaggtctccactgactgctgaatccagtggaccatcttcagagctcatcttcttgatgtccccatagttttcagcacaggtgaccactctttccttctttggactctgctacactgcacgcctggatttccttttacatctttgaatggctccatctcggtctcctctgaaggctttctttcaacaccttgctcttcaaggctttgtctgtgcttctcttttcttctcattaccttcttgaagaattgccttctcccacacctggagctccacatcgtttcatgacacctgtatagagacagctcccagcttcgtatcaccaccctggaccactgcagctgcaggtctcacacccagttgcctactcagtatccacagttggaagactccatggcacctcacagtaaacacacattcataagggtcgcaggggcaaaccgtgctggtatctagatggttacagagaacagtaaacaaaatagcaaagaggccaatgtgacaggaggaaaggagtgggaaatctggtggaagatgagggctgggtcatgggccatccgcacacagggacttgtgagccgtgatgaggacattggcacacagaggaagccctggcatggttttgagcaaaaaagtgaaacagcctatctgataccctagcaaaattacttttgcatggtgtgaaaaaatacattgaacagcagtaagaacagaagcagggagaccagttaggagattgacgcaggtgaaaggtgatagtgactctgaccatgttgggagccatgacctgcgaagtgtctggattctgggtatcttctgaagggagagcacactggatctagcagaagttcatatgcagggtgagtgagaaagagaagactccaggtagagctcagggggtttggtcagagtaaataggtagagttgctaatgagtgagagggacagaactgtggagaaataccttctggggaaggtcagcagtggttatgttaagcccaaagtgcccatcagacatggagtgcagagcagcagctggatatacaagtctgaagtgtgagggagagtactgagctagagataaatgtttgagtcttggggtatggatattatatgaagcatttcagtgtgaagaggtcagaaactagcaaagactagtctgagaaagagtggccagtgaggaagaggcaggctggaagagcctagagtcctggaaaccagggaagaaattgcttatgtaggaggtcagcctgtgacatgccgctgctgacaggccagaccagataacagaacactgatcctttgacttcgttatgtagaggtattatgacttggtgagtagtttcaggggagtgtggggtaaaatgcctgcttgaaggaggttccagacaggtggacacggcctagatgactgttttgaggagtttttctctgaagagggactaagaaacaagatggtggctggagaaagaaattggtcaagagaagaatatttcagtttaagattactgagatcaatttctgaataacatctggctaagtataaaacatcctttctcctactggttgacagtactgtatcatataccaggttcccatttgtacctagatctgtttttaaactgtctcttccattccattggtatatttgctcattcctcagactcttttgattttgtctgtttttatcactgttttggaatacaggtttatcactagtgtctgtttttatcactgttttggaatatgggtttctccaaaattattgctagaatcttaattggaactgcattaaattttctgatgaatgtggagggaaatgtcatccatgaacatgagctctctatttaaatctccctttgtgtcctttaatggaattcctataaagcccttgtacctttatggaacctttaaagggaattttcagacatcctatagattttgttgctgttatgaatggggttgtcttttctgttatattttctacttgattattgctgattcataagaatattattattttctctaaactgaccttatatccaggagtctttctaaactcttagtatttccagtaattgtttcattgtgttatgatgatgtgcatggaagtcctgttatctgcaataatggtgttctctctttccttcctaatgcttttgcgtcttagttcattttcttattttattgctttggtctgagtccctaatttgtattgaacagtggcaataatagcaaacattccttccttattcccagtatagaagcacttcttcattaagtataaaacatcatgctatgggtttttggtgagtagcttttattgaattattcctagttttgttttgttttgtggtttttttaagagacaggattgtgctatgttgcccaggctggagtgcagtggctattcacagatatagtcaacacactatagcctcaaactcctggactcaaccaatcctcctgccttcaccttccaactagttgggactacaggcatgtacctctgcacctggctaaatgattcctaaatttgaaggcctttttttaaaatcataaatagacgttgaactttatccattttttttacatctattaaggtaaatcataaatttgtcttatggctgaattacattgaaatattttctgatgttaaaccatccttgcattcttgagaaaaccgttacttcattataatatctttttctacactgttagatttatttagctaatattttaatttgactttttatatctgtttataatttaaatggatctataaccttgtaccaactttacgtaacataggagtcagtgttagggtagcttcggtagatgatttggctattttccactctttctgcttcatggaagcactgagtaaaacaaggcttgatcgtttcttcagaagttgagagtaggtctcccactttacagccatctaggcttggggcctttggtttgggaatagttgttgattatctctcatatatctatattattttaactttttatttatgtaaatttggttttgtgtgttttcatcatagtgtgttttcttatttttatgcactgtctcattgcactgtgttcttactcttcttcagcttcttacatttagcttttggttttatttcgtattttccaataaatatattaaagataaatattttcaaaggcagtatcttcaatgtttagttctgagtaatttttttgttcaatttttctctaatttctcacttctctcatctctgagattgagtttgggaaaggaagtcaacatcctatgctggtttgcctctgttttcattgtaatagagatagttattggtgtcaggttctccctatagactgtaagcacacagtggagaccgtggctaccttggtgattgctctgtccctgggagctagcccagtgctcgtttatccactgggataagatgatatgtttggcaaagtcttttgttaaggaatagtataatagactctgaaacacggcttcgctgaactcaagctataactgtgtccgtttggttttaattaaactcatctgacattcagcatctaggcaaccagagacagggcattttgtttaattccttctctcactagcatgtgaaatgagaccatttgatcaaaaagcacaagttagatctggacctcaggtgccttgtatttcttttctttttttttttttttcttttgagacagagtcttgctctgtcactcaggctggagcacagtggcgcgatctcagctcactgcaacctccacttcccagattcaagcgattttcctgtctcagcctcctgagtagctgggattacaggcacgtgccaccacacctggctaatttttgtatttttagtagagacggggtttcaccacattggtcaggctggtcttgaactcctgacctcgtgatccccccaaccttggcatcccaaagtgctgggattataggtgtgagccatcgcgccttgtatttcttgaggaaaattgaggccatttgattcatatgaaatgctatttggaaagcagttttttttgttgttttttttgttttttgcttttgtttttgtttttgttttgagacagagtcttgcttttgttgcccaggctggagtgcagtggcacgatctcagctcattgcaacctctgcctcccaggttcaagcgattgtactacctcagcctcccgagtagctgggattataggtgtccaccaccacacctggctaatttttatatttttagtagagacagggtttcaccatgttggccaggctggtctcaaactcctgacctcaggtgatctacctgccttggcctcccaaagtgctgggattacaggcgtgaggcaccacacctgactgaaagcaattttttaatactgtgagaatacatgacctttaaaaaaaaaaagatacttgatatatgcgtttaacatggtcagaatttacacaggaaatgggttttcaaagtgtattgcttagtttctacattagtaaagaactaatctagaaggttcccccacattccacatgctcaagattccatgattcagacctgtagcctgctttattgagagatctagcatgatatatttatatttaaagaaaggagacgctaattaataatgttccaagggtgattggaaggccaggtcagatgagtttccagaattcacattattgtaacacacagtagtcattctgtaaaggcttgttgagtcctaaactgggaagatgccattgtgctacctagtactttttattgtcatttcattctgagggaaaaacaaatcgttttaggtgaaacaaactaaatgaaaggaatctaaaatgtttagctcagtttcaaatagacatatatcacatttgtgtcctaggaggtaggtcaaaagtcaaataatatttgttgttataggataaaatagactttaaatgaacctgactagatagtagccgagatcgtgccactgcactgcagccagcctgagtgacagagcgagatgccatctcaaaaataataataataataatagtagtatgacatagcatctcatggcagctgtagtaaaaatacaggattaaatttaatttaatttaaaaatacaggatttggcccctaaagatctatctttctccttgagaagctacagatttttgtgctattaatcctaagtaaaaagaaaataattttaatccaagtaaaatctaaaacttaacatgcaaataaggacgtttttctatctaaacatattgctgttagtcaaaatataaggtatgtttggtatttgttgagtttttctttgagacagagttttgctctgtcacccaagctggagtgtagtggcacaatctcagctcactgcaaccttgacctcctgagttcaagcgatcctcccacctgagcttcccaactagctgggactacaggcgcaagccaccacactcggccaattttttgttttttgtttttgtttttgttttatttgtagagatggggtataatgttgttaatgttagaaatcatccctgtaatttatgagagacaaaaactgaagacatagataataagcaaggaagcataacataaactgtagtgagtagcttgtgaaggatccagacaggatgaaaaatagcaaatgatggagcagagccttccctaaagtgggtgatgaagaaggccccagcagcaggcagtgctggagctgggccctggcacatgcagccaacacagggaagaacaaacattgggggcgagggagcacatggcaagggaatgacaggccaaggtggggcccagagggcctgtaaggaggcacagactccctggtgggaggctggggccatgagacccggtcctgcactcaggaagccacattgcaggcagacttttttagatgaggaagcactgcccagagtgcctcgtttccctttctttgttggaattggaatgatgcttcccatcagtcgcaagcttctgtacgttcactgtgccttgacattgtggacttctaacattatttctccgtgagcgatcttcaagcctggaagggacttacagctgtgtgtgtgtttcccttcttcagcatttctggattaaaagtggtgggggagtccctttctccagcctttcacctacaactggaagagagcactgggtctcgcgagcaagatgtcagactgcttcaggaaattgtagatcaagtaagtatccgttgacttgaggcatccccccacaccacttctgcccttgccccaagcaattttttaatgttaaatttttaagaaaagtctctttgccctgagagagaagagggtagaaaggaagatgctggtgacccgctcttgacatggaatcctaatcctccaggtccttcctagcttctggccatggtaacaggcagcaggccctcccattgggtcaatgtgtggctccctccaaagatattgtgttttgtaccactttgcatttaaatatacttggcctctcctctgaaaaattagccttgcagaaaactcacttgctcaccattttacaaagccaggctttcctatgtgtagttgggggaggcattgtgtgtgggcatagcacacattcctggacggctggctgtccccgcagcacagctcagggacagtccactcacagtcaccctgaagtcaggatgctcttgtaaacggaaaggaagaccgctttttataacatacctaatttggggagatttatttaaatttctttatcttccaaaagttattttactactaattgtctaagaaacacatcaccagggaaaactgcttgccccttttcatccagtagcactacccctccagagtgcttcctgccctgggcacgcgggtttacagtggttcagagccaacagaagtttctttaaaagggggaggaagagcagcggaataacctgggcaggaaggactcaggacgggcagtgggatgccacccaccttgcacccctcttccaagtcctgggatgctggacatctgctttcagaagaatctggacttttatgtgggctgctgctgctcctttgagaagaatctgacatatacctagtatgtatttgagaatgaaaatgggcatgattctgcttccttgtccagaggctgtagctatgagcaatgctactaggtttctggggtcataatggcagctaccacctgtcatgtgcctttcctaggccaggccctgtcctgagcctcatccgcctagacagcctctcaggcaggctcttctaggccacatggctgtgcagtatacagaccgggtgtgcaggcagcctctgctgcctagctggcttcagctgtcctatgtcccaaatgtttgagccacgtaatctggaataacagatttgtggagaacttcataaaatttgtggtcttctagagtcaattacattaaaaaataaataaaaagccccaggatctgagcttcctaaggaaacatgtcagattatgaatgatcaggctggagctacttatcttgtgaggtgaggaaatgcagctgatgtcccctcaggcacaactctgtggacatgaagactctctagacagggaaaaacatcccactgcctgctttactgcctcattgtttgtattgtaacgttccttaaatacagacaaacacaaaactaagtatgacatctttgtgattagagttctcatacaaatggaaaactaaaacgcatttatacattaaatacaaactaaatggacaagccagtaaaattcccattcatttcattaccttcatgaggcaggtgaatttgtttttttcaatggacttgccccagcgggacagctgagagctgtgttcacagagcaggctcatgagctgcatgcgctggtgttgggtctgagtaatggctccgccgttctcactgagtctcttctcgaactgcatcaggacagttgtccacacatgcttcatgttgagggacagttgcctccttcagatgccagtgtattcattgcatagtaaatccacctctgttctcttttcattagatagcaacagctaaagtcttactactgctttgtaccaaagagacgcagaggaggacgtgcgaatgaagcaactcggtgttaaaataccatgcttacaggaattagccacgtaatgaaagaggaaacgaaaagtctgtggacagctcacagatcccaaactcctgtctgtgggcctggtttgatactggctctcttaaggaaatcctcttgagagttgagtgagaagagaacaatctggggtagggaacagaatactatctagaaacttcattgatagaaaaaatacatatatcttcccgcttctgtgcatcatcacagcttccatttttaaaatcttccgaatcttttgttccactcccctcatcttttcaatatttgaaggaaagaaaagaaccatgctgctgtaactcttatttaagctttgtagatctgagaggctttgccaagtttatgttgagttgctcaacaggacactgtttttacaaactgagctattgtttataatgtctcttaaccagccagggctagaaacagagccagtccagatgtttgcaggagttcacttttccaagtacacttccagagcctagagtcagcgggaggctgttgtcattgcctagtatggtttttccatctcttcctcgcagcctacgacgtgacccctcttcaggcagatacttttactgccagagacatggaataattgttctttcctttacactgccctttgctctgttgctatttttttttaatataactcacataccacataccataaaattcaccctattgaagtatatcgttaagtggcttttagtatcatacattcagcaggttgtgcaaccattactatctcattccaaaactttttcatcactccagaaagaaacccctgtagcctattaccttgctctggtgtttgtgctttctttattttagtagagattgttttcattttttcttaatgttgacagatggttaatatataggaaagctgggtaaaactttgttaacgccagattctgcagtgcccagtggcaccatgcccagatgccacatgtggacatcgtttttgctaatatctgaagtgcagtggtttttctctgacgcagttctactggtggtggtggtcataagtccagcctgcaggactttgctcgcaccacttcctcatgtgctaactctgctttgtctaaatggtagtcactagctagctatggctgtttgaatttaaactaagtggaaataagaaaaggtgcaactgtgacctctcagtagcaccagccatatctccgtgtgctcagcaggcacacagggctcatggcgactgctgggcactacacaacagaggtatttgtcattgcagaaagttctgtggacagtgctgccaaggtggtggtgtagtattttggtgatatcttctagcaattataattggaaaagtgaattaaagctaccgttgcaggatttcagcgttcccccagtttaattaccaccatgtctgaagtccaggttgcagatgtcttctttttcttcctacagtgcatgaacagaagtattgcattaactcaggcgcgctacttggagaaagaagagaagtgtctccctcctcccaggtcagttgacgttaaaatatgaccttatttttttcccctactctgagctctatgaaatacgttatcttttgaaaaattttgaaagactatcataggctatggaagaatatctgtcattaaaatatagtacattacctgtcttctgctcttaaactagaagtttctaaaattttaactgaaaagctcccaaggactcactgagtaccctctcagttaactcagagaaatgtctgggagcccagcaatgaacttgggcaaactgagtttccatcagctcatatctgccacatctgaaaggtggcacatgccacaccaggagttcctgccacaaggaccgtcctgcagggaagatcggcagtgtggggtgggggtgggcatgcgcctctgctgctccttcagtcagcaacactcagtaacatttgagaaaaaacaagcaacagtggggaaaatgtacagcatcaagaaaaaacaccaaaagtgaaagactaatgtcttacttttaaggagactggattctgttcacaaagcatatacgaggtagtccaaggagttggccatcccaccacagcactgggccaggcagtcacagcagggggcatggacatggtcagttctgccctggggcattgctcaggcttttgagagcaggcgatgtctacaccaaaactagagaagtgtgtgtgtcgggcatcctgtgggcatcgtggctttccatcagatgaggtggtgtgtgctttgctcagggttttcagtggcttggagacctccaggttcatctgggagtacagagtgcaagccgcagaagagctggagagaagggtcctgaggccaggtgccaagtcagggaggctgcaggagagcccactggggagtttgaatgctctgccggcccacagtgccagaccaggatttggaagatcactctggtagcagctcaaagcaccttaaggagcctgcccttttcagccaggtgcagtggcccacacctgtaacctcaacacctgggagaccgaggtgggcagatcacttgagcccaggagtacaagaccagcctgggcaacatggtgaaaccccatctctgtaaaaattagccaggcatagtggtgcacgcctgtggtcccagctacttgggaggctgaggtgggaaaatcacctggttccaggaggtcaaggctgcagtgagctgagatcactccattgcactccagcctgggctgcccccttcattttttattgcactcatccaaaggtgtaatcctacatcctacgtttacttgttagtaagaccgtaggtgcatgaggacgggagccgtgctggttttgtgccctcaggactccatgcacagcatagtacagctcaataaatatgtgtcaaatgcatgaaacagatgtttacagatgaactctgggggacagaggtagcattgtcctttcaagctattatttctttgatttcctgaaaacttgaaaatttctgccatgccttagagtattacagagctttcacattgctattgacataaatacgaacaatcaaactgtcgttgatttgagaaggatggaattcctgctttgtgcctggcactgcctgaagcagtacatgatggacaggatgctatttcccagcttctgaggcagagcccacggaaactcactctgactgggtgtgcactggtgtggtgtaggccgaggccttcaggctgcagattccctgccgcagcaacccacctgccacagtagtgagaaagtgactgtgggcagcaggtacatgaatagacaggcctattgggaggactgccaggagaggtttgtttacaaaaataggcagtggatttggctctcaggccatatatggttgactgtgagtgcagttcctcacctcacatagataattcttttttctgtttgtttgtttttggtttttttttttttttgagacagagtctcactctgttgcccaggctggagtgcaatggcgcgatctcggctcactgctagctccgcctcccaggttcacgccattctcctgcctcagcctcccaagtagctgggactacaggcacccgccaccacactggctaattttttggtatttttagcagagatggggtttcactgtgttagccaggatggtctcgatctcctgacctcgtgatccacctgccttggcctccaaagtgctgggattacaggcgtgagccactgcgcctggcccacaaagataattctttgtgtcctttactgttctcagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctgattattagtctatttgcatatgtaatatatccaacagaatagtctcttaattttaacttttttgcactggggtagtattctttgttgtttggtcttattttagaaaataacaattaaatttcttagttccttttttcacatccaaccaaagaatatatagtatctgaagtttcctaggttcttgctgacctcataggactacaaaaatatcatggccattattttcataaataactgttcagcttcttttagaatactttctaagtgaaaatagcaacatcaaaataatgtttgtaataaactttttgaaaatatgatcaggagtttctgggaaagatggcggatcaggcacattatttcagtccttaaaaccaacattgtaaacgaaaggaaccaaaagtaaaatttttgtgttaaaattatagagtgaccacaatccagtaatatacaccacgatgaaatgtctactagaaacagtaaaatttggatcaaactgaagcaaaatgctgagaaagtacagtcatctcaaatctggaccaagttacaaattcctcttttacagagtgagaagtttccagagtgctctaccaatgatctgtgttttaaaaggcagtggcttggggtgagcagtgtagagaccattgggagcccatttccactcagcaggactgtccgcagggaagaagagaaccacaccacctttttattgtctgtgactaaattctaacttcaggaaaagtagggctttggggcaagttgggacagaaaatacaccagttatttcatcaaattcagtacttcacta

SEQ ID NO: 15692 - DNA, 87352 bp, Human; identical to SEQ ID NO: 12053

SEQ ID NO: 15693 - DNA, 87352 bp, Human; identical to SEQ ID NO: 12053

SEQ ID NO: 15694 - DNA, 60338 bp, Human
  misc_feature (1)...(60338): n = A,T,C or G
tcaggtgggggaatccctttgggccacgccccactttggccctcagcactgctctgcagggtaagggccagggcagggttgaaggtccccctggccgatggaggggtccaggcagaatggggctcattcagaagctggccagtcctccctcaccttggtctctgcctctgggcaaccactcaccctgctgttggtggcaggacggtgggggtggggggcggggtgctgctggcagtttgggcccctgttttcttctcaggagcgctgtgacctcactgtccctcatgtcactggtgcatgtgagttaggaagggtctgtcccctaggctggaaccatttctgcggcaaggagtaaaggtcccagcagcctgtgaccctgggactgtgacctcagttcagctcaggctggagctaaagcagagggtttgagccagagcttcagacactggattctagctccgctctgccactcacatgctgtgtggccttgggaaagatacaccgtcattctgtgcagcaggtttctgcccataccattgagataacaatcacaggtacttcatacagggtagtcgtgaaggtgaaaacagaatgcttgctctttccagggcgaccctaccaatgagaaaacaggctgcagtggggagtgaccgccccaaggacacacaactgctgcaagggtgtcattgtgtaggtgttcctcacttgcctcctgctagtgtgggaggcccagagactccacgagacccccagctgctcctgtgagagggctgaggggggccagctgtgataccgcctcccatctagaaggggcctcaagccacccatgtacacccagccccacgtggctcaccaggggcccctttgccatcaagggccacatcccaggtttaagtgtcagagaactaaggggcttaagagagaatcgagctgtggctttgtttgtgaattggtttgatccttttttccttctagaaggactcacagctactgttgcttgccatgggcttgagggggtggtgggggctgactggcagaggggctgagagtggatggtgattaaaaggagcactgactccagggtagcggctgggcaaggcttggggctcccacctcccccaggttcagagccggctgaggaccgggagtcctcccttctggggtcagtgctcactatggagcaactgccttggatggggtcccaggacttgctcttttactggggctgtggttgcagtgatcagggctttggagccggcagaccaagctgggaaactcctgaggtagagaagctgttgaaggcgggcctggggtcacaactcccagctgctttttacaagcaagagacttctctctgaacctcaaccttccctcctgtctagtgggttcgcagccagacagtcttttactcactgcttactgggtgccctctggagtctgggcaggtgccaggctctgagaagacaggccagcaatcagccctggcctaagggatgaaagccgggccttcccgcgccggctcacctcggttttctcatccttactcggctaccagaggctatggttggggagggagggggctctgggggctgcagaaggcccaggctgccggcaccggatagaagtgagcacgaagctccctgcgccagtggaacttttatcccggctcccaccgcgaagcgtttaaattgcttccccagggccaggaggcaagtctctcgaaggacggctgcggccaccctccgcccctgagttacatgggtcgcagccactgccgccctccttggcgcctccagcccgcgggccagggccaggaaccgcgagccgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccggtaaggagccctcggcccctctcgctgcccactccctagccgagagcacccgcttcccgggcccagcggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtgggggggctcccgattctctctccctctctcggactcgccgtctgtctccacctctatttctctgcgtaaaaccaggagtccagcccctctggggcttggacgtatcgctttccccgcagcctcagtttaccctggacagatgggcatggtggccctggctcccttccctgcagggggcggcagccacctggccctccccggtggggctggcggcctcgcggcggggtttcctgctggcctgggctgggctctgtgggaggggcagtgccaggaatattttctattcgggctgctgttgcctttggcccctgggcggctgcgccctccagggaggcagggtcattgtgaaagagaggaaactcctctcccaggcggccagggctgttcctgaggagggctggcctggcctcagtattcttctctgagaagtggagagtccactcccgagcagccgagtcaggctgcaggtctcagggcaggaacagacctgttctctccccaggggtagatcaagacctaggggacttgggctttgatcctcccgctcccagcaagcacaaacccagtgatggggagagctggtgaggccttggctcagcctccagattcccaagcttccttttcattttcttttctttctaaaaatttatcagagatgtggactcgtcatgttgcccaggctggcctcgagctcctgggctcaagcgaccctcctccctcgggcctcctaaactgctaggattacaggctcgagccacccaaagtgcctggcccccaagcttcagtctgttagagctggctggggctgagggctcaggaaacatttgcagatactgtgcggctgctaagggctctgtagactgttgggtgctgggcctgggtccaattgcacaataactgtgcctggggttaggttctgatgagagggagggagaagcagccacacggactgggaagcttggctaggagcaggaactggaggagtctccattccaaactccctctccctcccagaccccttaggcccaaggcctagggcggggaagtttgggggtgggggcgggaccctgtcctggcggggccatctgtgcaccatgctgagaagtaattctggttctgctctgtgggggtggatcaagtgaatgaatagtgactcctgcctgctgagcgcctggccggtgcgggggcagacacgtcgtgagagggaaggggaggccccactctcagcacagtctccattcctgagtgcttgggaagcaggcccagggccgcaggagccttggggtggagccaggcccaaaacagcctgctgcacaagcgcttccccctcccaacccgggcccatctcatctttggcctgctgggaggccagccaggtcaaccagatgcctcatctgagcactgactacacagtccctgaagtcagtggcttgcctgtgggcaccaggcacccatgtggaaagaggtaacttcgctggaattcagagtctaaggctctgatttctgatgtagctttgggcaaagttgatcttccagggcgtggctccctccccagacttggggtcgaccaggcacccataggcactttgatatgagtggaacgaatgaatgaatgtgcccttcgtccatcaccaaagacaaaccgagctcagctgagttagaatgtcagcgaggggttgcaggggaatcttccacggggcagtaggcctgagctatagcacacaggctctccagagaaatagtgggcaggttggccatgactcactggggggctggttttctggaaggtgtgtagagtgaaggggagatctgaggtctcctaggagccagggagtggaaggcctagtgcagggaagagcaagtggcctgcagtcaggctgggtttgaagccgctagcttgtgacctcggctggccgcttagcctctgcctcctcctttgtaaataggtggtaatggcagtctccaccttgagaggatgcacctgtgactgtgaacatagtagccgctcttgttgtcattccagctctgacgttttcaagtagcacgagttttccttagtgtcaagtgagcgcccaggctggcctgtttgctggaagctggacagatggctgtggctggggccacagagaatgccatcccaatgaaagccaggtggctctggtaccttgacgcgaggccaccttccctcctcccaggtgtctcttccggggaaggagggctggagggcagtgggcatttgccagggagctggagaaacctgccgtggccctttctgggggatgtggtgggggtggagctgggactaggggaggctgaattcagccaggatctgcctgccaggcgcagctcccaggaagaaagcccaatgtctgggagggtcagaacccagagggctgtcaggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgtggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatcattttcccaagcccatctgcccagctcatttctctgcatgcatacactggccccaacacccacacacgtgtgcatgcacacaggcacacatgtgcaagcccaaacacatcacacacatgcatgcacacacattgtgtactctcaggtacgcacccctgggtgcacacaggtgtgtgcgcgcgcacacacacacacacacacacactgtctcaggtacacacgccaggtccatgcattgcttcacactgcccagccccagaggctgaaggcctcagagcccacacctgcccagctacaacctggcaggcaggaggggctcactggtttcttttggtttatttaagacagagtttcactctgtcacccaggctggagtgtggtggcacgatcttggctcactgcaacctttacctcccaggttcaagcgattctcgtgcctcagcctcccaagtagctgggactacaggtgtgtgccgccacactcagctaatttttgtatttttagtagagacggggttttgccacgttggccaggctggtctggaactcctgacctcaagtgatccacccacctcggccgtccaaagtgctgggattacaggcatgaaccactgtgctcggccatgagagcatgtgtaggactccacagcttcagggcaccccagccctctttttgcggtgaggagctgacctccagagagtggaactagtagcattgttctaagtgcctgccacaggcatctgggagatggtccctgtttccatggagctcgtagtgggggagagggcagttagaatacagcatgatggccggatgtagtggcccatgcctggaatcccagcactttgagaggctgaggcaggcagatcgcttgagtccaggagttcgagtccagcctgggcaatgtagtgaaaccccatctctacaaaaaatacaaaaattaggcaggtgtggtggcatgtgcctgtagtcccagctacttgggggtggtggcactgagctgggatgggaggatcccttgagcccaagaggtggaggctgtggtgagctgagattgcatcactgcactccagcctaggtgacagaatgagaccctgtctgaaaaaaaaaaaaaaaaaaaaaggatacagctctgatgggcaggaggcatggcgggtcactgaggcgatgcaggtgatccagctgtttctgtggagctgcccctccgtgtttctgtggagctgcctctcttggctccaggtgcctctgggaggaggcaggagcaggggtgactctcagagctgggtgaatcttgggccagcatcatcagatcacacttgcccaggacttcccttccttgagtctccagtggtggtcttgtacctatgagcagggggttaaggagccgagctgatctgagttggagtcctggctctgctgcctaccagtcaaacgagatgcagggcaagttcctcagcccaagcctcagttttcctgactctaaaatgaagagaaccccagatggaagggcttagcctaagacggacatgtctattcccttgattgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaaatgcaatttatgatatgtcaagtagacctcaatagagctgttttaaaacatacaacagaatttcccgcaacccaaccacaccacccgcgccatcacacgcaaacaggggtaggcttccacacatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcccaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagccccggctgactggcaggtgggaccgtgcagcatgcacgggactgaattctcatgtgacggagctccaaagtccacctggctacacggccaggctctgcagcagaggacgggaggcctgggaaaggcacttcctctccccgagcttccaggcacacagagagtgctcaggatagcgatgcctgcatcactgcaatggtgatggccgggtgacccttctgggctccacttccccagtagtgtctaataaagaccctgggtgactctgaccttgtgacgttggtcagactccagtggaaacgttcccaggcagaacaaacatgccctgtacatttgggaaatgcgggatgctggggccaggtgtccacggaggctggaaccaggaggcctgggcccacatctgcccctgctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgaggtcagggtccccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaaacctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactcaactcaaaccaacttacgcaaaaaggaaagggaaaagacaattcttggctcacacaactgagaagtccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgagcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcatggcctttgactagggaggagagctggaggctaggaaggccctgacaagctaatctttgcactggctgagaaagagttttctggaaaagacagatgagtttcaggagaaccctagaccttccagcaatgacagcagatggttgtctcccagcagcctgtgtggccagggccaggctcagccaatgctccaacccatggaagccaccagccatcaccacgctacaatccagctcccaatctcacctcctggaagaatctcacctctccaggccttgggctttgtcctttttccttcttactgtgacttggccatggaatggaagctgtctctgtagcagggggtgggaggctgctgcatgcggatggtgtgaactcagggctccccccaggggctgacggagcctctccgcttctgcttctcaggccaacattggccagaaggaagacttcgaggaagccaggaagaaggcactgaagcttggggccaaaaaggtaccaggcgggaggcagggatttgggctgggagtggggcggtgatgtggagggcagtggtggatgctcctgccccagggatcccatcccttccagtgtgtcttcttgcttctaagagtatgagatcatcctgctctcaggtgtgtgaaccctcttgtttttctgcctcccccacgccctcttccacccacccaccttcccatccaggtggagtgtctcttccccacccacataccttcccttctcttttatctctctgtccatctatgcacccactcaccctcttttatctctgtttatctactcgtccacatatccatccatcattcatccctccattagctatccatcgatccatccatccatccattcagccatccatccatccatcacccacccatccattcacccatcatccatccatccatccatccatcacccacccatccattcacccatcatccatccatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatccattcacccatccatcccttcattatccatccatccatccacatatccatctgtcattaatccctccactgtctatccatccattcatccagacagccagccattcatctatccatcccccatccatccatccatgcttcatccattcaccgtttttctatccatccattcatccatccatccatctgtcatccatcatccatccttctgtccatcatccccctacctgtccttccctcttttatctctctgtctacccattcttccattcattcaacagaatcagagaactccaattgagtctggtgccttgattgtgaatctaggcatgtggcaggcagacccctgtcccatacagggcatttatgatgaacagtgtcatcaggacccctgctcacatgtgctcactccccatggagaagcccttgccacttgtgccccttcatttgggagagtgagcaggggacatagcagggatgatgtgcaaggccaccagcccacctgcagggtcagagctgatcccctctgtggggtgcttctgcagggttgccagggtaattagcatgttaaaatgaacacgggagggagtggatgccccagtcccaagtcacctactggccacaggcctggaactagaatgtccctccttggttctgtgcctcccgagtgctggagagcagaggggttgtctgagcagtagtccaggaaggggagaaagagccctgagtgttgaagattcgagtgcgctttcagcagcgcaggagcaggctttgtgcacggcttcagcttttgtcctttattctagatgagcagttctcaaaccttgtggtcttgggaatcctctacactctaatttacgtggcgtttttaatgtttattttcttgcatataacattaggatgggccaggcacagtggctcacgcctgtaatcccagcactttggcaggctgaggcaggcagatcacctgaggtcaggagttcaagaccagcctggccaacatggtgaaaccctgtctctactaaaaatacaaaaattagctgggcgcgatggtgggtgcctgtaatcccagatgctcgggaggctgaggcaggagagtcgcttgaacccaggaggcggaggttgcagtaagctgaaatcacaccattgcactccatcctgggcaacaacagcaaaactctgtaaaaaaaaccaaccaaccaaccaaacaaacacaaaaacacatttatcctaatgttttttatatatccttagtcccaattgctttcttttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaacccggaaggcagaggttacagtgagccaagattgcacctctgcactccagtctggatgacagagagtccatctcaaaaaaaaaaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaacagatggactcttgtagcagttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggctgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaatatctccagatacttccaaatgcctcccctactcccacccccaacagggacaaaaccgtctctggttgggaactactgctgtgagatcttaggtgacaactaagtttcatcttgttggggctgatttagaagccacatccagtttcacagaacggtgcatcaggattgattagcaggctggccgcggtggcttgtgcctgtaatcccagcactttgggaggccgaggcagctggatcacctgaggtcaggggttcaagaccaacctggccaacatggtgaaaccccgtctctaccaaaaatacaaaaattagcaagccatggtggcatgcgcctgtaatcccagctactcaagaggctgaggcaggggagttgcttgaacctgggagacggaggttgcagtgagttgagactgagccactgcactccaacctgggcaacagagcaagacttcgactcaaaaaaaaaaaaaaaaagagagctattgattagcaatgtctgccatgagtgcaggagggagagtaacagtgcagtgtgctgggattgatgaatgatgtctactacagatgcagaagaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaacgcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcgagggtaacaaaatgtctcaaactggtggcttagaacacagaactgttctgcctcatggttctggaggcctgaggtccatagtgagggcatgggcagggccacgcagcctctgaaggtgccaggaagcctccggctcaggcctctctccagcttccagtggcctctggtgtcccttagcgtgtggctgcgtcactcctgtccttccgtcctccatcttcccaagctgtcttcttcctgtatctctgcattgtcttccctctgcttgtctgtttaccttccccttgctacaggaacccgtcttggattagggcccttcaatgacctcatcttaacttggttactttttgtgtgtgtgtgtgggggagagggacaaagtctcactctgacgcccaggctggagtgcagtggctcgatcttggctcactgcaacctctgcctcccagattgaagcaattctcctgcctcagcctcctgagtagctgggattacaggtgtgtaccccaccacacccggctaattttttgtatttttagtagagacggggtttcgccatgttgggcaggctggtcttgaactcctgacctcaaatgatccaccagccttggcctcccaaagcactgggattacaggcgtgggccaccatgcccagccttaacttggttatttctgttaagaccacatgaggccacattcggagggactggggttaggacttgaacccattattttgtggaaacacaaatcaacccatcccgtaccccttccctccgggccgtgtgtcccagtgcagactgcggggtccccgtggggtgcaagacaggaagccccctgcctgctgctcttcggaaggcagtccttgagaaaccagattcctgacaatgttggcaactgtcagccgatgtttttataaagacccaagtcatgagctctcagtcagcggacagtatgccaagagcctggtacaggaattgactgtttaccaaccccacagtcagaaggctcggaaactccccagtgacggggagctcactacctcgcctgcccgggctggtcagggtgctgatggtgggaagtcctggctcactgtgggaggtcctggctcactgtggtgcagggacacacacagctaagatgatgatggaggagacgcggttgatttgagggtggcctgggagacagccacccaccaggatggcacctgtcatgtctttgaaagtccaagtgttcatttcttcaccggagcactggttcagcaagcttgcactgggtatctgctgggagttgggtgcttgctggcattggcacagtgctaacttcttgggctcattgcgtaccttcagagagcccatttcctggcaagagaagagaaaatggatgtgtgatgaggaatgggagtggggccaggggtctgtgccagggaactgtgggagcagcaggcaggggctgaggatgagtctagaggagtgaataatggcatggaagagtgtgagaggcagagggaacagcctgtggaaaggcttagagccaagaggccctgaaggacagtctgtctggggctgtggagcaggagctattgctgtgagggaggcaatagggccaggactgggctgaggccatgctgggaggtttggcttcatcctgagggcaactgattagtgggtggaaggaggtctcaggttggatggaggtggccagtgactaccccagcgagatgctggggaagagacaggggagagcttctcacagactgcggccttggtttttactgtcactccagctgtggatgatgggatggtaggaaaccaggcaaggaggtttgggcgggcctgagctgttgggcaggaccgtgtgtatgctgccatctgtgcaaaggtggtggcagaggaggagaacccagaggatcaggactgggcgacacagcgagactctgtcccaaacaaaaaaaaaagctcccgacccatctgccttaatggaaagagctggatcgtgagcttcctatcccagaaggcatacaagccgagggcaggggatcagaattctgggaggggtcctgccctcaggtctttccaacggtaccattaaggttcagtagggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcctccatgtggccaccagagggcgccagaggcttgggtttgaggccttgggggccaacaaaggcgggaggaggtggcggcaccaccggggtcctctgttccccatcctggacctgcagggcgtggttctgaggagaacgcccccgcaagctagtgctatggccgctcgggacttgggggcgtccctgcattcacactcagaagacccaacagggacggactccggggatgccagggagtaggtgctacctggcacagccacctctttcctggggttgacaggcaaggcgtacttctgcgcctcagtgtccctttatgacagtacccaggaaacccccaacagcctctggagacaatttccgagaactgggggtgtgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctggccggggagcgagagttttgtaaatggcaccatctgtatgggtgccccagggcagatgggagaccccaggccccccagtcccagtgggaccgtgtttacatgcatgtttacacacgtgtgcacaaatatcagcatgcggacactcgtgtgtgagacactacatcctccttctccccggaaagctgccaggagctgccctggtgctggggtcttggggttcagagggggaaggattagactggcctccttggctcttgcctgagacgagggcagagtttgaaccaaggaagcgtttgtttggcctcttcgagggtctctggctcctgaacagatgggtgtccgcatggcagcatctggatgggcagacagcagcccagccgtgcctggctggtgaggcacaagccgtctttgtgttggggaaacatgaagctgtgggggaaaatagctgggccatgcaacgtcggaccatgccttaccatctaaaatgaggctgtcttttagttgctccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggcgctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggatgcctgcgctgaccccggcctcctcctcctcggcatcagtgtggacggtggtcccggctatgtcgggggtaacgttcacagctcagtggggtgttgaggtgtctccatttgcccacagaggatgcaggcgaggcaacctgcccgagggggtggctgtggtgctggggacctgggcttgggtcccgggcctgccctggctgtgtgtccttggactggttcctttcccttcctgggcctcagtttccctctctgtgcagagaagagctgaggagcaaaaggccctcagtggtcacctagttccacctcctccctgacaccagccattgaagagatgcggaaactgaggctcagagaggtgacagggttcccaaatgtatgggtatgggggagtccaagcaccctggtgccccagccctgaagtgagcttgatttggggcagggcagggtcagcaatgtgggggccttgaggaagagactatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacctgatggggaggagggcacagggttctgggagattccacaggacaggcacagaatctcctccgtggcaggggtgcccatcgggtggacagcctgctggggaggctcccttcgctggggccagctccaggggacacactttcttccccgccattcattcttcccggagaggctgtccaggtgctggggcacgggatagaaagtccctgccactcttcagccacatccctggcatcccaggtgtgggcaggcatggctctggcaccccaggtgcgggcagggatggctctggcaccccaggtgcgggtggggatggctctgaaacgtggttgctggtgtctgggatgctcagagccctccgagccccagtcagagcccccagctatgcctggctcctccccaggccacctgtgcctggtccccagcatctcttgagcctttcctggggtgggaatcaccaggatctcagggcctcaaccgccctggcccgtggcatgtcacccaggcaggagggcacctgtgggtattgcccagactgctactaccatccccacccctccagcttgaccttggacctggcctgcgtccatgcatgaatgatggacacgttccttccttcactcgctagctcatccttcatccagtgtctactgagcacccactcagctccaggggtgccgagtgcagggcccagggcagggccgagcagtgggagtttgaggcacactgccgctgcaagctgcccaatttttctagtagccatatatataatatataaatatttttatataatatgtattacatataaatacatatgttttatatatatatatatatatatatattttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccagctgtagtagccatattaaaaaatagaaaaatgaaacaagtgacatgattttaataacatgttttaccgaaaccgatatatccaaaatgttatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttgggctcaagctctggaagagttgccccctcctaagcccccaaggggctcacaggagtttccattttgttctttctaagaggaatctctttccccgtccctttaaccagctggtagctcttgggatgcgtggcctggaggtgagccgtaatgagctctaatgatctgttttgaccccagacaccaggcagctcagtggctgggacagtagctgcttgttgacttgctgccagcgaggccgcaggacggggccctccctcggttcccacagcagcttgtggggccagggtgtccagtttcgaggtctttgtctgcagaggccaagcccaggcactgagatgggattggggcaggggccaagctgctccaggagctgggagtaggactgtggtcttcccatggctgctctgaggggctgaggaggtggcgggccccttccattgccctgcaccactgtcagctccacggcccagcagccaaatgacatctccacccccacacacacatgcccccgagtcctgctcagaggcaggggcctggtgagctccagggctgagtcgggggctctttttaccagctcaggccgaggggctcaaggggaatgagcttggtccctcagccaggctcagagtcttcccccacttctttcccttccacacccagagaagtgggtggggggcagcctatgcctctctgggcccccgaccacacgtggggccaggccagcagcggcagctctgtggactctccctgggtcacggcagtggccctgtggctgaaggtgctggcaaggaccatgaaccccgtctagttcaaactctcaggtctcatctggggagactgaggcccagggaacagggacccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgggcacgtccctgctgggggctgtctgagccagtggcctaggccgggactgaccccatgtgatgggggattgaacttccaccccagctgcctacacacgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccggggggatgtgatcgggagctgttctcccaattccctggatactaattgcccctagcgctttccccgggaacaggtaggcgctccaagggacagtcgcagacaaagccttttatggcaccagccctttttgaagtacaagttgcaataaaacatattagaagttttgcatcaagatccttagccgctccccagggcacctttctttttagcgactcgatggcagcccttgacaaacagcctcaatcaatcaggccggggaaaagcaactcagcgcacacaccagaaaattgctcaggtttttaaatagcagtcgccaaggctggctgtgagctctcgctgcagccaaggtgccgcgtggtaggggaggcggcagggacgcagccctgcccccgccgccagcaacccattaagacctggagtgctgggagggaagaccttctccaccatctgttgttttattattaagaggggagtttacaagagcaagcccatatgttgccaaacaaattgtcaaatagcagagctattaagggagccgggttggtgaggtttctcccctggtctccttgatgatatagaatatgaagcgtgtttcatctttaagaataatgaattggagcccccacccagctctaccctcacgcctcgagtcctggatagagaggggcagggccgacccatacgttgccctttctttccgttaagtccccagacaaaagcagcttctggtttttctagcatagatgagtctcaggagcacactgctgtccttccttctcaggttttgaggagaaggtgctgagctcagcttccatcccaaataaccttttgagccggaaaagtttgccagggaaagatgagcatggccccctcggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagatgcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacatgccctagtacatctggctaatttttgttttttatatatttatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaattacaatgagagtgtgaggggaggcacctcgggaccgagagaggctgggaaacacaaatctctttggtcttgggagggtcattgtcattggcccctgttgctttcctccccgccctttagcctctccttgctcctggacggaggtccgctgagaagggaggcaaaggttctttcacgccaccgcccaaaaacagaggctccacggagcctggccggctgctcttcttagcacccagctgctgagctgagtgaggagcgaggacggagcccagcaggccaccaggacatctctgctggagagtccagtcttgccttgcacagggtccgggtacccatgcctggccaagggcacagggcgagtgtgtgggctgaagagtcttcaaattctagagtagatcgtgggctgtgttttgtttttttaaatttcagttttcacgtgtaatatggtaactgttgatgagataatctacacaaactaaggctcttaggggcccttagtgattttttctttctcttcttttttttttcttttttgagatagagtctcactctgtcacccaagctggggtgcaatggcactatctcagctcactgcagcctctgcctcccaagttcaagtgatgctcctacctcagtctcccaagtagctgggactacaggcgcctgccaccatgccaggctaatttttgttatctttagtagagataaggttttaccatgttggccagactggtcttgaactcctgacctcaagtgagccactgcacctggccttgtaggctgttttaaaatgagtctcctggctttctagaaaaccccgaaaccagagcatttagcctcattttaatgttaaggtggtgatggggaaacagctgctccctgcaggaggcctctagaatctcaccatcttgggaatgagcctgagtggggtcgatcccatcaggagagagatgggagggtgacccggtgggggctgcctgtggttcccacagggatccagtggggctgaggggctgaaggggctcagaggcagagcatccagtctcgctggctctgaggggctgggtggggccccttcagtgcaccctgtgccctataagcttggggccaggagagcagtgccaggtgtccgagtgcaggaggaggctggagtgcacgagctggattccagtcgggcgtcatcaagggtggtgcgggtccccagggcgacaagcctcatcttcttcctcctcttaaggctgagtcaggtgggccttccatgcgtgacctgcagccctcttagcctgggcctcctgggcagaggtgggtgtcctcctgtaacaacagactgggccatttaggaagcgaaacagagccagagccgagtgccttggagacgggatctgctgggtgttccccttctagggtctgcagagtgatgtgtgtggctgttgcgccaggcccagggaggggtgcccccagaaggtgtgggccatgagctaaaagctctccctgcatcctacctgtcctggggtccacaggaagcactgcctgggctctggtgccaggtgccccggtccacagtgcgagcgggttcacacaagccccagctcgtagggtggtggcggggctggttggctggtgccgggagacctggctgggcatggcacctgcgtgcttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgaccctcacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtatcaaggagggcttcttagaggaggtggcattcaaggatggagaagaggcccagatgtggcacaggggaagagtgtttaaggcagaggcagaggcccccccaaccacgtgcagagccccggggcagtccccagaagacaggtaaaggccccagctctttcttacaacctgcagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccgtctcctcccagctggccacctttggtggtagcagctccatgccgatgctgtctgatgtatttgtagcctaatttgaaatttcacgggggccagccgtggggctggggccgagccctgcctgtgttccccgacccccgcactggcccccctctgcccaccatctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggcggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctggtttggaggcgggaaaagtgtgctttttgaggggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagagtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctgcctgtggctgtgatgctggctggctctggccacaggcctcaccctgtttctcagcccaggttactacagcagctgggaaccagcataaggtggcggaaagagtccctgtgtttagcttccaaagcatggtttggagaagccacctctcagccttggctttccctgtggtccatagaggcatcaggctgggggtccctcagggcccctcctacctcctggagtctgtcttcagggaaagttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaataaggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcgatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtctgcaaggtttttaaagcaaagatgagacagcagttcctggatgtcagcaggtgaacaaggaccccaggcacaggatgcccacaggagggacctgagcagtcaggcccaagaggccccagtccccacagtggcaaatgtccaagccacggcctgggggagctggggcctccgaaggtgggagggaatttcgagagtttcaggcaacacgcagcccctccaccactgcatcagacgagaggcccattttccaacacgcccaagaaaaaatatacataaaggttgatgtgttttcaaatgggtttttgctttgctcttctcttttctccctgtgagtattaaccttggggaccctggggacggctcggcttgccagagcacctgctggggtcacaggcagtcattagctttgcggtcagtgcagaataaaccccaatcccgagccggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggtatgtgcccacctgttgggactcgaagggggttgacttttggggccctggctcctttcccctccctgcctgggaacctaggccctctttacccccgccctgcattcctggaagctagagttcaggcaggggcttcaaggtaacgcacagcccacctccctggacagtacaacccatggaccatggatgcctctaggcttgggaggaacatgccctcggctacccatcactcgggttcatgggcaccaggtctggaatgagagcgctctagtccctgaacagccactcaactttcctgggcctcagtttcctcagctgtatctgaggatgaaagagtgcctgctgttttcctggggtagaatgaggcctgcaagggagcgtccagccctgggccctgaccccggaaggtgctcagtaaacggtgagtgttggcgagctggcctcatggacccctgggaccccacatggaaagccttcgccagtcttcattgagccgctctgggcctcaccctgctgaccccacgttcaaagctgcggccactcttgctcccctcggcagtggaggctgtcctgatcgctccctccttctcactgctgtcaacaagaagcgtttgctgacctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggggctggcccattcgtccacaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttgctccccttcatctgtcccaacctactggggggccaaagaggaccccaaaggcagccgggcccccaggcctgtttgcaggcacagagcctccctttaggatcatctctgagaagatggtgggagtggccccagcagcacctcctggctccctgcacagggctcccaggagcctggagagccgtgagggtgggaggcgggtggcaggctgcggagggtcctgggcaccaggctctggcagccctgcccgaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggcggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccccccaaccccttccctcctgccaccccggacccagctcctcggattcagggacgctgccgacacctcgcctgctggagcgggcaccgtgtcacccccatcaatcagatggctgcgtgtgggtctggggtacagggtcggggcgcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccctgcagcaggcctcaacctgcacagggcttttgaaggagtcatttggagtccatatctgtcacatccatttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccggggctctcaggcccttggctggatgggaggccaggatagaaggaaagggagcagtagttagctgtggcgctaggcagggccccaggacacagggaacggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcggggcccagcaaacccagagatccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcaggtgcctctgtcttctcttagtagccaaagcccatgattccctttgtcagccaatcagcatttcatcttgaccacaaccctcctctccaggactcagtttccccattcatacaccaaggggatctcagctccctgagggtctgccagtgtgtgataaagccatgctgtgttctttcttgggggtcctaagagggaaagagcaaggtttcagcagttgcagcccctgaattgggcacctgaatttttatactggtggtggggtcagggcttcccgtttcggtaaatgttcaggtctctttgcttagggttgattggaaaagataccacaaccaaatatcacctggccacggtatagtcacggccccatgtctctcaggctatttttactaagattctaaaatccaaagagagccgatcaccccatgtgggccagaagaaaagggtggtggtccggagggcaggatgcctgcttctggtctcaggtttgccctgccttgcccaacaaccttggacttgtcatctatcgctaggcctcagtttccccaagtgtaatgcggtaggcgctgggagttgcatcactctggctctgacctgtctgcgtttccctggaaaggcatggcagcatggaccggggcggggacgggcttgcctcgaaagacatgggagcgcggaaggggaggcgggctcgcctctttcttgtggctttagctccttgcttgctgttattcaggagaaacaacctaattgaagctctggggaggccttgagaacaatgttactaattagctgctcctttttatccgggcttacctttgtctcttacctatattaacatgtgattagatgcccctttgtcgcagcctgcccttgggagccagcgcggtgtgcaccctccagggagagctgggagggaccttgaggagccacagaccagcaccccatttacagatgcggaagccagggctggggaggggtgggatagagggcttgcttcaagtcccaggcactttagtggcaggaccaggactgccatctgggcccagagtggcatggagtggagggctaacagcttagactggagttggacagatctgggttcaaactcatgtatggtggcaggaactggtacactggaagtgctccataaatagccatcagtcccccgggcatgtggaatggggacagaagcagcccccatcctctgggagctgtcagtgtggcggggggtggggtgggttccagtattgcacctgtcttatcataataagggcctgccacaggcatgcccttgccatgcctgtggcaggcatcaccagtcaatgctggcattatcctgttgactccagaggtatctcagggctgcttgcaggcactaccaaatgatcaggattggcatacgtgatgaaagtgtattgccttccctattggaaagataaggactggcctgaagtcactgtgaaatggcatcctgtggggtggggcgagtcaagcagagttgagcaaaaatgaactgaaggaggtggttagtgatgaaaacctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggagcccagccttcactctgccctggtactttgtgtgtgctgttggaggctctccccaaaagcacagaatttagtcagtgtcgtacagggaagaaaatcgggattctgacggcaagaacttgctgtgtgatcttaggcaagtttctccctctggaactccaattgtcaaggggccagatgaggaggtcgtatcatctccctctgaatgtcctcactcacctattttcttgctttgggttggggagagaagacaaagttgctaggtaattttagggtggtgtcttgtttttatttctctactccaaatatttcatgtgagaaggaaagaggagagacggtaaattagggcactgtggattcccccatgacaaggtttttattaagtgtacagtaatgagagaagctgttaatcgtcaattatattgagggcagaacagaaagatgctattgtccgtatctcggtgtacaaggggaacatgtcatttgtattgattttacaaagctcgtaattgaaattcgttaagggctgatttttttctctggggggcgggggcgggtagggagttgggcagcgccagtgccctgggtctggggtggcctagtcagcggcgctcagggtcagggacagggggctggggaagccgcggctggagtagctttctccgtattgtggctgttcacatgtcattatcacattatctttttaactctggaggggggctaattaagtgaagtaaatgaaatcagtggggaggagaaggggggcaaggcatgccggagggaagctgagggaggccgggaaggagccagcgcatgtccttgtgctcagcctctttctctgtctcctctctggccccagacttctcccgccgctctcccctctccgctctcctcccagccctgcccgtctcacctctgcctgcccccgccttgctcctcctccttgccttcctttcctcctccctctctccctttcctcctccctctctccctttcctcctccttcccctcttccctcccttgcccttccctctttgcacatcctcctccccattccccactctcccctcctgtctcccttcctccttactcctccactttctggcccagaaggaacaagggctgtcacccacttgcccaacgtgcccacccaccatctggaacattccagatggagaatggagggagacctgtgaagcaaaaaggttttcagccccagaggcccacccaggatggggcccgccaggcaccaggagcatagaggatggctagagtcccaccctgaccggcctcccatcaccatggcaactgcttctcaccttggccctggtacctaagaggggagcccttgggctccagccaacccctatgccccacctcttccaaatcacttcttctactttcccaaaggaccagagcctttagtccaggtgccctcacctccagcccaggccccagctgagctggcggatcccactcaattctgcaaaattgctcattccgcctaacctggcagcctcagggacagacgagaagaatttgggccacagtagctgtttggttcccacctctttctgcttggtccactctccccccagccacccctggccacccctagatccttgcccgtctccccactccccgctgcacctttcttggcagtaattatggtgtgattgaagctgctccacagagaactgctgacacctctgtctttttcctgtaaacacggggagatgaaaatagacacttggagctgctgtgtgtgtcactccaaagatgtccgttgtctcttccacggcaacacagaggctcagctgtcatttcctccttctctctgcgcagtggtttgtatgccgactgtcaaaagccccaaattcatagtcttttagcatcaggtttctgtcactgttttttttttccagaagaaacacacagaaatcatctgtaccccctacccctgtggagaggagagggaagagctttaaacgcacacacacacacacacacacacacacacgtgcgcgcgcgcgcgtcggcagcaacctaaaaacaagttttttgatccgtcacaattaacactttcgaagaaaaggagcaggaatattaattgcactggtgtgttttgtggctgcagcctttccccttgcccgtgagccctccggaggctgcctgggagggtggcagccaggaagccggtgctgggggctcaggaagaggagggttctgcctggcctctgcccaccagacattctctgctcccggtggcactggcctcattttcctggggacacctgtgatgggccagtagctggaggaccttggacaagtcacagctcttcctcgagccctgaaccccacctgcgccctcccctctctggactgatgggaggcgatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtaatttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactgctgaaccattcccctttctggtggcttttttggcgctgtcatgtttgtgtgcggtcatcatgttttgttttgtttctctttcagacagggtcttgttctgtcaccgaggctgtagtgcagtggtacgatcatgactcactgcagcctcaacctcctgggctccagcaatcctcccacctagcatacaccaccacacccagctaatttaccatttttttgtagagacggggtctccctatattgcctgggttggtcttgaactcctgggctgaaacgatcctcccaccttggcgtagtagctaggaccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctgctctgcagaaaatgatgacagacccatttgaactgttttacaagagtcacggtgaggcctgaggaactcccgagggatttgagggcttggatctctgcataaacttggagagaggccgtttcctaatcagaggtcacaactagattcagacggtggacgtgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccaggcctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggttttttttttttttaatttaaaactgtggtaaaatacatgtaacataaaatgaaccattttaaaatgcgtaagcgtgccgctcaacggcattaggtcctttcccagggctgtgccactgtgactaccgtccacctccagaacattttctttttgcaaagctgagactctggccccatgaaacactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttcctttttttttttttagacagagtcttgctttgtcacccaggctggagtgcagtggtgtgaaatcagctcactgcaacctctgcctcccaggctccagtgatcctcctgcctcagcctcccaagtagctggggctacaggcatgtaccaccatgcccggctaaatttttttgttatttttagtagagacggggtttcaccatgttggccaggctggtcttgaactcctgacctgaggtgatccacctgcctcggcctcccaaagtgctagaattattacagtcatgagccactgtgcccggcccccttccttcttaaggctgaataatattccatcgtatggatggactgcattttgcttcttcactcatccctcgatggacacctgggttgcttccgcctcttggctattgtgattaatgctgctatgaacatgagtgtacaaatcctttctgggtttttttcaagcagccactgtagaaagatgttagtaaattcccaggataactgagaacctgcccttttagtgatgtaacgtatggtggaagaaaggaagctctcggggtagaatccatggagatgggggagctatggcccctgctccacccagacagcagctgcagggcaggcttgcccaagggccagctctgaagttgatgcgagaggtcgcactcctggggcaagagggggcctgggctgtgtgctgtgggcggtcctgcctcttggtgccccactgtcctccaatgcagtaggaccttcccccagacccagctcagcccaagaccaggcatttctgtctcactcggagatcatctgttccaagcaggttgttttccaaatggagggactgggcctgaggtcacaagaggggacttgagcaatcccttctcccctgaccttccagggttgggcctccacggccaggtgacttacagggcagcagacagcactggtgagggactcgggggcctacattcagttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattttttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgagggagcaaggggatgctagaacctgccttgccatggggtgtgtccagggagatgcaccggcttcccaaggtgtccggcagcttccaccccctacagtttgcatgactgcagcaatgccaggcactgggcactgtgcggcgacatgcatcaccccgcatggtcctcacaactttcccaggaggtctgcagctccttgtacacgaggaaactgaggctcagaaggaaagcataaaaccagaagtggcctagctgggtttgacccccaagtcaggctgtctccaggaagaacctggacctactccatgaacttgagggagaggctccctggaccaggaactcagccccagaccccagtaccgcaggagccagatcttgaccatgaaaccactggggtggccacagggcctgagccctgtcacacacccagcccatgtgtggaaggaccggtgggtgacagcacctgaggcgggggtgtccccgttttgcaggtgaggagcccgggtttccatgccttggaatccaggcctcctgactccaaaatccaaccctcatgtggtgtaacagaggtccccaaactacagtccctgggtcaaatccagcccgtcacctgtttttgttcagctcatgagctaagaatagtttttacatttttattttatttatttatttatttatttatttgggacggactttcgctcttgttgcccaggctggagtgcaatggtgcgatcttggctcactgcaacctccgcctccctggttcaagcgattctcctgcctgagcctgctgagtgactgggattacaggcatgcgccaccatgcctggctagtttttgtatttttagtagagatggggtttcaccatgttggccaggctggtctcgaactcctgatctcaggtgatccgcccgtcttggcctcccaaagtgctaggattacaggcatgagccactctgtctggccagtttttacatttttaaatggttgggaggaaaaaaaattttttaatgctatttcatgacaaattatataaaattcaagtgttgccgggcacggtggctcacgccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggctaagctctcctcccctcgcctctccccctccactcccagattttgtttccttttaagcctcctaatcactgtaactcatctcaggatttcgagagggctcgatggttattggctggcgttatttctccctgccattgttccttgcagctttgaagccaagtttctgcccccgttcccagggacagacaggtgcttaaataccattgtctcctgcaggctttccagcccggcgggattgcgaccccgaaaggaggattttagttacaaagtgagagagtcattaagacgtggcggaggagagagcacctggccgggctgctccggggcctccacggaggctgatcccaccgtggccgcggccacggctgccacttatcctgccatcttgctgctaggctctgagctgggcacctgatggggtattatctaatattagctgcgcagaggtgaggaaacggaggcccccaggtgaagacactcacccaggctctcctggctggtgatgggcagctttgagccggggacaggccagctgtagcggccaagttcccagttactccaacagattccaggatgctcgtgatcaaggggcacggcggcacagacaggggaaccctgggtgtagggcacagtttggctcctggctgcggtcacgatgcctctacactggactggctgggttgagtccctgctctgacagccagcgacaagccctctacatcccaaactgaggtacaatgattaggagacttaaaaggaaacaaaatctcagagtggaggcgagggagagtaggggcttcttctgggtagttatcactaatattaactttgccctggtccgctgacatgcagggccccacaaacatcaagatcggcctcgggcagcaggctgacccccacagctcagagggcctgtttgatgcgattttccccatgagggatacagacatggtatagaccagggctttgcttgatcatgttacttaacttccctaggcctcagttttcccatctgaagagtgggaataacagttctacctgtctggtgggtgaggactaaaagtatgagtatttgtaaagcacctggaacaatgtctggcagacgagtgcttattccagtgcgtgaaataactgcgagcgcccggcgtggtttcccagtgtggaggcgcggcacttggagtcttgcctctggctgggttaatggtcttgagcagggctgtctcttccttgagcctcagtttcccctcctgtcaaataaagggcaccaggctgagggcacgccagggtctcttcccagtcccgtctagctcctgggtggaaagcccaccattctgctgtaatgcttggcttcctcagagcccttgtggtctcggcacagatagggagactgaggcacagggaagccctcctgccccagcctcactcctagaggccctaggttctgtgaccactgccactctgcatctgtgtgtctgtgtgtggctggctggctccctctcctctcccaccattcccaaatttcctggtctggctgtgtgagcttcaggcagactgtctccaggagtggcaaccagggttagcctggcaggaccccagcttcaggaccctggcagggcccagaggagcatctcatctagggggtatagctcacttcttctcccctcacctccatttcttcagcaataaaatgggtataatgtgcaactcacacagaattgctccagttagaaaggatcgcatgtgtttggctgggcctagcagcacgggggaggggtccctctccagctcagccctaagccccacccacagtgatctgcaggtctggggggtgcagggtctcccccattgcagcttatgccaggctcactggcccccaacccaggctgggtccgctgggaaaagaaatctgagcagaagaaccctgtggggcagaggtagaaaattctgagataaagcccaggccagttgctcccacagagatctctgtcctatctctggctccatctcctgcctgtcttccggcctggaaacttaatgggctaattatcccagctccgtcagaaagatggccaagcccaggacaccagggcatggggggctgggagaacatcagtggccccctccacgagggtctcggggtgtgttggaaaaagccctgggccagagttaggagtgcttcatcagacctgggctcttccaaagtcttgctgtgtggccttggacaggctctttccctctctgggcctctctccctgtgtacagtgagggctggcacagagcatcatgttcaaactgcaaatgcaaaacgctttgcgctctgtgcattccctcactgcatccacacaacctctggttagcaatgttttctcactgtgcaaatgaggaaaccgaggcacagggaggttaatcacttgtccaggtgtggctgggatgcggactcacagggtgggacactggagagcaaggactcaacctctactctccgtgcttggccctcccccgcctctgcaagccccaggaccccatcccagaagcctgtcccctttcccacggaggacctctgcaggtgcccccaggggcctgggcctcccacaatagccgcagcccctgggctgacccagccctttatcagggcaggagatcatgcgccatctggccctgcagctgcccaggtgggctcaccttccaggctccatttcaggaaactctagccttgccctgtccctccccccgccatggcctgcctgcctgcctgcctgcctgccccttggtcccagcctccatcagcagaggctagagagaggccgggggcagactggggtctgagcgctacccctccctggcctttagggctctcggggagaggggagggagcatgtttctcaggcacctcctgcccccacctacacaccaagggatgttctggccatagagaaagctccaagtttatcataggaagcagagttgttacaacttgggccaacacaagtcaaatggaggctccccacttccggcctgtgtgatcctggagaagtttcttaacttctctgagcctcccttcctcacccagaaaggggagaggctaagagagtttctctcagagtgctgtctatgaggattcagggagctagcccagatcaaagcctgagcgcagtgctgcttatctatgcagaaatattctatctgcccaggaaaacagcagcaggtgcagaaaacagctcactgattccaaggggtgggctctggccaggactccagttcacagtagcccctaaggctggtgctgctcagtgctaggggctccacatgaaatattactgtgacatccccactcaacagatggggaaacagaggcacagagaggggaaggctatgcatggccatggtctgaaccaccacccagctgcctgcactggacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatggcatgaagcagtgggtcacttccctcctcctgacccttagggaaatgacctaggtggtcacctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgggcacagagcctatcttttgactggatcctcaagacatctgtgcctgagcacatgtcaggcaccatgcagagcacagagtgatggtcacagaggatatagacaccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatatacacatacatatacacacacacacacacacacacacacacacacacatatatatataaaataattggggttgtgaagaagctcctttgctattcaaacaatagcagaaggagttaacaggtgaatggggggaggggtggaagggcaaaagtggccagggggaaggagctgaagctagatcttaaagggaagggcaagatcagatctgtgcatttagagggtcctcctggctgctctggagaacggatttgagtaggtgggaggtggaagggcacctgtggaaatgcggtagcttggaccatgctgatgattcctggactagatagcagcaggcgaatgtgacacatatctaggaggagggattgaaatgacttggatgtggagggagatggagggtccagaatcaccctggtgtctggggtcgtgagcagctgggtgcagtccctgggttgaggaaatgctcttgaggaaggatcatgcatttggatttaggtgtcatgagtatgggtttcttttgagatagctgggaaaaactaactggaaggccgccggacacttgggtctagagttgaggagaacccaggctgaagaccctggagcatcataggcattttgatgttctctgaagcgctgggccaagagagactgcctaggggaaagtgtggagtgagacaagaagggaactagccaggcaagatggtgcacacctgtaatcccaactctttgggaggccaaggcaggaggatcgcttgaggccaggagttcaagaccagcctgggcaacatagtgagacctcatctctactaaaaataaaaaaattagctaagcgtggtggcatgtgctcgtggtcccaactacttgggaggctgaggtgggagcgtctcttgagtctgtgagatcaagggcgcattgagccatgatcatgccactgcactccagcctgggcaacacagcaaaaccctgtctcaaaaaataaatacataaagtattagccaggtgtggtggcatgcacctgtagtcccagctactcaggaggctgaggcaggaggatcacttgagcccaggagctggaggctgcagtgagccaggattgcaccgctgcactctaaccttagtaacaaagctaggcactgtctctttaaaaaaaaaaaaaaaaaaaaaaaaggaaacacaactggaaccatgagatttctcattgatggaccaggcagaaggtggccaaggaggagcccctggaggggcaggagggccctggtgagccagggcaaaggtggcaggtaacgattggccactcctgtgtccgccccgtggatgagagtgacctgcaccaagggacgaggtgtcacctccagaggtcacctggccaaactagagatggggcaggcccctgtgggacagacagcccccactagacgtgggtcccctaaggcccagcttagctcaggctaaggccagcccctccctcctggaggctggttgggaattaaagtacgagtcttgtttggcagtcaatattatttttttctttcccttctccttgccgtgttgagtttctccccgcttcaatctttctaaacactttataagccataaatacaactgagtcagtttagatcagttggggtaaatgtcaaattatcttctctctttctctctctggctctttcttccctccccctccaaatcaacagcctctaataatctgtccaacccttcattaagccttacagtctcactcagggagattaaatgaataaagtaaaaagggaaaggggaaaaaagagagaaaagcaggagcatttattctcactgtgtctccgaccatttcccttttctttttgatttctacatcgctgacttgaaagcccttgagtgacagcgtcacagggaccagcgaggaagccgtgagaggtagcagagctggaaatgccgcggctcagtaggtagaaagtaacgtaattatagagcaggtcagagccactcgaatgagcaaaaataaaagcacagaggttttctgtagaccgtcaggggaggtaaaaaaaaaaaaagaaaaaaatcattgtaaactctttttccacctccccgctcacttcaaaccacaattttaaaaagaggttttttagttcctgagaaacccctcttggaactcccagcagcctcgtgggacaagtttgtccctggatgtgggccctctttgcaggggctgccagggcagctgggaagttcccaccttggggaacgggatggggagagtttgttgtgacttgtgagagatggaggtgaagggacagatggacacagaggtggggggattctgtgtcctacgttctccctgggctgagtataggggccagtggggctgaggctcggtttctaaaacaaggtctgttgaagggatctgaggaggttggtggtctagtttggtctagctcttcctaagcactgactgcacagaaaggggtggccagcaaaagtctggtatctcctcctcttccagggaatgcaagctcctagtggcttcagtgcctgagccctggaggggccgtggaggtgtagaggagggaggaagggacatcaaggaggtacaggagcatgggagtgactctgcagagagttccacgcacccaccggcttcaaggcctggtgaaggtcagggcccgggtcctgaacaaatcactggggccaggcagatgcagagacctcatttgttcttgtaaaaagtccactgtctacaaagaaccagtcagagggccagcctcagggtctcaaagcagcagatcctcctgcctcccaacaccgacccccgctacccctacctcgagaaccttgagtcagctttgtcccaaggctggaattctgcagacaagggtctgattcagagcaggacatgacaagggaccccatcctctcagaggctcagaggctggccttgtggagtaggaggcatctgagtccacgtgccctaagtgcttagcacaaccataattaatgaaggcaatgggtgattgattgcttcggtctggcccctccctgtggacaccactcttgctcttccttccttggcacctggcccagcatctggcaggcagcaagggcttaataaatgcctgaacaaatgaatgagtgaatgaatactgttagtactagtgggtgctcaccatgtgccaggcaccagctacattatttcatgtggggccaaatgtgacactgagagctaaccaccatcacgcatttcacaagtgcaaggctgaggctccgagtgcaggaatactggcctgggctctctggtggcgggtggcggaaacaggacgcaaaccccagtcagctggctggagtgactgccatggttaggaaggttgggaggagcagctaagggtggagagccccaaagcagaaggctggtgagtctgagaggtggaaactgtagagaggtaaaatctgctctgctgagtacagcagcagtcaacccagcattttccatgacacactggcagtgggtgcccaggtttcaggatggattaggtaaggtctaactggttggacacatgaggggaaaggtgacttggtgggcccatctcgctgtgaatgctggaggcctccctgcagcttgcgaaatgcccttgtgctattgcaattcacaccccaaggcctcctgagccttcaggtcactgcatgccatccacacagtcccaagggcacagctggcttggacgagttacccatttacagacagagtgctctggttggtggaattcatagggctagttctggggtggctgctcctagcctcctgccacattgtgtagcagggaagaggctgctgtgtgctccactagggctctccaacctttgggtgggtgcctggcccagaacagggttccctgagttgtacagaaattcaatggaaagccgacgtgcagggagggtttggacccacacaggggaaatgccctggcatctgggaggtggggctgcttctggccccagcagtcctcccttcaagcagaggccagggccaggctgagctgacaagcttctactctccttgcagcatgaacgtgcagggtgattatgagccaactgatgccaccgggttcatcaacatcaattccctcaggtgagaagctcagggccctgacgggccttcagagcctccaggtgtaaagggtaggctttgagagcccccaggtgtaaagggtaggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggagggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagtaactttccaagggtcacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatgactctataaacccttttaaatggcccagaacaaacagggcttacatagtggcctcttcatttctcctattgccagttaaacgctttgtcttcaacaatgacaaacaatgttttccccctaagataaattaattacattatcctgattggagggcaggaggggccagggcgggagagggaatagaaaaaaaggcaacttcacacacatcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatccggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgcacagccctttctctggacatcacttttactcacagcccacagggagcttctatagagggtggccatgagtgaccctaggacacttaccacagctgcatggcctaaagcagcctaaatcatgaaggaggagggagaggcctgagcagagaggagaaaagagcaagcccggaacttggcagcatttctcattgtccacaaaccaggccctaaagcagccatgtttgtagtgtggccctggccccccttggtcatatctgattggaccgtggatggacacctgactcgagctggccaatcagaacccgcaggaattgggcctcggcacgtggccgaagtgaggacatgtaacacaggcactcaccgctgggatgctgtggacctggggcacagagcaggtgtagaaggaaaggagagggaagagatgggaagagagggtcatggtattggcgtccatatttctgtactggtgcttcatgaaagctggtggcatctcttggcctggtttccctgacacctgatatcataacgaattcaggactccagctcagtgagagagtttctgctccttgcaaccaaaagcatcttcactgggaagacttgagtgccgcttgctctgtgctttgccctggttctgaactcagaacctgacctcagggatcgcttcgccactccgctgcctgtgtccatgagggtttctcgcaaaagaagttttacctttaaaacttattttcctctgattattaatgtccgtggtaataataaatgactcaatattagctttgtgccaaacacttcgctacacactttattcacattatctcattgaatcttcaaaaccacacttggaggtggacactttcatctccataatgtagaggtagcaacgaagctgcagataaactgacttgccaaaagccactgagctagcaagtgacagaaccaagaaccaaatcccggcctggctgagtccccaaatcttgtgcgtttgtcttgttgttgttgttaagatggagtctcgctctgtcactcgggctggaatgcagtagcgcaatctcggctcactgcaacttccgcctcccaggttcaagcgattctcctgcctcagccttctgagtagctgggattacagacgcccaccaccacgcctggttaatttttgtatttttggtagagacggagtttcatcatgttggtcaggctggtctcgaactcctgatgtcaggtgattcacccacctccggcctcccagagtgctgggattacaggcgtgagccactgcacctggccattatgtctttaaccatagtgataagctgcatctttaagaaaagaaataactagccaggcacggaggctctcccctttaatcccaaaactttgggaggccgaggcgggtggatcacaaggctacgagttcaagaccagccagtttgagaccagcctggcctcggcctcccagagtgctgggattacaggcaggagccacgacgcccagccacatttggtatattatcagtcatatgtctttttcttttctttttttgttttttggctaaacatcctataatgcacatatattttttcctatgcttacaatatttttgcagttatttaggctaaagtataaatgctttatattttatagttataaatgtatactttatactttaaagtataaactttagc

SEQ ID NO: 15695 - DNA, 4438 bp, Human
tgctatctgtctctttgtattcatcttccggttcatccaatgtttgtgaaatgtttttctgtcaatttccttctcactgacataatgactagaaattgaaaacttctgatttttcaactatgttcactaaaagctaaaaataacctacaaagatggtttctctagttttctttcatacctacttgaaagacaatgcaatatttggggtgatataataaattaaaagatgaagcaatagttattactgtagcatccttctaggcaatcccattattcttattattttattcttttttttagcatagttgagaataaatgagttaataatgaatcaatttctaagatgacaaaacagcaaactatttcaagacacagaaacaaataagatcactaatactccataatgtatcttagatttacaaaatgcttcaatggacccatatgtaattacaagagagaatgaacttcattctattttaaaaataagtatattttgtctttgttttttggaagacccctaagaaagatttaagttaaaaagctatcaatcctatgaatagttagaactgttcaaaaaagaaactgaaattgggtcctgatgttatactgatggttaaaattctccacaaataattttaaacagctgtattatctatacactacctcattgagttaataaaaatattgctattttaagagacagtagtcaaaaggcaatgttattactacagagctgctaaggacacacggccaacgtgactgcctgggcaaatgcgttctcaaacttctcattttaattctgcggaaaggttcatcaaaatcatatggtatcacctagttcttattttaagaaaacatttcactaaaaaaaaattctttatatccagtaatataaacttttagctttcaccaacatgtatgtttaacttctttattaagtatatatatatcaacatgcggtttaagctttcaactccgaatactatttcctttttttttctttaccacctcaaataaattagaagttcgaaattcatcaaacaaaactaattctttatttgggcaatatgataacattaatacacagataactttgaattctagcaactgtaaaatctaaacttaaatgttatttaccgtatatttagtgaatttatttttccctaccttcacgggacattaaaataggaaaggaagttaggttcaaaggagaaatggggctttgtagtcatcgctgccacctgaagccacctgcctctagccatggtcaacgccactgtgttcttttgacatcattgttgatggtaactcctttggcccatgcagctccttcgagctgtttgccgacaaagttccaaaaacagtggaaaactttcgtgcactgagcactggaggaaaaggatttggttataagggttcctgctttcacagaattattccagggtttattttatctgccagagtgctgacttcacacaccataataatgccagtccatctaccaggagaaatttgatgatgagaacttcatcctgaagcacacaggtcctggcatcttgtccatggcaaatgctggcccgacacaaatggttcccagtttttcacctgtgtggccaagactgagtggctggatggcaagcacaaggtctttggcaaagtgagaagagggagtgaatatcatggaagccatggagtgctctgggtccgggaatggtgagactggcaagaagatcaccactgccaactgcggacaactctaatcaatctgcttgtgtttgatcttaaccaccaaatcattctttctgtagctcaggagagcatccctccatcccacttgctcacaatatcctgtaatctttgtggtctcactgcagttctttggtttccttattcccctcgacatcaagctggattgtagttaagtttaggattataaaataaaaactcagtaacaaaaacaaacaaaggagaaatgggagaaaattaagatttggggcctctcctctccggtccgtgcctccaagatgacaaagaaaagaaggaacaaaggtcgtgctgaaaagggccgcggccacgtgcaggctattcgctgcactaactgtgcccgatgcatgcccaaggacaaggccattaagaaattcgtcattcgaaacacagtggaggccgcagcagtcaggggcattctgaagcaagtgtcttcgatgcctatgtgcttcccaagctgtgtgtgaagctacattaccgtgtgagttgtgcaattcacagcaaagtagtcaggaatcgatctcgtgaagcccgcaaggaccgaacacccccaccccgatttagacctgcgggtgctgccccatgtctcccaccaaagcccatgtaaggagctgagttcttaaagactgaagacagactattctctggagaaaaataaaatggaaattgtacttaaaaaaaaaaaaaaaagatttggggcctctgaacaggtgagctgtagagaaatgttccaaaataattcagacatgtggtcacttacttagataaataagcaaagtcaccaacatgcaacactctattcctcatcagttccctagcttggtgtccttttcacacctagggtccatagtggcactagccatgatagtgagtgccagtgaaatatctttcggctagatgcaaagggccaagcaaagagcagtgaaagaagagatgcatggagaacaatgatgaaggagacagggctgcaggggcctgtggtgtggaaggaggcaaaagagaacggtatttctgaaaatatatttggtaaccaataaatctcggttataagccaaagcactaacatgtattctattttaaaaacactttaacaaaacaaaaaccttatgaagttgaaaattatcaactttctagctaaatgacactcatactcagatattttacaagacatagccaagcactttgacaacctgacaaagtgaaatttcagaagcaaaaatgaaaaactttactgaatatccccaagtgatctaggacttagattattccccttcatgttggatacgctggcaaatcaggtaagatgcaggccatgggacctgacgtcacttgagtgttggccacttggccagataagcaaaggtgacttttctttcttccttggcggcaggccgaggggagagaatatctgttaaaagttaaaaaagctttctcctcacatctataataaatactttcagaattaacatttttattgaaacacacatctagactaaattggaaaatacgagttttacttttaagtgggaacgctatctttaaacattatgtgaagaaatctgtgccgaaaatgcccactccataattgatttgcataaaggtcagattatggtacttagaatattcaatcggaacttcaccagtaaaaacaaaagcatggaaaacccccaaaacgtgacaagtaccttgtgtattaattacagctacacattttgataacgcttattgtataccaatccagaaacaagtgaaattacacgtgtactgtgagagctctcaacagcaaagacaactagaattctctcatatataatcaaatataacttgttaaggatttcactcaaaatgtgcaatagggaaacctggatatttgatattttcataccctgaagaaaataaaatgaaaattatcttaattagtttcaaaaattttgtttgttctgaattgacatcgatttctagaatcttttctggggtgattataatgtatctatagtaactaaaactagattagttattagttagcaacttaatttaggggcaatgcaggtttgtttcatattctgaacatattttcccccttcttaatttggcatctaaagttattacatgatctgcagtatgcattaaaacacatcagcacagatagggtgctatgcatgtgtgttagctatttgccctaaatgagaaaatccattctaggagtaatgagctagcacttaatccaaaggccagatggccaccttaaatgctttagctatcttaatctccaaaccaaaccagaagctttgttgttagtaaaatgagttttcacatgcactaagtggcctcattacttagtataatggatattagaaatcactagggtaacatgagtggcattaagccatggactgattagaaagagatatatattaacttcaaatagagccttaaaaaaagataaatacataaataaaaacaaagaaagatatatatagaccctccccaatccggggtcaagggaacaagtgttgagactccagcaagtccaggaggctgtattgttgggggtgctcctagagcttgatactaaatggctgtgtgcagccagtgatctggaagatgctggttgcctggtgcagaccatattctgtcactgatactgtcacatttgcctcagtaaatctttcag

SEQ ID NO: 15696 - DNA, 8796 bp, Human
accagcctggccaacatggtgaaccctcgtctctactaaaactacaaaaattagccgggcgtggtggcgggcgcctgtaatcccagctactcaggaggctgaggcaggagaacccgggaggcggaggttgcagtgagtggagatcgtgccagtgcgctccagcctgagcaacaagagcgaaactgtctcaaaaagaagaaaaagacacacacacacacacacacacacacacacacacacacacacacacacacacacacacacacgaagaagaagaaaagaaaccatttgcagggagcgcacggcttccgtctggtcctgaactggacgcaaacaggccgagcatttagaaacccgcgcagctccccgcaccgagaggcttcctctcgcctggctccttcgaagcgtggtctggaccagcacctcccacagcactgggggcgccttggaaacgcggccttggacctatttccgcgggggcaggcggcgatcggtggccctggtcctcgcaaggcccctcaccacccagaactgaatctctggcgggccctgctgtgcggtcagcagacgcccaggtgcaggggcggtggccggcgtcgcggtggagctcgttaaagtaccggcacgctggccgcgcccacgccacgggcgggaggggacggtgagtgcagggacccaggcgaccggccggccggcgtccccgcgcctcctggcggccagaagcagggcctgcgcttccccggctaaggggtgccggcccccgccccggcacctgggagtgaaggtaccagcgggtctcctgggcggtctcctggggccgctcgttccttcatcacccccaggggcagttggaccctgagcagccttagccaatagccccgggactacccttcccagaggattcagcggcagcacccgggtctcggaagggagacactaggacctggaggaggggagttttgcaatccctcgcagttcccctcctagccactaggtgacactagccataaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccaggttcgggttggtgggccttattcattttggcggggctatacgtattcactcttaagcctgtagaagatgaacgttgattgtaccttctaaaacgtgaggttatagttaagagaattgcgttgtcggtctgctcagcagagatgtaagtccagtcttgatttcctcaggcactacttgaggagttgggagagtgtaactaaaaggtcttataactaggacaagtgtttttgatgcaaaagtctttagtccgtaaacatatacagaaaacacccgaataaaacaaaaaataaaaagtttcgagcttcggttgataggcccttccgatcaaacagtttttgttgaagttgcacaacatgacactgcctatgatcattctagactatcaagataaaatcattgcggttatttgtttggaagctggatgagattttggtcatttaagagtctttttaactttttatttagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggtgtgtatccctacttgttctcgttgtcttgatggatattttacgcacttagcttagaagagggattgcattcctgagaaagatgcttctgagactcttgctcccaaagagtggcaagatgagttgagccagggaccaaaaaacagtaagtaagctgcttttcagtttttaattgtattatttggtgaaaatcttttttttttttttttgagatgaagtctcgctcttgtcccccccaggctggagtgcagtggtgccatctcagctcactgcaaccttcgcctcccgggttcaggcgattctcctgcctcagcctcccgagtagctgggattacaagcgcccgccaccacggctcggctaatttttgtgtttttagtagaggcggggtttcaccatgttgggcagggtggtctcgaactcatggcgtcaggtgatcagcccgcctcagcctcccaaagtgctgggattacaggcgtgagccaccgcgcccggctgagatggggtctcactcttacccagactggagtgcagttgcgtggtcatggctcttgtgggctcaagtgatgctcccatgtaggaccttttttttgtttctgtagagaggggtctcactttactgcccagattggtctccaactcctggggatcctgcccgaaaatcagtttcctcaaacgtcagatgatgtgaccataattaggtgacataatcagaacattgctttgggattaatccttttatcaatatattgtgactacccaacaggctcattttgcctgctgtccagatagagccgatttatctagacaggaattgcaatagagaaagagtttaattcatgcagagccagaacgagagaccagagttaactactcaaatcattctcccggaaaatttagggatgggagtttttttaaggataatttggcaggtagggggccagggagtggggcgtgttgacaggtcgtatcagagatgaaggcatagggagttgaagctgtcttcttgctctgagttggttcctggatgggggccacaagatcagatgagccagtttattgatctgggtggcaccagcggatccatcagtgcagggtctgaaaaaaaaaatcacacaaatcttaggctttacagtgtgttatccctaggagcaattggggaagcctctagctgcctaaactgtaatttctagtcttgcagctaatttgttagcctacaaaggcagtctggtacccaggcaagaagggggtttgtttcaggaaagcactgttagcatctttgtttcaaagttaacctgtagactaagttcctcccaaagttagtttggtctatgcccaggaatgaacaaggacatcttggaggttagaagcaagatgggagttaggtcagttctctttaactgctgtaattttctcactgttggcaatttttggaaaggaggtttcaatgtttggtcattgaagaggcagttgaggaccaataaacagaattgctcccaatctagattcaggagctgtaactgaagcacagtcacgttatcgtttgcacttacaggtaaataatttgttgcatctatttaggtgaaggtttctataaatgacccttaggtgtaatctgtagtgcagctagtgattaaagaattcaggcagtctctaaagccatttacatacacaccatcaatattttttcatgcctatttcaaaaagatgaaatgggttcccaaataagcagtgtgggttgagaacagccgttggtccctgctgcagtagtgctaaacttgccagtagaccttgaaaactgtcatctctgttttcaatacataccaatgcaagaaagtcacaaactgggaagaagaatctgttcagaaacacttgtcctcacaaactgaggaccactgggattcctgtccactaacctttgggaaagaattggtttgttccgttaagcatttgttgctgccctctgactagcactaggttgcacacattaatgggttcagatttaaatactcttggtctgttgctgcttttgagatggagtaacagattccttgttgtcaacttcttacaggttgccgaagtgggctcttttttttaaccttttaatataatgatagggtgaatggtgtatgcatgagtttgtttacttgatttacaaggttaatcttttattcaaatatttgttacttttgaatttgctcttaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtaggtgtttttgagaatgcttgagagaaggaaattatggcaattattgttgacatgattgtttacagagcaaggccatagaaatagtccttgattttacatgtgctggaaaaaaacattttaaagtaaatactactgcacttgtattgaaaattctaataccatttaaaatgtttctgacatcaaagtgttaacggtcattatgtttctgttagtttgtttttgagacagtcttgctctttcacccaggccggagtgcagtggcacaatctcggctcactgcagcctccacctcccaagtgcaagcgattctcccgcctcagcctcctgagtgtagctgtgactacatgcgtgcaccactacacccggctaatttttgtacttcttagtacaaagtttcaccatgttggccaggctggtcttgaactcctgacctcaggtgatttgcctgcctcagcctcctaaagtgctgggattacaggcatgagccaccatgcctgtcccattatgtatattgggcggaggttgcagtgagccgagatcgcaccattgcacttcagcctaggcaacgagtgaaaacgccatctcaaaaaaaaaaaaagaaaaaaaataaagaccttaactgatcttcccttacttctgacatctttttccattctatatgttctagtctgctcgcctcctagcaacttggtagaattataaattctaagagcccaggcctactgaggcaaaattagggcttatgacccaggtgtatgttttaataagccctccagttgattcttactcaagtttgagaaacacatctatgaaacttgataatctcctgcctttgaacctttcaacttgctgttctcttccagatacctgtgcatagatagattgctcaccactttaggactctgttcaaatgtagggctttgcttgatcactctagaaagcccctcggcctcctcacacttgccttcttactctatcaaagtgatgtagattcacttgtaaatgttttcgggctccctatactagaatatgagttcagtgactgtggagatttttgtttggtctgcatgctgtatttccagcacctcttttcaccctttcctcgcattcataagactaaaatttatcataatttggatgtcttttaggattggaactgttggagtaagatcgtattgtcatcttctcactaaagattttgcaggtggaattatgtgtggatgctacctttaatttctagcattaaaattctgaagttactttattatttttctgtttgggggtggggttttttttgttttggacagagttttgctcttgtcgcccagcctggaagtgcaatggtgcgatctcagctcactgcaacctctgcttcctgggttcaagcgattctcccgcagtagcctcctgagtaggcattcaccacaccctgctgttttgttacttgtttgttttttgagatggaatctcgattgatcgcccaggctggagtgcaataatagcaccatctcagctcactgcagcctccgccccccccagggttccagagattctcctgcctcagcctcccaggtagctgggattacaggcatgtgccaccatacccagctaatttttgtatttttagtagagaaggggtttcaccgtgttggccagactggtctcaaactcctgacctcaggtgatccgcctgcctctgcctcccaaagtgctgggattgggggcatgaaccaccgcacccagcctgaagttactttggaaacaaatatatttgtatatgacagcttgtaaaactgtagtgagaagagcagaatcatatatttctcagtgaaaaagaaacaaatcttataatgaagcacagaagaggctttaagaattactgataccatcttgccttttctcctttgttggtaggaaattagtaaataagccaggtttgatggctaaagagtgatttctggagttttttaaaagttaaaatcttttcttattaggcatccacctaccccaggtttgggaaatggtattgaatgttgggctttcccttgtgttttagtgattatttaaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagagcctgtgttttgtgtgtggtgatttaggacactccctagttttcagtggatcagtctcttacctctgatttgttggtctaaaatttttctgaaatcaggactgatgagattttttttatagtgggcagcagcatttgaggatatatcagaagctggaggggtgtcattgagaagaagaaggcctacaagaaaagctagttggaaacacttcctcttgaacctgtcttttaacttgcttactatggataggttgctatatggacaggctatattttttaccttactgcgtaaaagtttgtattgccattggataggaagtcttgctttcaataggataagaagcttctgtgactttatagcttctagatgacttcttcaagctgttcctccagattgagaggtctcgggttcaggttatctgatagacccatgggccccctttaccttgttttctgcacaagtgctggatgagtgccatcaaaccaaaacctaacacgtctttgagttaaaatataaactaaactgcagcttcgtcaggatgaagtgaaaaggtgtgaggtggcagcagtgtgtgtgctcctgccgttcctcattttaagcatctaaacaggacacctgaagcccgtttactttccaggctggagacttggcaacaacgtgggaatggggaacgggcccgagttaagtcactggcttagccaaggtcacagctggcatctgggtgaacagcgctgcacggtgtccgcggtgcctctagggggcggggcttccggctggcgctgaccggcttccggcggagcgggcgggaggtggggcggagttgctgctcgggggcctctgggtggagggggattcagacgccgcgtctggtgtgtccctttctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgctctaccttgctaataacgacctacctgtaagcgacatttttgacaaaatgtcctttaaacatcttttgtgctcagctctgtattcgtgggccctccaaagggggtacaggcaggtagaagcctccgtccctaccttataggttgtatatatctgaactggtcgactaaagatgcaaagcgaagtgctccagtgagtgtggtacaggttgttgagatgaaggagagatggcaatcagctgaagttactgaatacgtcaggaaggaggctggtttcagctggctgtgattgggaggatcaatgcgaggacattccgagtcggaaacagccaaggcgaagactcacaggtgggtgaagggagtaaacatggctttggaaatatttccagttttctctgaccaactcgtttatcacctagccgtcacatagatcacaccaagaagctgattgatttacggtcacatttctttcatgttgctttggaaaagatactgaagcctcgggcaacataatgagaccccgtctctacaaaaaaaaaaaaaaaagaaagaaaagaaaaaattagctgggtctggtgacgcatgcctgtagtcccagctacttgggaggctgcggtaggaggatgccttgaccctgggagccgtgatcatgccactgtactctagcctgggtgacaaagtgagaccctaccctctcaaaaaaaaaaaaatgaaagaaaaaagatattg

SEQ ID NO: 15697 - DNA, 9822 bp, Human
  misc_feature (1)...(9822): n = A,T,C or G
acagcaaatagcatttagaatgcattcagaaaggatattagctgaataataatcttctctattgttcatgtaagaaaagtgctaacgtaggcatgtagaggctcaacaatgtcatcaagtcctgaagttctttccaggcctctcttctgccttctgcaatgttaggcttcaatgtcaagctgcttccttcagtagcactagaagcagcaatgagggctgcatgcttccctgctcacttccagaaatctcttcctccataccttgccctatacatcttttcatctatatcatttgtaatacactttatgataaaccagtaaacgttaagtgtttccttgagctgcccagcattctgagcaagaaactgattcccactagctggcccacttaaatcacaggcttatgcctgatccaataaccataatctggaataaaaggtattgattagtataagttaattggggctcatttctggacctgcaatgaagtcagtttccttctcaaatcctcaaaactctaagtgctttcagaagtgggaataaagctgggcgcagtggctcacgcctgtaatccaagcactttgggagaccaaggcgggcggatcacctgaggccagcctgagcaatgtgatgaaaccccgtctctactaaaaatacaaaaattagccgggcgtggtcacatgcacctataatcctaggtactcgggaggctgagacaggagaatcagttgaaccctggaggaggaggttgtggtgagctgagattgtgccattgcactccagcctgggcaacacagcgaatcttcatctcaaaaaaaaaaaaaaaagtgagatttaaataggtcttcatcaacctagggatttggggttgtcagcaacagaaactactacagaaaccgactgcatagactggagagacaggtggtcccctaaaggaaaaatagagtgttagaagaaaggagaagagtgctggacagtacatacttaataaatatccactggttatttcatagaaggcccaaaaatgtatttatttaacccagtaatgaaatctgagggttaggaagagcagaaaagaaggaagtgtggcaggaaggaggaaaaatgaaagtgggcccaaacaacacggcagctaacagagatcttgcaacgaaaggtctattggtggaaaaactcctcccaggaatgtcagaacttttaagaacgacatagtaatgacacaagaataaacacacaggcaaatgagcaaacaacggaatacaaagtctagaaatagacacaagtaaatatgctaacattatatatcaagggcagcatttaaattctgttggggcagtttgtttaacaaatggtgttgacataactggcgctccatcgggcagagaagttagaccccagctcatacatgcataaggataaactccagttacattaaagatttaattttttttataaaaagaagaaggccgggcacggtggctcacgcctgtaatcccagcattttgggaagccgaggcgggtggatcacctgaggacaggagttcgagaccagattggccaacacagcgaaaacccgtctctaataaaaatacaaaaattagccaggcgtggtggcgggcgcttgtaatcccagctactcgggtggctgaggcacgagaatcgcttgaacccgggaggcagaggttgcagcaagcccagatagcaccattatactccagcctgagcgacagagagagacctgtctcaaaaaaggaaaaaaaaaaagaaaagaaaaagcaagataattcactgggggaatttggggaaactttcctaaactggaagccaagcgtgagcccttctcattccgcctcttccattgggttcccatgacttacgtcacaggacatcgagccaatgggaactaggcatgggcgacgagcttgcccaatggggccggggcgggagatttgaaaagtccttggccagggcgcggcgtggcagattcagttgtttgcgggcggccgggagagtagcagtgccttggaccccaggtgagctggcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccagctctcctccccctttctctctaaggatggcccagaaggagaactcctacccctggccctacggccgacagacggtaaggcccttccctccgtccctgcgcccccatgaccccgcatggcgagttcctgctgggaaacttgagatcctgcaatgagcaatcctttaagcactttcttccccgttatgctccaaagtacgggtcccaagtttgacgacagaacccgctctggtcatttgtagccacatcctgtcaggtgctgccaacgtgaatctgaccagccagtgactcccagctggtgaggacctctgcagggctcgtcacatacaaatgatatctgggactgagcaggcagggcctggccttcaggccatgattcccaacccatatcctgaaaaaaaaaaaactagacagcaaatagaaatagactctaaaaggatataaagttacagtttaaaaggcccagggcaagtctaaattacaatttggaattaatgactaaattgaggtaagaatctaaatggatctaaattgacttatttcccaatggtccagacagatttcattgaagggcctcctctctgatttgaaatgccacctttattatatatataaattcccacatatatgtgggtctatttctggactgtattttattcaacttgcttatttgtagattggtaccaatatcactatttggggcctaggggctttcttctcttggctgcagaagaaggaaggggccctgcacaggctttgctccctgtttttggagctcttgcttcctggagagtctgtctgttcccttgtacatcagctccctccctcatggagcactgagtgaggctgtcaggaatggagtctgaatgagaaaccattgtcacttttaccttagtcactcctaaaagaaaatgtacctattattttgagagttgaaagtgaggccaggtaggtggctcacgcctgtaatcccagcactgggaggctgaggcaggtggatcacctgaggtcaggagttcgagaccagcctggccaacatggtaaaaccccgtctctactaaaaatacaaaaattagccaggcatgtgcctgtaatcccacctactcaggaggccgaggcaggagaattgcctgaacctgggaggtggaggttgcagtgagccaagatggcaccattgcactccagcctgggtaatagagcgagactccatctcaaaaaaaaaaaaaaatgaagaagttgaaagtgagaagtggtccagggccatcagggtagctcttagtgtccttaaagcctgttcttgcaaaagtgtaaatcctggttattgctataacattcaaggcctcaagcatcttatctaagccttaataaactaagctttttaggagactttgagaatacctctgtgctaaaccccttgaattgtgggtgttcattgacgcagctctctactgtggtgtaagtgaggggctggatgaatgactgtgttgttatggacaggacttatacaggttgaacagcttcatgcctgaaaagtgtgggccagggccaaagaagtgaaatgttaggtgttggtgtgagtcctttgccccttatcttaggcctacttaggttatttattttttatttatttatttatttatttatttatttatttattttttgagacggagcctcactgtgttgcccaggctggagtgcaatggtgcgatctcagctcactgcaacctctgccgcccaggttcaagcgattctcctgcctcagcctcccgagtagctgggattacaggcgcctgccaccacacctggctaatttttttttttttttttgagatggagtctagctctgttgcccaggctggagtgcaatggtacgatctcggctcactgcaacctgtgcctcccaggttcaagcgattctcctgcctcagcctcctgagtagctgggattacaggagcgtgccaccacggccagctaatttttgtatttttagtagagatggggtttcactgtgttggccaggctggtctcaaactcctgaccttgtgatccgcctgcctcggccttccaaagtgctgggattacaagcatgagccaccacgcccagccgcacccagctaattttttatatttttagtagagatggcgtttcaccatgttggccaggctggtcttgaactcctgactgcgggagccactgcgcccagccctaggttgtttattaataacccattttaatatgggactatgagcagaggctgggaagcaaaactgtcacatcagtgtttctctttgaattgggggtaggtgggtgggtggctctttagcaaggggctgaaatactgcttgcagcacattccaccccggtcatcagacaaaggcaccctcagagctaccccctgctccttctcaggctccatctggcctgagcaccctgccccagcgagtcctccggaaagagcctgtcaccccatctgcacttgtcctcatgagccgctccaatgtccagcccacaggtaactggcgcaagggggagaggactgagctggggagatgaccgtctgtgggagggtttagggatgagaaggtcatccctgttcgcattcaacctacctgttctctccttagctgcccctggccagaaggtgatggagaatagcagtgggacacccgacatcttaacgtaagtgccccaagcctgggggtggacgggggtgaggggacaatgaacaggcaggaagtcggggagataaaacctaagcacgggaggagtagggatgaagacaagtggggcggaggacaggatgtgatgaggaagcagagagaaagcaaacctcttaataaccaaaaccggttctgagttgccttcctccactttctaagcaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcagtatgggttgatgccccctgagccgaagcccctctgctccctcacccccagctcctcattcagccccacttcatccagattgctttctctgtagctatggctagtgagccccatttagctcttagtcctggcaagccttgaatccagaaatctgcctccagtttccccttaccactcccagccctggtgtccccggcctgggccacgtctgaccccagtttgctcctatcatcttttccagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacggtccgggcgggtgggcacctggggcgccagtagggggctcgaggctgagggtgtgctgcttgtagctggaggtccatccttgtctgattgcctgtcgttgcccctcccagatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggtatggtggcctgggaggccagacctgggtgtgaggctgggccattaaaacctctccaggggccgtgcaccgtggctcacacctgtaatcccagcactttgggaggccgaggagggcggatcacctgaggtcaggagttcgagactagatttgccaacatgatgaaaccttgtctctactaaatatacaaaaattagccggccatggtggtggacgccagtaatcccagctactggggaggctgaggcaggagaattgtttgaacctgggaggcggaggttgcagtgagccgagattacgccattgcactccagcctgtgtgacagatcgagactgtctcaaaaaaaaaaaaaaaaaatggttagagtgtggtgctaataaccccaaggtcgcaggtttgatccctgtaggggccaatggtaaaactttggccaggcgcggtggctcacgcctaccagtcccagcactttgggaggccaaggcgggtggatcacttgaggccaggagttcaagaccagcggaccagcctggccaacatgatgaaaccccatctttactaaaaacacaaaatttattaagcagacatggtggtgcacacttgtaatcccagctgttcgggaggctgagacatgagaatcacttgaacccgggaggcagaggttgcagtgagccaagatcgccccactgcactccagcctggactctctcaaaaaaagcccggagcagtggccttttttcctcccacatcactttttaatggtttcatagtatcacatagtagctgatttatttaaccagaacatgcctgatgggcattagagatgtccccagtgaactccaaatgaacactgccctcatatcagggtatcttattaagatatatccttcagtgtggagttgctgggctgtgtgcaggctcacctctggggctttgggatatatcatcaccccaaccccacccccactccagtggccttgcctggctggacctctcccctggtacatcccgtggtcttttggctcccagccgtcaggcagcagggaaaggagagttcctatgtcactaggacccctgcccacgccccttatccctcccaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtgggagggcggcctgggcttcgtgccagctgctgaagccaggagctggggggctgggggtgggcagagtgtatttgcatggccctaagtaactccaaacagaatgggtagtcaaggaagatgtagccagggtgaaactaatgcagcccttccatctcttcacacctgcaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcatgagtgtagatgtttctaggtggaggctttgctgtggaggaagctgttccctagaaggagagctggctcaccatgaggagccgggatgagcattactttgctatccctggtaacaccctaccctctcagctctgacacccacctggtcagctcccagccaccccaacccctacccccacttccacctctaccctcactgtctattctttccgttgctcagactcccacagcccaggggcactgggggccctggctccccattgctacattggaacaccagccatctctggccaccttctttcacctctctcttggttgtccaacttctagtttttccttttctgtttcattctctgcccctttgccaacgtaggagcaactaaacagttctgtaccctagaagctgtctttgattatttcactgctctggtcaggatctagtacaggagccaatagaagcagcagtgattctgtcttgttcctgacatgaggttacactgttatgcatgatgcttgctgtaggtttttgatagataccctttatcaggttaaacagggcctattctactcatagtttactcagagtctttaaaaaaaaaacaaaaacaaaaaaacagttaagtctgggcgcagtgactcatgcctgtaatccctgcactttcagaggccgaggcaggcagatcacaaagtcaggagatcgagaccatcctggccaacatggtgaaatcccatctctactaaaaatacaaaaattagctgagcgtggtggtgcacacctgtagtcccagctactcaggaagctgaggcaggagaatcggttgaacccgggaggtggaggctgcagcaagaccagatcgcaccaatgcactccagccggctacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15698 - DNA, 145812 bp, Human
  misc_feature (1)...(145812): n = A,T,C or G
tctaaaacaagcattttcttcccctcacaaaatatcacatttccatttccacagttgtgatgcttttcatttacccatgacgttaagctcatctttagctcttcttcattatgtgggtctgtgttctagcttttacctcagtagcagtttttgtttgcaggaaaaaaggaactcttttggtagtcactgtttgtaattgcggccttgatattctaagccattgagtcacaattaataattagaaattcttactaactttgcccatatattacctatgaagcagtagccgtaggaatgcaattttcctgtaaatccctccctcttatacagctctagttcattatttaaaagattcagggtgaattcaagtaatttcctatgctgctatcatttgcttaaagaccttttgcaatgggtcttatgtaagaagaaatgcaggagttgctttggtgaggtttatttaaagaaaccattaagtgcaagacagacctgaagagcagcatcagttgtgtatggggaaacaggagctatgaatgcgtcacttcatttaggttgacagaaagagggctaatacttgaaaaaaatccctacacgatctggtgccaggctacttctttggcctcacctcttaccactgccccctccttccgtgtcctccagccacagtgacctctttcctgatccttgaacttgccaaacactttcccttctcaaggtctttgccttcaggagtccctctgcctgaaattcttttcccagatagtcatgggactggttcattctcatccttcagatctctgctcaaatgtcacttattctaggaaatcgttcctggccaccgtaaaatagcacaccccctcctcactttctactccttttctttgttattatgtatatggcagcagaaaactatgcattttcttagtggcaattacacaccccgcacattatgcatttaaagcgttgtttgttgttttgtcgcttccatcagaatacaatccagtagggcaaggagtgtgtggggtcgtgttcacctggtatctctggggacctacagcccggcacctagtagacactcagtaaatatttgaatgaatgaatgaggccctttggcagccgggaagcccgtcacagccgttgtctccaccctctcccgggctacaccaggccacgccggtaaagttgtttctcctctaggagaaacattcgctaggccttgttgccaacccgcaggcggctgggcgcttcatcccaccctcacccctttccagccaaggtggctgatgggagtcaggctctcgagggcgcattgccacgaaacagcgtgtgtgagcgcgttgtccccggcccccggcgccacttcccctcggcctagcagcctggactggggaaggacgggtctgctgtacccgggaggtggaaggaaaagccgaaagcggagaagtgtgcgggaggggagtctccgcgcggaggcagcccggcctcctccagtgcaggctgcgcgctggggagccagccagggtgagtcactcccggccgcttccctggagggcggcggccacacacacacccgcccatctagtgagggccgggcccagcgctggcgcctagctccagccgggcaccagcgtttcgcgaggcgccgccgccttaacttccttgcgcgctcacgcccaggggccgtcccaggaatctccacgcgcgctcgccggcttcccgagaggcagctgccctgcgtggcccgcgcctgccggtcccgcgaccagcaccgagcggcgcacgcgcactgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtgtggccccggagagggtggagacaactgtgacgggcttcccggctgcccgaagtgggagtggtgtggggctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgtcccggggcttcgcagaccttgacccgccgggtaggagccgcccctgcgggctcgagggcgcgctctggtcgcccgatctgtgtagccggtgggtgttatctctgcctggcttctgggtggggggcagcagctgtctctccacccccttcctaccttttggtcccgcctgccccctgctagtggcagcaaacttctgagccagaaaaatcttcctctttaagacgacacctagaacgagtcttgctggtgatatttgcttccatttgtgtcttataattccctcgctcccgcctccttattcctttttaaaattttctagacacttaaacagcctagaaaaagcatttgtttcccctggatttatgtggtagtagttaactgctgcttctgtttttaggtttcagaagcaggcaacaggaacaagatgtgaactgtttctcttctgcagaaaaagaggctcttcctcctcctcccgcgacggtgggtgtgctgtcctttatcgctgcagtaaaggcgaaggtgtctggagctgggagtgcgtgcgtagggaaggttggaagcgtgtgaagagaggcagggctcattgttgcttactcttctgaaaatgtcagtgctaaacttttaatgttgatctgggagagtaattttggggtgttttgttgttcgtcttggatcctttaagaaacatttttttgttggctttacacataacgtgactttgcagagaaacgaaaaacgttgtccattaccctttcttcttaagcagccagagattcttaatcctttaaagaggagtatttccaagcaataagagatagcttttgggagaacacgttagctattcttgctggggtttctgctaccacattgaatgtttcctcatggttttatctgcctaagcttgctgtgtcggttgaatttacccagtttgttttccagtaattactaatctgttaggagaaactccatttctctgaatgaaagggtaggagcggctgagtatggagaaggaaactggaagtgggaataagggaaatgattgcttttggtttcataataagtttgtacagtgagttgttgggctactgcaaataaagattttgtatcccttctccagaatgcttgggaccaaaagtgttttggattttttttaaaaattttggaatgtttgcatatacaaaatcagacatcttgaggatgggacccaagtgtaaatacgaaattcgtttgtttcatatagaccttattcacacagccactaagtcatttgcaatatttttaatacgtctgtgcatgaaacaaagtttgtattaagtacctatgcggggaattttccccttgtagcatcatgttggtgctcaaaatgtttcagattttgcagcttttcagataagggatgatcagcttgtattttgatataacacccagaacatttgaagatgaataatcaatttttggcctcccttcccccatccgcctcaccttataccactttaagtgtgagaattatttgcttgtacatgcatttgtctgttggtgtgtaacgtatgtacagactggatgtatccagcacttgccttaatagtacatgtatttacctgaataggaaagctgcagtacttgctggccagaagagcacaccatgcttgtttttgctctaactgaatatcctgtatttgcaatttatagcagttttagggactcattagggaattttgtgtgtgtgtgcctttggtgatttgagacaggtgtctcagatatgggaagggaatatgacattgtttctctttcacctggctattactgaaaggtgggatgcttttgaggcagaataggaaagtgcattggctttggagtgagatctggatttgaatcctggtgttcttgccacttaagagttgcattatttacggctggtcatggtggctcacgcctgtaatcccagcactttgggaggctgaggaaggaggatcacttgaggtgaggagcttgagaccagcctggccaacatggtgaaaccccatctctactaaaaatacaaaaattagccgggcgtggtggtgcacacctgtaatcccagctactcgggagggtgaggcaggagaattgcttgaacctgggaagtggtggttgcagtgagccgagatctccactccaggctgggcactgcactccaggctgggcaacacagcaagactctgtctaaaaaaaaaaaaaaaagaaagaaaaaaagagttatattatttacgactcttttagcttcactttcttataagattgttgtgagaagtgagtaagacacatgcaaagtggtaaactgcctggctgtcataaaagtcttggctactatcacggctgggaggcaaaggagattcagagaagggcagaatgactgcataaggtgatctgcctgtaactcgtgtttcttcctttctagtataaagagataaaggacttcaaggtcttaaactggtgagggagtattacagcctttgtatggaaaggtttgactttgtgtctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctccgataaaaagcaactactacatgaaaatgaatgtagaacaggaaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaatatgtttataacttctgcccagttctttcattttaaaactaatcctattgctaacttgttgtactagtcacttcctggtttttcctgtactggtcttctgcttctacttctgttcatctccttaaactccgaatgccccaagtgaaagttaccattttctaccccttaattttcttctaatcatgtaggctttaaattaggcatcatctttaaactacttctttcatttacctcttattcccattcaaaatgtccatatttcctttctttctcatatctctgctttccctcctttactgtgtgaatcccaggacacatttcctgagcctagaatattgaaagtcatttgaacttctgagaattcagtgtcccttccttctgtttatcctcaatagagattccactctaatactccttattatagcattcccttgccccaaaaccttcagtggcttaccattttctacttattaaattttcctgacttttaagatagtctattatcaatccctgccctatttatttagtcttttgtctaaggatctctagtccttaagcttgtaagctgatttccacactttctaataataagctatgcttcttctatcctttaatttttgcccatgttctccatccctcttttttttcctctatttctgtagctctttagtcttagaacattttcacatggtttaattatatgccatgctttagttgtttgatagttatttccctagtgttagccatatcttttcaagttgattgtgtattctttgaggagcagtaccttagattaaaaaaaaaccacaacacacagtggagagcacatgggcagcattcaagaaatacatgttgattgtgtgataaggaactgtagtcaccaaacaaatatttgttaatacttgcaatgtaaaaggtacttggctgtattcaaaagagaaataaagaaatataaaataggctcctttccctaaggacttacagtataattgggcagataagctaaataataaaagttacagatatttaagaccacttgagttgagcagagattttgcataataggaaggaactggtagagggggtaagcaaaggcaaaatatgtatatatgtatgatatgttcagagagcagtacataaataacttgactgaaatgaagatttgtgtgaaagagtagtaagaaattgtgttaaaaatgtagttggaatttgattatggatgtctttaaatgctaggatgagaagaatgtactttgacctgtagatatggagaagctttaaaagttttgaattgagaaagagtttgctgaaataagtattttaggaaaatcaaagcagcaccagtgctaggtctcatatgaattggaaagagaatggtagaaagaggtaggaaaataattgagccctgaagtaatgaggacttagaaataagtcagattgcagagatgtcacaagacattattatggattggataagaagggagaatggaggggagaagagtgattaaagattaccttaccttgaaggtttgcttttcagtgacggaggaaatcaaagagtgttgactctccaagacatcttagaacatctaagtctatatgttttgtatattaggactcagaccagagagatttaaaaatgtgtccaaagttactcagctagttaatgacaaagaaactgccgtttgattaatggcagttactaacaaaaatagttatggcagtgttagtagctggtagaggggatgtagacagttgagcgtatattgtggatatgttgagtttgcggtggccgtgggatgggcaagtgaaaattgatagcatacagtgggacatatgactagaatttgttagcgaagttaaggctggtgctgtggtacttaagagaaaagagtgggattgcccataattagcgggtgggtgaaaggagaggaatgggtaaaggagacaaagaaaaaaacagtatgagaggcaaattagtggataggttaggaggcggaatgatcaacatgttgatcattggcaagaaatgagaagaatcagatccaaaaaaaggtcttaaaaagatgtattcgtgtttttcctaataagaaatctataaaaacagaagaaaattgcttatactttccctacgtggaaataaccactgttaatattttgttctctccggtttaacaaaagacctttggatttgacagttgggtgatcagtggagacttttccaaagctctccatcactaggactaaggatgagaattttaggcataataaaacctaggagatatttttcaacagattgtcattcgtctgtatcgtcttatatatcacactgtccaggtactattcttcctgtgtgcattggttctgtgtttttttctgaatgatagaaggttagacaagccatctctgggtgcttttgtgctggtaaaatttgaataaagtgataaaatatttgtttctaaaaggaaggagaaattcttggtcgataacttataaatctgagggttgaatgattgatgaaattaggggtactggaaagaacaaagagaagcattatttattttgaagcttttctgtatagttacaaagggttaactaggttagaatggtccatgggctgtttactttgcttgcatgtttattttgatcttcccaagaacattcttctgttcatctttttagtatgttattggaaacagagtactcattagttcttactaagtggttttagtttaataaattatgattatgaaataaaatgctattaggtaatatttttataatataaagggccatgtgatgtgagtaagtgcactgttttggaaatcaggggataagggactgaccctgctctcagcatggtatatgatttcaggcaactcacgtaatcagtgagtcttgtctattgagggaatggactaaatcttttctagaaaatttaaaaaggtgggatcacatggtaaaatgtgtataaagtttaaaaaggaaatggtttaccaatgtttatgacaaaaaccagcaaactctttcccacccccccaccccacatctccttttctagtctctaattcctgtacaccaggcaaccacctgtcctctgtactttgccgttttcacctttataatgaatgaattgtttagcatcccctctaaagcctctccattcagttgtgtagaagagctcatcccctttgccttcaagggctttaccattatatttctctcctctttttcttgccttctcaattcttccctctactggattatttccatcagcattactctgattgctattgctgtgtaacagaaactacccaaaacttagtgatttaaaacaactactttattaggctcacagataccatgggtcagtaattgagacagggcacaccagggatgactttgtttttgctccacaatggctactaggacatgagttgggaagaattgccagccaggggtgacttgaaggcaaaggactggaatcatctggaggtgtcttcactcacatgatgggtagttgatgctggctcttgactgggatgttagctgggctgttaactggagcatgtacatgtggcctggatttcctcacaatatggtggcttcagggtggtcacctttcatagtggtgagtagagaattaaaagtgagtgtgtctcagcataaatcttttatgatttagccttggtagctgcacagtataacttctgccatgtcctactggttgtaagggtcagaagcctgtccagatttgatgggggagtggcaagttcacactgcagaagaaaaacatgtgagatgggaaatagtgttatggccatctttggacaattattaatactattgccatagtttgccattttgccaaacttcacatccctcctgtatctgaaatacacgcaaaatacactgagcttctcctcaaaggtccctaattcacatcccatcatgacagtaactcagagtccagtatctcatcatataaatcaggtccaggtacagaatagttttcttgggtatggttaattggatatggttcttcttgaactgaggacccatgaagagacagtttatatgtcccctgcatactttacaaaatggaaaaggcacaggttatctgcagtagacattcctcctcaagaagcatgcaaggtaggcacagtctgtagcaattctgcaacctcactgggcacatgttgccagttccttgattaggtctcagtcctgcttcctggaagtcattcttaataggacataggcttcttctgtttttgggtttaccttctgaattatttatctcccccacccctgcacccaacccatataaattgctttgtatttgtaagagtagctttctgagcttgcttcctgcctgtagtgctccagagtccaaaggcccccttttatatagcaactgtccctttcattccaagctaatacaactcctttaaaaactttgtggacttcctgtgtgtaagtttataatctgtactgccatacccacaaatctcttttgagaggaactctttcctcccctaagctctgtgtgagtctgctgtgggacaacacccttaagatccttagataatatttcgtctgaaaggatctatgaggtactgatttagatcttaagaaaggatcttataatcacactctagattggatctttgctctgaggccctttttatttgacactttgctggctgaaaagattgttctgagtccattacatctccttgaaattctactcaaaaaatgaatagcttattctttagttcatctctctgttctctcaattataagggcagctagaagaagccaaattgctttaacttcctgctgagaatctccttaattcattaggtcaggtatgtattttattttccatgttaatgtaggtgacagttttgctaaactttgccctagtatgtaacaagggtgtcctcttattcagctttcactatcatttctctcactttgcttgaagtcctcactgacagtctccttgagggctcttaggctcccatgaagtttcctcaagaccctttacatgtgtgaacacaaagggtccttatctgttcctggctatatagcaggtccttgaataactgtcatttcttcataacgttgataagaaaaaaatggattcctggctggggccactgtttgtgtggagtttggacattctccccacgtctgtgtgggtttttccgggtgctccaatttcctcccacattccaaagatgcatatgttagtggatcggtgtgtctaaatggtctcagactgagtgatcatgtatggatgagtgtgccttgcagtgggtgatgtcctgtctagggttggttcccaccttgtgccttgagttgctaggataggctctagccactcgtgactgaactgaattgggttaataattatcctacttgtttttattagtctttcttaaatgtgtgtatagctcacatttatttcagtgtttaataatcagagtgtttggaatctttacttagaagtttgatgatgtttttgtggccataaatatgccataggaacttccttatctcaattagcctatggaaaaatggattttgttacacattgtttcacttaaagtcacagtttccaagaacctattgaagacagtgaggattaactgtactagaactgtttcctaacccactggttcttatcagaattacctaaaggacttattgaaacacaaattgccgctgggccccacccccagagtttgtttcattagctctggagtgggacttgaggatttgcatctgtgagttcccaggtgatctgataatgttgatctggggcctagattgtgagaattactgatttaaaccagggattggcaagatttttctattaaggatcataaataaaatattttagactttgtgggcaagattgtttctcttgcacctactcaattccgcctttgtggtgcaaaagcagttatagacaatacgtaaatgaacagacgtggctcatggctgtgttctcataaagctttatttacataacaggcagctggctaaatttggtatgtgtgaactgtgctctgccaattcccaatttaaatcattacttgactccacatctcttcaagctatggccccatttttcactcccctttggaacaaaactctctgagagttgtctgtatttgtctctttttattctttcataaaaaaattatctattttttgaacacatttaaatgtcttagaattcaaaaagtagtaaatatctttgtacatttgtcagggcgtgtgtgtgtgtgtgactataactaaagattaagtagaagaggagttgctgattcaaaagtggtatatgttactaagttcaacaaatattgccaaattgacatagaaataccaagttatgcttttctacacctttactaacattgtgttttcagatgacttgattgttgccaacttgagacgtgaaaaatagaatctcattataattttaatttgctttttattctccttttttagggaactcttcactcatatcttggcccactttctattggatttgtggtccttttactttgctttgtgggagctcttatactaaggaagatagctttgagtttgcgaaatgagttgttttccctaggttgtctctttatctttttgattctgtagatagtgtgattttgttgttgtgcatctaggtaggttccttctaaccctgaaattatattttgagattctcccttgttttcttgttccatctggaatttatactgatgcaagatataagatgggacgcaacttttttcccctagatggttgtccagtttcaatactatttgtcagataatccttcttttctctgctgctgtgaaatgctggtgttttaaattgtgtatgtagttggatctatttctggactttgtttcattctaaaaatggctcctctgaaaccatattgtgagttcttgggtagtgaacatttctatttatttgtttccaagtcctgtataatatttattagcatatgggaggcattcaagtacttgaaaataaaatgaataaatcaagcatttaggaatagaagcagatctttttgccaattattcattttagttattctatttaattctctatttctgattttaaacttgaatttaaccttggttttccattttagttttaccttttttttaaactttattgtgaagtattaagttattttttgtacttactgaatgggcatttgctaacttatgtgtctgctcttattagtctatttttggcctcaaattgttaaaaattcacagtatagttttatttgtatcaaatttgctactgagggaagcttgtcatttcataatggcaatccataggataggtcaagtcatttgagattggaaccattaaggataagttcatttaacattgaattattagatctgtggttaattggccaggttagagaagacagaattacagggaagtctggattttacaacttattattttagagggtcaaatttagaataatatttttaagctttttaagtagaagtatatggatcacctgaggtcaggagttcaccaccagcctgactaacatggtgaaaccctgtctctactaaatacaaaaaaatagccaggtgtggtggtgcatgcctgtaatctgagctacttgggaggctgagacaggagaatcgcttgtacctgggaggcagaggttgcagtgagctgagatcgtgccattgcactctagcctgggcaacaagagtgaaactctgtctcaaaaaataaataaataaataaataaaaataaatacataaatagaagtatactattctgattctcttatttatatgtataatttatttttttaaatacatgaggtattgtagattttttggtttttttgaggaggggcgggggtgatgtgaaatatagttttcattgcatcagatcttcagttgtaatgatattgctggaatccaccatttaggaccctgtcttgttaaaaaaaaattatccttgccttcacccctacccctccctgccacagacttttaaaggtaagtattctgcgataattggattatatttactattatgaaaatttaaaattattagaagtaaaatgaaatatacctccattgtagtaagtttgattcacagtgcctctggttatggtggtcagtaaaagtaacactgtattaggaacagtcttcatggtgggagttctctccttttactcttctgttagtttgttctttttttttttttttttttttgagatggtttcactgtcactcaggctggaggacagtggctcgatcacggctcactgcagccttgccttccctggggtccagtgatcctcctacctcagcctcctgagtagctggcactgcaggcgagtgccactaggcctggctaatttttatatttttttttgtagagatggggtttcaccgtgtcactcagtctggtcttgaactcctgggctccagcaatctttctgcatcagcctcccaaagtgctgggattatggttctggagccaccgcgcatggcctgttagtctgttcttgcattgctataaagaaatacctgaggctgagtaatttataaagaaaagagatttaattggctcatggttctgcaggcttacaagcatggggctgacatttgctcagcttctggggagtcctccgggagcttttactcatggtcaaaagctaagagggagcaggaatatcacatttcaagagctggagcaaaagagaatgtggggaaggtgcacacacttttaaacagccaaatcttgcaagaactcagtatcttcaggacagcaccaagggggatgttgctaaaccattcatgagaaatccacccccatgatcaagtcacctcccaccaggcctcacctccaacattggggattacagtgcaacacatgaaatttaaaggggacaacatccaaactgtatcaaccttgctgtacccctcagcctcattttataggcaacaattgaatatattggttttataaaggtttgatatggaaagattcattaggagtggattttaggacttggggaatgactcagagaagaaaatagtgcatgatagtataagtctatctgattgatgagtaactggaaatccttccaaaacataatgcttcagtgtctgcagaattgtttcatttccatgtttatgtatttcttattgtttccttgtttatccataggtgcttaatttttttttaatctgaatgcattatgataatctttaaataattatttcagaggaatatctgaaatattcagtgttcttctagcatggcagtattttaaaaatcattatgagcttaaattcatactgatttaaacaacttctagatttttttgaatatcaatagcagagggtagttttaaatatttcacgagcagaattaattaaatttcctgtgcaattttattttttatagacaaactcgtcacttcttaaaatcttttaaaaatgtcttggtaatacaggcttggaatatgatggtattgaaatgagatcttaagggaaaaaaaactccaacgggtttttttgttgttgttgttgagatggagtcttgctctgtcacccaggctggagtgcagtggcattatctcagctcactgcaacttctgcctcccagattcaagcaattctcctacctcagcctcccgagtaactgggattataggcgcgcaccaccacgcccagctaatttttgtatttttagtagagacggggtttcaccatgttggtcaggctggtctcgaactcctgacctcgtgatccgcccgccttggcctcccaaagtgctgggattacaggcatgagccaccatgcccggccaaaaactccaacttttagaggcctatttacagcacttgtcccatatttgttcacactttttctgtatgtgtgttgtgaattataaatctggcttttcctacaaatgtggcttttcctgtgtagtcatcattaagcatgattctaagaagtagctcaaaatctcctaagaccaaaaaccacaaaaaacaaaaaaaaaaacaacaaaaaaccaaaaccagaaaagggatacattttgcagaataatttatattttcttctcttcatggcatcagttttctcaggagttctttttttgagatggagtctccctctgtcacccaggctgtagtgcagtggtgcgatctgcaagctccgcctcccgggttcacgccattctcctgcctcagcctccggagtagctgggactacaggtgcccgccaccacgcccggctatttttttttttgtattttcagtagagacggggtttcaccgtgttagccaggatggtctcgatctcctgaccttgtgatccacctgcctcggcctcccaaagtgctgggattacaggcgtgagccaccgcacccgggctcaggaggtcttttaagcttttgcctgtcatgtgtgtacttctgacgctggcccaaggtaaaatgattacatttgacttcggtagcccttaaatgtatggctgttcttaatcttttctaaagcctaaaagttgaattagtattcatcttagatttcttgtttcttaagtgaaagaatcatgacattgtattaaaatatcttatttgcatgtattttatatactgttttaataggcagtagtagtatacaagctttgaccaaatgtctcttcatataaaaaattcaagtgaataaaaacagtcatttaaaaatgacattagtcaaaggggcaaaaaagattacaaatgcttattgtgattgacagaacttgcttaacatattagggttctctagaaggacagaactaataggatatatatatgagtttattaaatattaacttaaatgatcacaaggtcccacaataggctgtctgcaagcttgaggagcaaggagagccagttcaagtctcaaaactgaagaacttggagtctgatgttcaagggcaggaagcgtcttggctaatccacccatcttggcctcccaaagtgctaggattacaggcgtgagcccccgtgcctggtgtacatcatttttaatatctttatagtattctgttggctaagttgccacaatttatcagacccctttaatgtcattaattttttcccaatatttagacttgtttcatagaattattagatatgcatgctactactcctgtcctttttcaaaggacaattattagatattcttgttttcctcatatctttgccaacactgggtattggcattcttcttgtttaccagtcagctaaggaagctaaggaagaaacaatatctcatttttatgtacttttctctgattcttaattatgttgaccatgttttcatttcttttgtgaaatgcctatttatgttcattttcatattaaattgtaagagttacttgtataaatatattaaacctttgtagtatatattttttctgtttttttttaaagttttgattatagtgtttataatatgcagtcaaatttacccatcttttatttcctctatcatttttcacttagatgtggggtttagaaaggaggtacataatgtgacagagtttttggtatagaaataactgacatagttagatataaaacataccaaggaaatagtcggaaatgtccaatttcgaatgtgtaaggagaccagtaagaaaatcatgaagaacagctaacagcagtaatttttaaaagggtatttacaaacacttgaaaatgtttatgtagtttaaaggaatgattcaaatataaagagaagcgtaacataaaaatgaaataaaggcatatatatagtcattgtgtagatggttttctagtaacagttataccaagtttgaaatgatttttaggctttgttatgccaacttttaggagttttctttttaaactttttgagcttatgtttcatcatggccaatttttataaattttccctatatgctcaaaacatttttttagtggaaggttttaatacgtctgtaatttctccggtgtcttaaaaataattagtttgtggagctctttgtgtattggagataccatcttcttgtttgatatatttgtatatgtattaagtaagaactggataaagaaggtggttgggatatgtataaatatcaggtaagaacttgataacgtattggttggtttgcatatgaaaagttgccctcactgtcaggttctttcctgtttctaggaattggctagccctggaaggactgccccttccagggtcagcaaattcccaagatagcaaagcatcaaaaatacagaataaaaagacatgcttagtagagtatatagaaatacaattggttttgtttattttgtgatgtatcctgtgatactggtaaattcatttataagttctagtaattttttggtagaatcctcagcatttttgataaatacaatcatgtctgcaaataaaaagttttatttctttcatttcaatctctatgtcttttatttcattttcttaccagattgcattaggtagaacctccagtgttgaatagaaatggtggtggtgagcatcctttccttgttcctgattttatggagaaagcattcaatatgtaatcattaagtaatagaaggttgtttgtagatgatctttattttattgaggaaattcccttctttttctaatttatttccagaaattttatcatgaattggtgttgacttttgtcaaatgcttttcctgcaacaattgggacgatcttatggttttgctccattattctgttaatgaggtaaattgcattgattcattttcaaatgtcaaagcaaccagtatgactggaataaaacccacttggtgatggtgttctgacctttttatatgctcctggttctatgttctattattttgttatgttcatgagaaacatttgcctgtaatttttttttttttttatgatgtgtttttgccaggttttggtattaggataattctggccacataaaatgatttggaaattatttctgcccctctgttttctgtaagagtttatacagaattggtactattttttccttaaatagttgacagactttcccagggaagtcactttggccaagagttttctttgtgggtatgtttttaatgaagaattcaatttattgaagagatatgatactattcaaggtttctgtttcttcctatgtcagttttggtaatttttgtctttcaaggaatttgttcatcaaatctaacttgttaaagtcattggcatgaagttgctcctatctttttatatccacttactgtttataaaatctgtagcgatatcctgctttttttacatcatatggggcacatattggtaatatgtgttcttttctgtttgtaaattgatcatcttagaggtttatcaactttttaaatcttttctaaaaacaaagttttggtttgattgattttctttattgttttatatattattaatttttgttctttattctttcttcactctctggttttgttttctagctacctaggaagcttacataattaatttcatatctttcttcttttccatcataagcatttatagctatacattctctctaaccactattttagctgtattcccccaaattttattgtttattatcattcaggtgaaaataatttctgatttcccttttaatttcttcttcgaacctgggattatttagaactatgttaattttgcaatactgggagattttctagatagttttttgatatttatttctaattcaattttgctatggccaagaatataattcatattaattcagtcttttcaaatgtttgagaattggtttatggaccaacctatggtataacttagtgaatgttctgtgagcacttgaaaaggatgtatgttctgcagttgttgggcattgtgttctgtaaatgtcagttatatttagttggttgatgtttaggtcttcattatttttactgattaaaaaaattttttttgttaattcctgagaaatgagtattgaaatttttagtgtaatagttgttttatttccctctttacatttttgcttcatgtaattggaaactattattgtgtgcatatatatttaagaagagtaatttataaatcttctatgattagtgtttttatgttctgcttacaagaggtcacattggtctgttttccatcttaaattaatatttgtgtaccgtatgaagtagatagaagttaaggttattttttgccccatatgaataaccagttgactaagccacatgttttgaaatgaccaatatttcttcactgaaatgcaatggcacatctgttccaaattaggtaactgtatgtgagtatgtttttttggactctattctgttccatttgtctatttgttcatttttgtgctaataccaatctgcttgttctatctttatgataaatcttgatgtctgataatataaatctttagtttgctcttcaagattgttttggctattgtaaatcctttgtttttcacagactttaggatcaacttgtaaatttccacaaaaactgctaggattttaattggaagtgggttgaatctatagattaatttggaaaagaaccgacatctgaaccatactgagtttttctgtattcttatatcagcatggtctatccctctcttatttagctagcatttattttttgtagaaatgttttacagtttttattgcacagtttttacagatatttccatagatgtattcctaggtatttgattttttgttactattgtaaatgatactatttttaaatgttcatttaaaaaattgtttgcttctgacatacagaaatgcagttgatttttatatattggtcttgcatcttgtgactttgctaaattcactcagtgattggtagattcttttaaatttcctacatatacagacatgtcctctatgaatactgacaattttacttatcctttctaatcatcataacttttatttagttttcttgccttattgcactagccacaatgtccactatggtattgaatagaaatcatgattttagacatgattgttacgtttttgaactctagaagaacaagatcaatattttaccattaggtatattgtttttttactgttaccctttatcagagtgaggaagtttgcttttattcctagtttgagattttaaaatcatgaacattggttaaattttattaggagtagtttctgcatctattgaaatgatcatatggtgtgttttctcattgtgctaataatgtaaaatatattgactatttaaaaaatttttttctaaattacataaaaattgtatatatggtgtacaacatgacattttgttatatgtatacattgcagaatggcaaaatcagtctaattaacatatgtatcacctcacatacttatcttttgtggtgagaacacttaaaatctactcttagcaattttcaagtatacgatatattgttattggtaatcaccatgatgtacaatagatctcttcagtttactcctcctatctaacagaaatttcgtatcctttgaccaacgtctcccattcctcctaatgggaccctcagcctctggtaactgctgttctacttactctctgcttctatgatttctacttttttagattctatggatcagtgagatcatacagttttgtctttctgtgcctagctttatttcacttaatataatgtcttccaggttcatccatgttgttgtaaatgacaagattttcttctttttttaaggctgaattatattctattgtgtacatatgctgtattttctttatcagttcatctgttgatggacacttaggttgattctttatcttggctattaagaataatgctgcaatgagcatgggagtgtagatattgctttgacatattatttttagttccaatacccagaagtgggattgctaaatcatatggtagttccattttaattttttgaggaacctccattcattttccatagtgactgtaaaaatttacattttccccccaagagtatacaagagtttctttttctccacacactcaccaatgcttgttatccttatatctttttgataaggctcattgtaacaggcatgaggtgagatctcactatggttttaatttgcatttagtgatgttgaacgttttttcatgaacatgttggccatttacatattgtcttttttttttttttttgagacagagtcttgctctgttgcctaggctgaagtgcagtggtgtgatcatagctcactgcagccttgacctcccaagcgcaagtgatcctcctccttcagcctcctgagtagttgggactgcaggcatgtgccagcatgcctggctaatttttttttttttttttttttttttttnnnnnnnnnnnnnnnnnnnntcactgtgttgcccaggctggtcttgaactcctggtctcaagtaatcctcccaccttggcctcccaaagttttgggattacagggttgagccactgcacccagtctgtattgtcctttgaggaatatctgttccggtcctttgcccatttttaaatcaggttatttgttttcttgcttttgagttgtttgcatttcttatctattttggatattaactccttatcatatggatggcttgaaaatattttctcctgttttataggttgtcccttcactctgttaattgtttcccttgctgtgtacaagtttttaaatctggtataatgattgatttctaaatgttaactttgcactcctgggggtaaattcatttggtcaagatgtattcttttaaagtgttattggatttaatttgctagtattttgtttagcatttttttccaaatatgtttatgagagagattccagtgtaatttttttccttttcatgtccttacatattttggtatcatgtttatactctcattttaagaatgtgggtaagtgttttttattttctatttcctgagagagtttgtataagctcaatgtttcttcctcagacatttggaaaaatttaccagcaaagtcactgggcattacattttctatgtggaaaagttttaaatggtatattctgagggctctgttctgttccattgatctatatctctgttttgctaccagtaccatgctgttttggttactgtagccttgtagtatagtttgaagtcaggtagcgtgatgcctccagctttgttcttttggcttaggattgacctggcgatgcaggctcttttttggttccatatgaactttaaagtagttttttccaattctgtgaagaaagtcattggtagcttgatggggatggcattgaatctataaatgaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaacgggagttcactcatgatttggctctctgtgtgttattggtgtataagaatgcttgtgatttttgtacattgattttgtatgctgagactttgctgaagttgcttatcagcttaaggagattttgggctgagacaatggggttttctagatatacaatcatggtatattcaatttttaaattactgtatttgtttgttctcatattgctataaagagctatctgagactgggtagtttttaaagaaaagttgtttaattgactcatggttccataggctgtacacaaggcatggctgggaaggcctcaggaaatttacaatcatggtagaaggtgaaggggaaaaaagtacatcttcatacagcaacaggaaagagacagcaaaggacgacatgctgcaaaaatttaaataaccagatctcatgcaaactcactcactatcatgagactagcaaagcgtaaatccatcccatgacccagtcacctctcaccaggccactcctctaacactgaagatcataattcaacatgagatttgggtggggacacagaaccaaaccatatcaattatatatagaattattcaaattttatatttcttcttgtgctagtttaggtaaattgttttaaaaggaacttcatttgtttttaaattggagaatattcctgttgtcttttacatgtttcaatattgtaagctctggtaataatgtctactttttaattcccgatattgataatttatgttttatcttctttttttcttgatcagtctttctagtgttttatcaattttaatgcttttaaaaagccaacgttttactttgcttttctttattttatttttatttttctctgatttctgctcttaagtactttcatttttatggtttttggcttaatttgttgcaacttcttgaaatgaaaatttatttaataacattgttcagcctttcttctcgtcttgtgtatgaatttaagattatgaatatcttagtatacacttttactgcgttttactcattttcattattgattcaaagtatttttaaagttattctttgtaccatgggttctatgaaaatatattgattaatttacaaatatatgcgggtttctagttatttttctgtatatgctgtggtacttttgtcagtggttatattttccataagagatttttaatttaggtgccattggcaaatttccattaattcaaatgcagaacttcacatttttcaatgcatacgtgagttttttttgttgaggtattaagaatagcataaatttataaaatattaagtaatcattgaatgcaaaatatgtcctattttgcaacttaatatacttttattaggttgacgctaaagtaattgcgttttttactcatactttaatggcaaaaaccacaattacttttgcaccagtctaataatgagaattattattattattatattgtcttttttttttttggagtggagtctcactctgtcacccaggctgaactgcagtggtgtgatatctgagccttggctcactgcaatctctgcctcccaggttcaagcaattctcctatctcagcctcccaagtagctgggattacaggcacgtgccaccacgcctggctaatttttgtgttttcactggagaacagggtctcactacattggcctggctggcctggaattcctgacctcaaatgatccccccgcctcggcctcccaaagtgctgggattacaggcatgagccaccgcgcctggccctaataatgagaattcttatcaaactgtttacacagaataacatgagtgggtaatggtgaagctgagtttcacatttttatgcgatattcttcagtgttgctatttgttcagtacttttaagaattatataaattttttatagtctatacataaagtcaatattatgggtcccaaatatataaaatgtttgcttgttccattgtttatgttttgaatacaaattatattttgtatgatttcattaataatttgttgagaattttatggcctaacatgtggtctactttctaaaatattccagcttcatttgaaaaggatatgcattcttcagttgttaggtgtttgcttttgattgcttgtatttctcagtcaaatgtaggaagtggagattaagaaaagggctggcacttttggtgattgaggaggagaaagtatgagatagttgtcttggatagtggaagagtaaatgttctaaagaaatataaaatgatagttgagcagcactaagggcccatttgagtatgaatctaaagagggaccaatctgaatgcatgtgttttcatcagtgatttttatatgtgtgggtaaaagctctgagtagacagagataaactgaactcttttagagtttctttgttatctttggtgtttggatcctttgctttgatttgtatcggtacagtttttaaaaaattaaatgttatctcctctcagcagatctttttaacatgaacccagcatctttaacaccaataaaatttcttctattatttttcttccctgtgttttcattcgtcctccatctagagcttctctttagaattgtactccctggattgatcctcttatttcttacttttatgctcataatatttttttctttctgtctgtctctttctctttctgagtctaggacctgggagtttgtcttgactgtcttccaaattatgagtttgatcctttgagtcgtattattcaactctttcactgaattgtcatctatctctttttctttaatgtatagagaatttattatgcacagccacttgcaaactttaacaagtatgattagagcagcattttctataacagcaacacataagttggaacaacacaaatcttaaaataactggaatggatgagcaaattgggtggtccgaggctcagacatcagcaggtgttaaacacctgtgggaaaggagagaacgatccatttatttatttctataggaaatgcaaaagaggcaaaattaagaaaaatactgcttcatgataaagaataaagccgtgaagaatatccacaaaattgtgtatagtggctacatctgatacagaatggaaacagccaggatagagcagcacaggaacactatgaaatgcccaggctgtcttcattactagtcaggatttttttttttaattttgtaaactttatttattctctgctcctttttcataatctagtgatgctttatgttttcaaaatattcttaaatctctctgagaataccgagaaagattttaaaccaagttatcttccctgcattatctgtttcttctggggtcagttgttttctggtccattttggtcttactcttttattcctacaacccctgccccatccccatcctaactgtaataatccttgataatcattgcatatttatgctttttatgtgtgtgcagacaactgtttttatgcttatagatgccttcctctgtgtattttttttcttcagttaaaattttttttttttgcagtcacagtcttgctctgttgcccaggctggagtgaagtggtgccaacctagctcactgcaggctcaaactcataagcttaagccgtcctcccatttcagcctcccaagtagctagtactacaggtgcacactacatgctggctaatttttagatttcttttttgtagagacagggtctcgcaatgttgccggggctagtcttgagctccaggctcaaacgatcctctcgccttggacttccaaattgctgggattggaggcatgagccatcgcacctagcctatgtatgttttaaatagagtctatttcctctactctgtcattctagtcctatctacttttgatcttcctggaattactgtaaatttctgatttgctgatagcaccttttcttatttgtcggagccgccatgaattcgtttatataaacttttaattttactccttttagctactgttgttacctgttttacttttatatctattttaagccctaccatacaccgttattattcatgctttaaacaattgtcagttgtcttttttttttttagacggagtctcgctctgtcgcccaggctggagtgcagtaaacatgacctccgttgcaacctctgccttcggggttcaagcaattctcctgcctcagcctcccgtgtagctgggattacaggcgtgtaccactatgcccggctaatttttatatttttagtacagacagggtttcaccatgttggccaggttggtctcgaactcctgacctcaggtgattcacccgcctcggcctcccaaatgctgggattacaggcgtgggccaccacgcctggctgtcagttgccttttaatacatttaataaatggaagaagaataatattataattaatcacatatttactatttttgagctcttcattcctttctgtaaacctgagtttacatgtaatatttcctttaatccacatgattttctttatcagttcttgagtgtgagtttgttggtgatgtactctctcagcatccatttatctgaaaacatatttgttttgccttgaattttgaaaattcttattttttataatacaacagatccagtagtatgagaattatttttcaggattgtagaattctgggttgacagctttccccctctccctaccagtactttgtcttctggcctccattacttctgaagcgatgtcagttctatttcttgtcttggttctcctgtatgtatgtgactgcttttaagattatctttttgtctttggtttttagcagtttggctataatgtgacttaagtatggatttgtatagattggattcagatgaactttttggatcggtggtttgatttttttaaacaaacttggaaaacatttagccagtattttttcaagtatttcctctgttccacttatatgtatcagactttgttactcttgttgttcagtggtgtgatcacggctttctgcagcctcaaactcctgagcgcaagtaatcctcctacctcagcctcccaagtagctgggactacgggcacagagcaccatgcccagcaaattaaaaaaaaatttttttgtagagatggggtcttgctatgttgccagggctagtcttgaactcctggactcaagcaatcctcctgccttggcctcccaaaatgttgggattaaaggcatgagccatgactcctggcctagatttcttgatattgtagagtttacatatggcttctttatcttcatgcattatattaattttttactgtaaattctattacatatgtatcatagtaaacaaagtctttaaaataaattctaatatttgggtctgctttgggtccatttctattatatatattcttcttttcatgtttaataagtttcagctgactattgtacattgtgggtgatacagtgtagaaactccggatgatgtggatttcaatctttctctgaagtaatgagttttgttctagcaggcagttaaatttactagcagaccaacttgatcctgcggaggcttggttttaggctttgttgggacaggtctatttcagttttgccattacttctggtaagtggctcttattcttcaagtgtggcttttctggcgtttcagtggaaagcctgagatatttaccagttccctctaacactaaatcctgactctccaggaccagatagctgttgaaatctcttcccagttctttcagatttctagctattgcctgtccctgggcttcgattttcatcctatggatgggaattcaggagtcaggccccactgactcccattttcctgagatttctgccctcaatttttggcttttctagcagctccaaacttcattctctgatactttcacccagtaagactgcagctttttacaagagctctgtcccctcctctggcccctgcctgtacacaacagactgtgtatgtagttgtctcaggatggaagaagagtaagtatgggcctcattcagtgtattccccttctttcaagggtcatatccccccgatttgtatctgcttttgtttctttgacaatgccttcaaatggtgtttttataaatatatatttttaaaaagtttataattgtcgtcatcaggaacattagtgtagtataaactactctctcattatcaaaaatctgtatgttaaaaattacttaaaattgttgttatttatcatttccttggtgtttggggcagaagggaatgcacatgatttttctgaacttctcattaagggaggcaacccagccttggtctggagatcccgaaattataccgtatgtataataaaataattattttgttatttttatgagcatagcattaataaattaaatatttagtaagatttgtatctcaggatttttctacctgctaagaatagatcgtttgacaaggcagatgaggttctttgttgaattataaggtattgaagcctataatttagtagtggaaagagcacatagcaagagttgtatgatgaggttggagaggtaagcagcaaacagataatggaattttagtctaaacattcgtaaaatatgagggtggctcctgtgggagattaggttattgggaggcaaagtagacttagggaaaatagttaggaggacattgcaatagttcaggagagaaataatagctgtttagtgtatgatggtagttgtggaaaaaaaagccaatggatggatttgaaatatagtttggaagtaaaactatcagtacatattgatggactggatataggggtgaaaaaagagaagaataaaggttgaccaaattctttattatctcaaagtatgaaagcttgttaagacctcttttctgtttgtattttctttcttgctcaataagaaaacaacccaaagcactttttttctaataacttatatcttcttcttttgtgataaaaaaaaataggagtggtctttagagtacaatacaaaattcttttacatttcacctcaccatatttaggtttaccaaagtagtataggaataattgtaggaaaaacatagtatatctacttggactataaaattttggtatactaaagaaagtaaatcaaaatggttatatcttgcaatagaatgcaaaatcacatggatattaaaggtaaacatttaaatgtattttatattcttggcttcttcttcagaccactccattgccttttgggacatttctgtggaaaagttgagaagcactgacctatctgaaccttccaatccagccaaacttgtctctactttgttccaggaacatgctgtgtacattcctctttccatgttttgcatgcttttctccctgccaataatgccctgtttttcattacttgtcaaaattctattttccttttaaggtccagcctatgttttaattgttgtgtgaaacttctaaaacctttctttgttttaaataattatgatcattttcttcttgtcattttgtagcacttaatttttaaaatttattttgtacttagatgatgtgtaatttactataaatcatagatttttaagaattgggaggaacagcggaaatttaattaagtaattttattatacaagtgaggaagctgagattcatttgtcatgtaagtagtttgcaataagaaaggatgaaacttatttttaggtctcttggctcccaggttagtaatttttctaatctactgcattacttcttcatgtatatttattgatctgaaaagttgtgtctcttagaattatgtagtatatgagtaaagtttgaaaatatgaacttttaaaatgtgatatttgaggtactggtttttgagtgtatgtgtacagttgattaaaatttattataacttttatttactctttctttttttttttttttttttcgtagagacaggttctcactatgttgcccaggctggacttgaactcctgagctaaagtgatcctctcaccttggcttcccagagtgcagggattacaggtgtgagccactgtacccagcctcttatttactctttattcaacagatttgttaatcaacacatgttgaccagacttaattacagcttttatatactcttcatttattcaacaactttcatgtgtcagagagtatcctaggcactgagtgcagtagtaaataatacattaaggttcttaccttcaagaaactttcattctagtggtacaagacaatgagcaaaatcataatctaatctatggtgggaaaatatcagaacagctgtggccacttgagtggttggagcagggactgatggagaaggagcatggaagaactttctgggatgctgataatttcttagggctttgggttacataggtatatgcagtgtccaaacttattgactggtacacttaagatttgtgcatttgattgtatttaggagggaaaatcctgtaaaactagaatagatgtaacttatatgagagttataaatgacaatatgttaaacacccatgaaactaccacccaccccaggaactagaatgttgccagcaatttgcacctacatatgtgtttctccctagctattctcctgtctatcttgcagaagtaaccattgtgtattgtattttgggattaacatttccttgattttttattttttttttgcgggggcggggggagatttgtttaacacatgtatatgcctaaacaatgtactattcagttttgcttgtttttgaaatttagaaaaacggtattttacagcttacagttttctataatttactgcttttgcaacattgtatttttaagatttatccatgttgcataaagctatagttcatttattttaacaactgaggaacagattctgtagtataaatgcacaaaagtatttacctattttcctgatagtttgggttgtttgcagtttttgccattggaagctgaggcgcaatgaatattcttgtaatgtgtctcttggtgtaaatatgcatgaagtttgtaactagacgtagaattgtagcagttctcagaacgtggtctctagaggatgcctgggtatcctaaaaacctattcaagggtttaatgaaattaaaatgattttcataataatgccaagatgttaaatgtctttttcattgagttgacatatgcacaaatggtacagaagtaatagtgagttaaacggctggcaccttagcacaaatcaaagcagtaatgctggttgtagttgtgatcattgtattctttttctttttcttttcttttttttttttttgagacaaggtctcactttgttactcaggttggagtgcagtggcatgagcacaatcactgctcactgcggcctcggtctcctgggctcaagtgatcctattgttttctttctcgtcatgtacttccaggaaaagaaaaaagccaattcgagtcacttattcttttgattctttttcgtagcaaagcatcaatgcattttctaaatgattgaattcatttaaattcgggaaacatttactgagtgcctatggaattctgggatatgagtgtatgtttaaggcagtgtgatttccagttaccatcctttctgttctaaacacgattgtgtcatattaaaatataaaaagagtaaaaaatatcctgaataaaaatagatcaagctgtacatatatatagattataagtgcaaaatactgagtgtggttaaagcctatgctatgcttgctgggtttcctgtacagaagtaggcattggagacagttttgctcttgtggtacaacatggatgactagaggcaggtccaggatgttacttttactgccagccgtcgcttccctccaaatagactattggaaggggaacctcccgccaaacgctgcctactgctatagtgttggataagttgcaagcttaggaagatgagatgacatgatttaggaacttcaggatgaagtgaagtatctcctgccttgtgactgactggatctgcatcgtatcagatacctcctcaaggcaggaattttaacctgctgttataagacctggttctatatatggatagcccaggtaggctaagttgtggcagccacagattgttagatgaggagggacaccacagactgtgtatgtgtgtgtgttgagggcaaggtgaggtgaggaatggtgcaatgagcctgcaaaccaaattgcaaaatatatgaagaaatgtagtgctaagaaaaatagtcaacaaaattaaaaattgaaaaatgaattttttcctgataaaatttaaaaatgtaagtaaacctctaattgaagtgtaacacacaaacaggaaagtatgctactcataaatgcacagcttaacaaattttcataaagtgaacacacctttgttaaccactacttagatcaagaaatagagtatcacctgaattactggcaggaggcaccccagaggtctccctgtacctcctgccagttattctccatgccctcccactatcccaaccctgccaagctaaccattatcctaactttttttcaccatgagaaagaaatggaaggatatggaagtgagcttgagaggcctccatggtcagtgaacagttctgctaaaataatttagagggaataacaaagaagtagcatttgacggcatagtagctgagaatttcctagaatagaaaaaagacatgaatctttagattaaaagtatgtagtcatttttgatcaagataaagaagaatctacatcaaaacctttccaaaaatattgcagaacattgctgctaatgcaaacaagttttaaactacttgagggaaagccatgacatgtaggagtgatagcagacttcatatttatgttaatagataccacaaaacaatgcagtaatatctttaaagttctggggaaagaaaattataaataggattttgagagtgagggcaacatatttttttcaaagactacaacttaaaaacccacagagccccactgaaaggtctactaaaagatacatttcagcaggaaaaagtgagtcctgaaggaagacccaaaacaatgatgagcacaaaacaatccaaagtcagtggtgggcacaaactgataaaattctagcaaatttactccttaatgctaagaacttcgtttaaattaactttctatcttttcagaaaaccaactcttagatttgttaatcttttccatcatttttatagtttctatgtcatttatttctgctgtgaacttcattttttccttccttctgttagctttgggctttgttcttctttttctagttccttgaggtgtaatgtaatgttgtttgacatctttcttcctttttgatgtaggtatttattgctataaacttccctcttataactgcttttgctgcatttaatactgactataataagatacgatgtaatagatttcaaggaattatgtatttttgaataaattaattctttaaagttgcatatccagttgcagatgaacttcaaaaatcttgcagttttatatctgttacagtaattgccaggttttgttgttgttgttttgatacattagaagttctagaattgttatatcctcttgatgaattaatccctttatcattctagaattaccttgtctctttactgtttgtgacttaaagtctgttgtatctgatatacctttgcatggaatatctttttctatccctttactttcagtctatgtgtatctttaaaggtgagatgaggttttgtaagtggcatgtagttgggtcatgttttttagtccatttagccattctctatcttttaagtggaaagtttaatctatttacattcaagtttattcttgatatgtgaaggcttattcctgtcattttattaattgatttctggttgttctgtaggtcctttgttcttttctttctctcatattgtttagcattgtggtttgttggttttctatagtgataacatttgaatcctttcttgtctgtgtgtgtttgctttaccagtgggtttgatactttcgtcatctgtttttcataatggtagtaattgtcctttttgtttgtttgtttgtttcttttttgagacagggttttgctcttgttctgtcctccaggctggagtgcagtggtgtgatcatggctcactgcagcctcgacctccatggtctcaggtgatccttctgcctcagcctctcaggtagctgggactacagaaacctgccaccatgcctggctaattcttttgtatttttcgtagacatggggttttgccatgttgtccaggctgctcttgaactcctgggctcaagcagtctgcctgcctcagccacccaaagtgctaggattacaggcttgagccactgtgcctggcctgacattgttctttgacttccatatgtagaactccctcaagcatttcttgtaggtctggtctagtagtgttgaattcctcagcttttgcttgcctcagaaaaactatttttcctttgcttaatgaaggataattttgctgggtatagtatccttgacttgcaggtttttttctttcagcacttttcatatatcgttccattctcttcctggcctgtaatgattctgctgagaaatctgctgttagtctgatggagcttcccttagaagtgactagactcttttttcttgctgtttttagaattctctctttgtctttgacaagctgttgtctctgacaacagttctctctttgtctttgacaaactgttgacagtttgactctaatgtgttgtggagaacctgttggaattttgtctttttggggatctctgagcttctgtatctgaatgtctaaatctcttgatatacttgggtagttttcagctattatttcattaaccaggttttctattccttttgtattttcattgtcttctagaatactgaaaattctaatattagtttgctttatggtatcccatatgtcatgcaggctttgttcattcttttttctttatttttgtctaatggggttatttcagaagacctgtcttcaagttcagaaattctttcttcgtagatgctctagaatgtattttttatttcattaaatgaattcttcagtttcagggtttcttgttttctttttaaatgatatctctctctttggtaaatttctcattgatatcctgagttgtttttctggtttctttgtattgtttatctgtatgcgtttgtatctccctgagcttctttaatatcattatttttaattctttttctggcatttcatgaatttcttttgcattggaatcttttggtagaaaattattttgatcctttggagatgtcatatttccctatgttcccatgtttcttgtgaccttacttctttgatatccacacatctggtgtaatcatcacttccatttttttgaatttgctttcatagggtaggactttttcctgaagatttgactggggtgtttgttggccagggcactttgggtttgaatctgggtgcatgcagtagtgtagtctctgtaagattttttttcctttgtaaacagcatcagtggtgtctgtgatttcctcagtggcatagtgtgtggttgtggaggctgtggtgaacttttgctggggatggtgacaccagctggactgatcctcagtcctcagttgtggcagcagttggacaaccatgcctgtacattagccccagggtggcttacattagtaatggtgttagtgggtccaggcagtccaatttttgggtctccaggtgacttgtttgggtaccaggagtggcagtgatgggctgggcagctgagtgggtccacaggcccctgggcagtgagcatggcatgggttatgtcagtagcagtggtaggagaacctctggctgtccagttgtctgtgcttatgtcggcagtgacggcgattggctgggtaggcaagtcctaaaacctgcaggtggcaagtgtgagtgggaaccagctgtggtggtagtggcaggttgggtgggccacatcctcagacccccaggtggaatgctcagttgacactggacgtggacaaactggtgcgatcccaaggcccccagataacatgcttggatacgtgggagtggggtgctgagctgggcagggtgagagtatcctcaggccctccagtggtgttagcaggtgctgtttgtggtgggcaggagcaggatgatttccaatttcctggtggaatgttcaggtgggggcagcagtggctgtgctgtgccctgatgctggggagggtgcggttgctgtcagtgggagcagttgtagggagttggctaaggagtgtgcactgcagctgcaggtggaggctgtagatgtgatgaagctgtactcagggtgcatgcaaatttgcattttgacacctagcggcagcagcctgcaatggtggcagctgtaggtggtagagcttgtcctcagggcacataccaatatatggcagcccttctgctgggagcagtggggttattgccaatggcttgtgctttggtcccagaggcggcagccagcaatggaggtgactgtcggtggaggatgtcagtggggctctaggggtgtggatatgcaggggctgttgggctccagggtaggaggcattctggtgtgggttgggctttaaaaatggcaccgtgctgtagctgcttaggactcaggggtgtgttggaccagcataagctccctctctaaagcaatgtcattgtgcagtctccaggcagctccctatgttactcccagggcccatgaaagttgacgggctctcttgtgtctgggattgcaggagtttgcagtgaaaatgtgggccactgggagtctctcacttactctttccccacattgtgcaggctctctaggcttctggctgatcctggctgagcaggctgccccacttccctctccttccttgcattaggtgttttctatcacttctctgttgaatttccgtgttctctcttagatgacctattcaaagtgtgattatctactcgctattttggttcttctttgtggagcaggtgagtaccagataactctagtcaaccttctggacccctcttcccccaatttgagatctcttcttctgttgtctgtaactgagtttaatgcttgtttgttcatgttaggattttatatcatcgtcctcaattaggttgttaactggaattttataatctttgtccacaggaagtttaaaatgtatgatttcttgcattgtgctttgtatgtagtaatacacgatatttatccagttaatggatttgacagccattgctgtcaaggagcagtccttctttgtgtatgaagggtgccttatcaatattatttccatttgtaactttatttatttatgtattcatttttgagacagggtcttgctgtgtcacccagactggagtgcggtggagtgcggaggtttgctgcagcctcatcctcccaggttcaagcaattcttccgctccactcccagagtagctaggactacaagtgcgtgctgccacgcccagctaatttttttcttttgtatgtttttgtagagatgaggtttcaccatgttgctgaggcttgtctccaacttctgggctcaagctatctgcccgcctcggccccgcaaagtgctaggattacaggtgtgagacactgcgcccagcccatttgtaactttattgttttctcttacaggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtaagtattaaaaaacagcattttcctttttatgcatggattgttttaattatgctatgctaatactaggtacatgcataatatatatttttatttttttaatgcttgtatggctggcgtgtgtgttttcacatgcatagaaaatgaaagtgttactggagtacaatttatggtgaatctgccttgggctaggtatcaaaacaaattgatgcccataaatgtttgctgactattctttataattacatataaggtggttaaaaaatcctgtcatgggctatctcatgacataaggtaatattaaagctagatcctgagagcaacatgaaagcaaaaaattaatgttttgaaatatgtatttgatttaaaatcttgattaaatggctgacaaaccatcattttcttctagttagcttctgaagacctctgccaatctttcctcatatatatttcttatgtctttggtgtatcttgaaatcatttttactcttgagacctgattatattatctatggaccaaaactgtgaaccagagaactctttctatagagctaacacattttactagaccactgaggttactatagagcctactatcatggtatctcatttttaaatgttcttttaatagaaagactagttgacactattttgaagaatagtcgtatgattttatttgtagaggcaaattaaatgtctaatatagtatttataagaatgtatgattacatcaatttattctcttatttaagatcagtataggtcagaataaccattaactgtaagttggaggaagctaggtacatttcaagttccttctagctattttgaaaaatacaatacattgttgttaactatagtcaccctactcttctatcaaacatttgaacttgttccttctgtctgtatttttgtgcccattaaccaacatctcttcatttccctcttcccacccatataaccttgccagtctctgctaccaatccactctaccttcatgtgatcaactttttagctcccacatatgaatgagaacttgttatatttgtctttcagttcctggcttatttcactcgacataatgaccttcagttccatccatgttgctgtgaatgacatgattacattcttttttacgatgccactgggccccaggggagtacgcattctgttgtgagctgggcttcaaaatatcaccttgctgtagctgcttaggactcggggggagcgtgggacccagtgtgaacttcctcactggaataggaaatgcttttgtgctgtctctgggcagccctctatgtgaattttttgtcctgcaaggggctagggtctctcctgtgactaaaattccaggggttcacagtaggaatgtggaccattgggcatctctaacttaacctttccctgtgtggagtctctcctagcttcttgccaatcccggctgggcaggctgtcttgtttcgtctccttccttgcttttctgttgaataccagtgttcctcttggataatctactcaaagtgtgattatatactcatggttttagtttttagtggggaagtggatatgagagacctctggtcagttatcttgactatattgtaaagtctgtattttttgttgtgtgtagtctctgaaatctctgatcctttagcttatagtaagattttagcttgtaagatttttttagcttttaagattttttagcttgtaagatattttttagctagtaagattttagcttgtaagatttttagcttgggccgggcacggtggcttacacctgtaatcccagcactttgggaggctgaggcaggcagatcacaagatcaggagatcgagatcatcctggctaatatggtgaaacctcatctctgctaaaaatacaaaaaattagccaggtgtggtggtgggcacctgtagtcccagctacttgggaggctgaggtgggagaatggcatgaacccaggaggcggagcttgcagtgagccgagattgcgccactgcactccagcctgggcgacagagcgagactccatctcaaaaaaaaatttttttttggcttgtaagattcatttttagcatgtaagattttgctttagcttgtaagatttttttttgacagattttattgaattcctagggccaaaagaaaataatagaaaagaacaaaaaactctttcagtctttgcagattggctctgtgttggggctctcattcagtgtttacccagtccatttacaactctgccttagccttcccttcctgcttgtgctgactctaaagaacagcttgaggtgaaagcttagggtcttttcttctaagttctgttccttgggcatgcatatggcttttctactctccaatacatagaaatgcttttcagtgctgtcatttcccaaataaactctcctctgtcatctctgttttggttttcagtgtgtttattgtttgcctcaactttagacctctgccccagatagcaacagcttgttcatttgcaatgttttcaatgaatatcttctgtgaagctgcttttctgccctgagaaagtcctgaattaagtggaacataggtgtgctctttgcatcatttcttcagtcagtccccagtcagggcaaaagagagaaaaacagttttttgagattaaggttggctctgttcactccagagccagggaccagagtttcacactgggagcaccaattgccatcttcaagactttgcttaactagggggagtggagccggggctggtgggcaggacatgggcgtagtgggtggttaagggaaagtaaaaatgctgcacaactttcctgccatttttaagtggctgttttcttgattcagcatttatctgattgctgcatatctttgcctattttctgtagtttatatgaagttcattctgacagtttttactcattttttttttcctgtttctgggagaaggataggtccttggaactacctactccaccattttcactgatgttactcttttacttttctaatcatggaagtaaagtttaagatttttctatctatattggtgagattacccttggtatcgtagtcaaactaaattcacaaaatgtgtcaatttctctgttcgctcttggtctattctctgtgatagtatacttaagatggaattgtctttcatgtttggttgaactcaaatataaatcttgtctgggcctgatggtggttttttctttcttcattgttattttgttattcttcttccttcccttcttctgtctctttcttgctccttctttcttttcttcttcttttgtttaagtggatagagtttgtttcctttttttttttttgagactgagtcttgctctgttgcccaggctggagtgcagcagcatgattatggcacactgccacctccgccttccaagttcaagtgattcatttccctcagcctcctgactagctggactacaggcacccaccaccacacccagctaatttttgtatttttggtagagacggggtttgccatgttggccaagcttatctcaaactcctgacttcaggtgatccacctgcctcggcctctcaaagtgtgtgagccactgcacccagccagaatctatttctttaatggttatagttctgttgaagttttaaattaatgaatctttttaaagttacattttcacaaaaattgtccatctgtctatattttcaagtttattggcataatgttgttctagcactctttgtcttcataacttataattatgctttttaaaagttcttagtgtttatctgtgcctctttttttcttattatccttgacaaagatctattttgcaaagaatcatcttttattttgttacttctccctattggatttttatcatgtccatctctaacctttctttgggattactctattgtcttctactatattgagttagatacttagatcatttgctcttattttctaatataagcagataaagctacaatttttcctcttgagtttcaccttagttgtattccacaatttttagtacatgatattggtaatcattattcattataaatgcctcccaatgtatttttcctttgacttctgagttatttggaagttatttgtaaataaaagaatgaatgcaagtatactgtttaaaagttgctgctaaataatgttattataaataacttaccgaaattattacacatctgtaagtagacggtcgtgttaataatttaaattaagaatttaagtctttcttgtcagtttgtcatttgtgccgtttctatctacagtggaaaatagtgaaaacataactagaataaaatacttttgtgttctgtgagccttatgttttaaatatataggattaaaaaaattttacatattcatttctgatttaattgaagtgtggttagagaacatggtatgaatggttattctgtggaacttctaaagacttgttttgagttcacgtgattgttgtgtttgtgcttgtgtgtgtacgtgtatgcgtatgtgtgaatgttctatatatgcttgaaaatagcttgtattatttacttgtgtggtttaggtattctcttggttttttagttcagtggctttcaaccatttgttgatgtaccttctaaaatatcttttaagaaattacatatgcactcacattttaagttgatatttaaaatttttcattgtaaattaaaatagcccaaaggacataattattaatgtattgtgtaaaacttgacacattgttcttttaagagtattcatgacttctaaatatttttgtgatttgatacctattaattaaaacaactccttctgtgcaaccacatgcaagcatggatttttattatacctccagttcagggaaacttgaaaatttgaaccaacctttctatagaggacaactgaagaaaccagatgaaatgttttaaaaatatctgcttgaaagagtctcagcagttatattttaaaatactgacacacctcggagatattgtgggtttggttccagactatcgcagtgaagcaaatattgcaataaagcaaatcacatgaagttttaggtttcccagtgcatataaaagttatgtttaaattattctgtagtctgttaagtatgcaataatattatgtccaaaaaagtacataccttaatttaaaaatactttattgtcaaaaagcactcataatcatctgagccttcagtgagtcataatctttttgttagtggagagtcttgccttgatgttgatggctactgactgaccagggtggtggctgctgaaggttgggtggctatggcaatatcttaaaataagacaatgaaggttgctgcatcagtggactcttcctttcgtgaaagatgtctctgtagtatgcaatgctatttgatagcattttacccgcagtagaacttctttgaaaataggaagttgattcactcaaaccctgccactgctttgattaagttgatgtagtattataaatcctttgttgtcatttcaacaatattcacagcatcttcaccaggaatagattccatctcaagaaaccactttctttgctcatccataaaaagcaattccttatatgtccaagttttatcgtgagattacagcaattcagtcacgtcttcaagctccacttctaattttagttctcttgttacttctaccacatctgcagtgacttccttcactgaagattaaatccctcaaagatacccatgagagccagaatcagcttcttccaaactcctgttaatgttgacattttgacctcctctcatgaactacaaatgtttttcatgacgtctagaatggtgaactctttccataagtttttttatttactttgcttagatctgtgagaggaaacactgtgacagccataaccttactaaatgtgtttcccaaataataagatttgaaagtcaaattgctccttatccatgggctgcagaatggatgttgtgttagcaggcatgaaaacaacatgaaattcaatgtacatcttcatcagagctcttgggtgaccaggtgcattgtcaatgagtaataatacttggacaggaatctttttttctgagctttaggtctcaacggtggcttaaaatattcagtaaaccacgctatatacagatgtgctatcttctaggctttgttgtcccatttatagagcacaggcagggtaattgagcatagttcttaatggccatagattttcagaatggtcaataagcattggcttcaactaaaagtcacttgttgcattagctcctcagaagagagtcattcagttctttgaaactttgaaggcaagcactgacttctttctagctatgaaactactcctagatggtatcttcttccaatagaaggctgttttgtctacactgaaaatctattgtttatcagtgatctttgttagatctttggataacttgctgcatcctctccatcaacacttgctgcttcaccttgcacttttatgttagggacatggtttcttttcttaaacctcatgaaccagcctctactagcttcttgcttttcttctgcagcttcctcacctctctcagccttcacaggtttgaagacaattagggccttgctctggtttagggtttggcttgagggaatattgtggctggtttgatcttctatctagaccactcaaacttttgtcacatcatcaataaggctgttttgctctcttatcatttatgtatttactgcagtcgcatttttaatttcattcaaaaactttttctttgcattcagaacttgattgactggtgcaggaggcctggcttttagcctctcttggcttttaataataccttcctcacttagtttaattatttctagcttttgatttaaagtgagagatatgaaactctttaatatatgaaactcttcctttcccttgaatgcctagaggccattgtaggattattaattggcctaatttccatattgttgtgtctcagggaatagagaggcctaaggagagggagagacacaggaatggctgttgctggagcggtcagaacacacacagcatttgttgcttatgtttgtcatcttatatgggcacggttcatagcggccccaaatgattacaattgtaatgtcaaagatcactgatcacagatcatcataactgatataataataaaaaagtttgaagtattgcaagaattaccaaaatgtgacatagggacacaaagtgagcacgtgctgttggaaaaatggtgctgacagacttactagattcacacttgctctaaatccttattttgtaaagaaaaaaaccccacaatatctgcaaagtacaataatgcagggtgcactaaaatgaagtatgtttgtataaaaaaagattgtgattaataattcagttgtaggggttggtatatcaaaagatttcgactgctattacattttgttccgattttaagagttgttactttagcttcatttcaaattataggtgctatgtaaaaatattctgttgtgtacctttaataattcctttctctgcttcttttctaggtatcacacctgtgtatcataatatgtttgctttaatgagtgaaacagaaaggatctggtatccacccaaccatgtcttccatatagatgagtcaaccaggcataatgtactctacagaataaggtactttcttcagtaaagtaactcacttaatgctaaaaggcaaaatgggagaaattatcaaatattttttaattgcaaggtacttaataccagatacctgaaccaattagttagcactcatttaagatttcatttaagattctattctgtttctccatcagagaaactgtttatacatgttgtgtaagtagaatactctgagaataaagctgttttggtgggatgccacttaactccttatgattataattaaataagtaaacaaaatcacagtggcctttattaacaaaatcctaaatgtttgggatattgctggtttgtgcagcgttttgtgcaatagaatgcaatttcacatcttatctttataaagaactttttaaaaagttgacgtgaagaaaagagacttttcccagtgtgtatttgcagcctcaaattgtaagttaatttatataatttatggtaatgtgtaatgcctatttagagaaatctagaagtatttttttgctcgaaaggatgaaacaaagatacgtttgatttgtgtctcacaaatacctgtgatttttctaagcatttatatacatatatatataattcatcataacttcatgaggtgttaagatttccacattaaagataaagaatttggagcactgagaagtaatattactcaaatttattcatggtcacacaggtaggaattgggagtcaggttcaaatccaagcctggtttgcttcataagcttgcctcttaatcacctcatgtgtacttcattaaagagataatgtatatataatatttattattgtgcctatcacttggtgctctctcaataaattttagtattgttttgcttctttctcttcccctattctatataaaaatatgcagttggatgtgtttgcatttactgatgtctaatgtataatttgcactgagttcaaaaaaatattttttatataattattgaaaagacaattggtgaaaaaaataaatgttcaaagaaataatagatgtacaaaaatcaacagcattcttatatgcaagcaaccagttatataatagataaagaagatcctatgcagtgtagctacaaaaacccttaactaaccaggaatggtcttaataagaaaaaacagaagacagtataggaaaattagaaagttatttgaagaatatgaagaattaggacataacattggaatggggagatggaatattacaaagatcaatttctcttatgctatatccttagctctaagccaatcaaaatcctaacaaaggcattttacggaatttgacacattactatgtaaattgagaattattaaataagatagccatgagaaagaagacttacctggcaattgtaaaatattttgtcccaggagatattttcacattatatgaaactacaaaatggtatctattattaaagccacataattaaattcagaatcataaactaaataatgagaatgatggggccagtatatcttgaaagtactccttcatacatatagaaacataataatatgaagaaatcttttcatattaacgtggaagggagagattagtcaacaaatggtggtagaatagttgattagctgtttgaataaaattttagcttcttactttataatgtatatcagataaattatagattgattaaagatcagattgatatgtaaatagaaatgtaaagaaaatcaaactataaaagtctgaattggaactgaattcaagtccttgggaaaataccatttaagttgcaaaacaatagaaaaaatcatatgggaatgactgcaattgtcaactataaaaattttcaaatgtctgaaggtttcctcttaaaatgaaaaggcaggagggtggagccaagatgactgaataggaacaggtccagtctacagctcccagcatgggcgatgcagaagacgggtgatttctgcatttccaactgaggtgtaccgggttcgtctcactggggagtgtaggaaagtgagtgtaggacagtgggtgcagcacactgagcatgagccgaagcagggcgaggcatcgccacacccgggaagcgcaaagggtcagggaattccctttcctagtcaaagaaaggggtgacagacggcacctggaaaatcgggtcactcccactctaatactgcgctattctaacggtattagcaaatggcacatatcccgcgcctggctcagagggtcctacgcccacggagcctcgctcattgctagcacagcagtctgagatcaaactgcaaggtggcagcgaggctgggggaggggcgcccgccattgccgagggttgagtaggtaaacaaagcagccaggaagctcaaactgggtggagcccaccacagctcaaggaggcctgccggcctctgtagactccacctctgggggcagggcatagccaaacaaaaggcagcagaatcctttgcagacttaaatgtccctgtctgacagctttgaagagtagtggttctcccagaatgcagctggagatctgagaacggacagactgcctcatcaagtgggtccctgaaccccgagtagcctaactgggaggcacccccaagtagggggagactgacacctcacatggccgggtactcctctgagacaaaacttccagaggaacagtcaggcagcaacatttgctgctcaccaatatccgctgttctgcagccactgctgctggtacccaggcaaacagggtctggagtggacctccagcaaactccaacagacctgcagcagagggtcctgactgtcagaaggaaaactaacaaacagaaatgacatccacaccaaaaccccatctgtatgtcaccatcatcaaagacaaaaggtagataaaaccacaaagatggggaaaaaacagagcagaaaaactggaaactctaaaaatgagagcacctctcctcctccaaaggaacgcagctccttaccagcaacggaacaaagccggatggagaatgactttgacaagttgagagaagaaggcttcagacgatcaaactactccaagctaaaggaggaagtttgaactcatggcaaagaagttaaaaaccttgaaaaaaaattagacaaatggctaactagaataaccaatgcagagaagtccttaaaggacctgatggagctgaaaaccaaggcacgagaactacgtgatgaatgcacaagcctcagtagccgattcaatcaataggaagaaagggtatcagagatggaagatgaaatgaatgaaatgaagtgagaagagaagtttagagaaaaaggaataaaaggaaacaaacaaagccttcaagaaatatgggactatgtgaaaagaccaaatctacgtctcattggtgtacctgatggggagaatggaaccaagttggaaaacactctgcaggatattatccaggagaacttccctaatctagcgaggcaggcaaacattcaaattcaggaaatagagagaacgccacaaagatactccttgagaagagcaactccaacacacataattgtcagattcaccaaagttgaaatgaaggaaaaaatgttaagggcagccagagagaaaggttgggtaacccacaaagggaagcccatcagactaacagcagatctcttggcagaaactctacaagccagaagagagtgggggccaatattcaacattcttaaagaaaagaattttcaacccagaatgtcatatccagccaaactaagcttcatatgtgaaggagaaataaaatcctttacagacaagcaaatgctgagagattttgtcaccaccaggcctgccctaaaagagctcctgaaggaagcactaaacatagaaaggaacaactggtaccagccactgcaaaaacacgccaaattgtaaagaccatcgaggctaggaagaaactgcatcaactaatgagcaaaataaccaggtaacgtcataaagaccggatcaaattcacccataacaatattaaccttaaacgtaaatgggctaaatgctccaattaaaagacacagactggtaaactggataaagagtcaagacccatcagtgtgctgtattcaggaaacccatctcacgtgcagagacacacataggctcaaaataaagggatggaggaacatctaccaagcaaacggaaaacaaaaaaaggcagggattgcaatcctagtctcggataaaacagactttaaaccaacaaagatcaaaagaaacaaagaaggccattacataatggtaaagggatcaactcaacaaaaagagctaactgtcctaaatatatatgcacccaatacaggagcacccagattcataaagcaagtccttagagacctacaaagagacttagacttccacacaataataatgggagactttaacaccccactgtcaacattagacagatcaacaagacagaaagttaacaaggatatccaggaattgaattcagctctggaccaagcagacctaatagacatctacagaactctccaccccaaatcaacagaatatatattttcagcaccacaccacacctattccaaaattgaccacatagttggaagtaaagcactcctcagcaagtgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgacggcagaaataaagatgttctttgaaaccaacgagaacaaagacacaacataccagaatctctgggacacattcaaagcagtgtgtagagggaaatttatagcactaaaggcccacaagagaaagcaggaaagatccaattgacaccctaacatcacaattaaaagaactagaaaaccaagagcaaacacattcaaaagctagcagaaggcaagaaataactgagatcagagcagaactgaaggacatagagagacaaaaaacccttcaaaaaaatcaatgaatgctggagctggtgttttgaaaagatcaacaaaattgatagactgctagcaagaataataagaaaagagagaagaatcaaatacatgcaataaaaaatgataaaggggatatcaacccgatcccacagaaatacaaactaccatcagagaatactataaacacctctacatgaataaactagaaaatctagaataaatggataaattcctggacacatacaccctcccaagactaaaccagaaagaagttgaatctctgcatagaccaataacaggctctgaaattgaggcaataattaatagtttaccaaccaaaaaaagtccaggaccagatggattcacagctgaattctaccagaggtgcaaagaggagctggtaccattccttctgaaactattccaatcaatagaataagagggaatcctccctaactcattttatgaggccagcatcatcctgataccaaagcctggcagagacacaaccaaaaaggagaattttataccaatatccttgatgaacattgatgcaaaaatcctcaacaaaatactggcaaaccgaatccagcagcacatcaaaaagcttatccaccatgatcaagtgggcttcatgcctgggatgcaaggctggttcaacatatgcaaatcaataaacgtaatccagcatataaacagaactaacggcaaaaaccatatgattatctcagaggcagaaaaggtctttggcaaaattcaacaacccttcatgctaaaaactctcaataaattaggtattgatgggacgtgtctcaaaataataagagctatctatgacataccgacagccaatatcatactgaatggacagaaactggaagcattccctttgaaaactggcacaagacagggatgccctctctcaccactcctattcaacatagtgttggaagttctggccagggcagtcaggctggagaaggaaataaaggttatttgattaggaaaagaggaagtcaaattgtccctgtttgcagatgacatgattgtatatctggaaaaccccatcgtctcagcccaaaatctccttaagctgataagcaacttcagcaaagtctcagcatacaaaatcaatgtgcaaaaatcacaagcgttcttacccaccaataacagacaaacagagagccaaatcatgagtgaactcccattcacaattgcttcaaagagaatacctaggaatccaacttacaagggatgtgaaggacctcttcaaggagaactacaaaccactgctcaatgaagtaaaagaggatacaaacaaatggaagaacattccatgctcatgggtaggaagaatcaatattgtgaaaatggccatactgcccaaagtcctttatggattcaatgccatccccatcaagctacagatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtatcaaaacagagatatagaccaatggaaagaaataatgctacctatctacaaccatctgatctttgacaaacctgacaaaaacaagaaatggggaaaggattccctatttaataaatggtgctgggaaaactggctagccatgtgtagaaagctgaaactggatcccttccttacaccttatacaaaaattaattcaagatggattaaagacttaaatgttagacctaaaaccataaaaaccctagaagaaaacctaggcaataccattcaggacataagcatgggcaaggacttcatgtctaaaacaccaaaagcaatggcaacaaaagccagaattgacaaatgggatctcattaaaccaaagagcttctgcacagcaaaagaaactaccatcagagtgaacaggcaacctacagaatgggagaacatttttgtaatctactcatctgataaagggctaatatccagaatatacaatgaactctaacaaatttacaagaaaacaacaaccccatcaaaaagtgggcgaaggatacgaacagacacttcttgaaagaagacatttatgcagccaaaagacatgaaaaaatgctcatcaccactggccatcagagaaatgcaaatcaaaaccacaaagagataccatctcacaccagttagaatggcgatcattaaaaagtcaggaaacaacaggtgctggagaggatgtggagaaataggaacatttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaataacaaagacttggaaccaagctagatgtccaacaatgatagactggattaagaaaatgtggcacatatacaccatggaatactgtgcagccatgaaaaatgatgagttcatgtcctttgtagggacatggatgaagctggaaaccatcattctcagcaaactatcgcaaggacaaaaaaccaaacactgcatgttctcactcttaggtgggaattgaacaatgagaacacatggacacaggaatggaacatcacataccggggcctgttctggggtggggggatggaggagggatagcattaggaaatatacctaatgttaaatgacgagttactgggtgcagcacaccaacatggcacatgtatacatatgtaactaacctgcatgttgtgcacatgtaccctaaaacttaaagtataatagaaaaaaatgaaaaggcaaattgtaaagatagtttcaacaaatcaaataaacataaggttagtattcttgtaagtatgaaatttaaaacagtgtatccatttaacaattacttaatgtacatgaatatatagcgtcactagttatgagaataatgaacgagattgcttgctttagcacatagttacaactattcattattcttataactagtgatgctgagaattttttgaaaaggccattaatgatttgttcttcttttgttaaatatttcttcatgtacattaaataattgtttaatggatacagtgtttttaatgccaacaaattagaggatcaagatgaaatggacaaattcctagaaagacacaagttataggaactgctaaaagaaagaacagaaagtttgaataggtctatgacaaataaagaaatcaaattagcaatttttataaaagcccaggcccaagtggcttcacttgtgaattctatcacacattaaaaaaattattactagttattcacaaaaaatagaaaaggaaggaggatttctgagctctttctgtgagttcagtattaccctgataacaaattcagacaaagatgtctagaagaaaagaaaactacagaccaatgttgtaggtagaaaatcaacaaaatacttgcaaaccgaatccagcaatacagcttgaatatgtcttatctgaaatgcttgggaccagaagtgttttggattttagatttttttttttttttttggattttagaatatttgcagagtatacgctggttgaacatacctaatataaaaatctaaagtctgaaatgctctgatgaatatttcttttgcacatcaggttagcgctctaaaggttttgaattttggagcatttcggatttcagattttcaggttaggaatgctcagtttgtttataaaaagatgaaatactatgaccaggtgggatttatcccaggaaatacaaggctagtgtaacttccaaaaatcaatcaatgtaatacaccacattaatagaataaatgaccaaaaccacatgatcatcccaagagacacagaaaaagtatttgataaaatccagcatcccatcattataaaaaaactcaacacaataggaatggcaaggaacttcctcaatttgttaaagggcatctgtaaaaaattcaaaagtaatgtcatacttattagtgaaagactgaatgccttttccctatgatcaggaatgagatgaggatagctacttttaccactttgatttaacactatactgtagattcagggtagggaaattaggcaagaaaaagaaataaaaggcatttatattggaaaataagaagtaaaattgtagtcatcccgctgtatccatgggtttcacatccatggattaaaccaactgcagattgaaaatacttggaaaaaaagttgtgcttacactgaacatgtacagactttttcttgtcattactccctaaagaatacggtataacaactatttacataacatttacattgtattaggtattataaatagtctagagattttaaagtatactgaaggatgtgcacaggttatatgcaaatactatgcctttgtatatcaggaacatgagtatttgcagattttggtatgtgtgggaggttctggaactagtactgcatagataccaaaggatgattgtgtattcacagattacatgatcttgcatattaaaaatcctaaggaattaataaaaaaactattagaactaataaatgagctcaggtcagttgcagaatagaagatcaatatataaaaatcagttgtatttctatacagagacaaagaacaatccaaaaatgaaattaaaaaaatttcattaacaatagcataacaaatttttaggaataaacttaaagaagtgtaaaatgtatacactgagaaatataaaacatcattgaaagaaattaaggaaacacctaaataaatggaaagatatctcatagaggacttcatatttttaagatggcaatactccttaattgatctgtatgttcaatgcaattcctactgaattcctaaatgtctttattgcagaaattgacaggttaatcataaatttatataaaaagcaaagggacttagcatagctaaaacaatcttgaaacaatacaaagtttgaagacttatacttcctaattacaaaatttattacaaaaggactgtaatcaagacaatgtgatactaaaggatgaatatacagattaatggaaaggaattgacagtctcaatataatttctcacattgatggtgattgatttttgatcagggtgccaagacaattcatgggcatagaatagtcttttaaactaacagtgcggggacaactggatatccacatgtaaactaatgaagtaagacaatctacttcacactatatacaaaaaaaaaaagcttaaagtggatcataggcctatatatgagagctaaacttattaaaactccaagaagaaacacagaagtctttgtgtacttagattaggcagtggtttcttagatatgacaccaaaagctcaagtgacaaaagaaaaatagttaagttaggctttatcaaagttaaaaacatctgtgtgtcaaagcacactatcaaaaatgcgaaaagaccacccacaaatgggttccacaaaatggaagcaaatgtttgggaatcatatatctgataattgtcttatctccagaatataaaagaattcttacagctcaacaagacaatgacaacttaatttaaaaagtaggcaagggacttggatagacatttttccaaataagatatacaaatggccaaaaagcatgtaaaaagatgcccaacaggtgggcccctgagcgggcgtccgggaccgtggtgtgccaggcgccttccgcccttaacatgcggtggctggcccaggcggtgcaggagctggagcggggcccgagtggggcgccagagccccagcgcgagcaggagaggggccggagcgcggatccgcgccgcgctgctgaagcctggccggccacccagacgctgccggcagcctggccatggcggagccaaggaaagaatctctatacaaacaaatatgtggctatcaaattggagctgatcaagttccggaccccgcagctgcacctgggtaccggttctacaagcagctcagcgccatagagggcgtccctcaggtctactacctactacagcctggaggacctgttcgaccttcacgcccaagacggtgctcctgatcgccatccggctgatcacgcgcatggattatgtgcacaccaagaacctcatttaccaggacgtgaagcccgagaacttcctggtggggcgcccggggaccaagcggcagcacgccatccacatcatcgacctcgggctggccaaggggtacactggtctcaggaccaagaagcacatcccgtgcagccagcacaagagcttgacaggtacggcgtgctacatgagcatcaacatgcacctgggcaaggagcagagccactgcaacaacctggaggtgctgggccacatgttcatgtacttcctgtgcagcagcctcccctggcaggggctcaaggctgacacgatcatgagcggtacagaagatcggggacacatagcgcgccacgcccatcgaagtgctctgcgagaacttcccagaggagatggctacgtacctgcactacgtgcggcgcctggactttgagaagcccgactgtgactacatgcggcgcctggactttgagaagctcgactacgactacctgcggaagctctccagctacctcttcgaccgaagcggcttcgtgttcgactctgagtacgaggggctcgggaagcccttggcgacccccatcagcagtgtccacaccgacctgccctcccagcctcagcttcgggacaaagatcagccgcacagcaaaaaccaggcgctgaactccaccaatggggagctgaacgcggacgaccccatggccggccactccagcgcccatcagggcgcctgcagagatggaggtgggcgatgaaacgaaatgctgctgtttcttccccctgaatcttctccgtgcggccccttggggagcgagcttgtgtgagggccttggggcccacccacagcggcccagggccagacgctggctggaagccaggacacagactgcagggtcttggccggcggccccatccccgggacgaggggtcacttccttcacgtaagactggccaaaatttcttttttttttttttttttttttttgagacggagtctcgctttgtcgcccaggccggactgcggactgcagtggcgcaatctcggctcactgcaagctccgcctcccgggttcccgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagactggccaaaatttctacacctgtgtctagtcctcccctccaagagcattaactatttaaaacaaggaataaaggaaaaaaaagaaaggccccctccacccccacccctccattactttgctgaagtgagtagtgggatcctggaggcccccagggctgaggcccagccagctgcccccgttagcgtcataaagtccagcttgtctccctcatccaaaggccgttttctcagtgggagggcaggcctggcctggaggggtgctgtggggccatcttgcccaggcccacctgggagggacacaggcattgctgccaggggtgaggctgtgccccaggcctccccaaaactaaaggggaacggaggggtggggccgcggctgaagccagccccgcaaccaaaatgctgcaccaaagctcggtcgccacaggcacggccaccgcagcctttcacagcctggccccggcgaggggcaggtgggccctgctaggagggtgcttctcgaggcacctgttccccgaggctgtgctccgaccctcagaagctgaggggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgcgggcggccctggactggctggcggactcccagcgggtcagcttgaggcagtgcccagggcggtggccgtgagtctggtttttgctttaccaagtgtacggaaatggcgtttacgtttctctgatgctcttttgaagccatacaacttaggggctttaaaaaaaaaaaggaaaaatgaaaccctccgaaaaaaagatgcccaacatcattggtcattagagaaatacaaatcaaaaccacgatgggataataataggtctacaaggatggcaaaaatcagaaagacaaacaataacaagtgttagagaatttggactaatttggatgcagtatattgctgttgggaatgtaaagtggtgctgctactttggaaaacagtttggccattccttaaaagggtaaacaaagagttaccatatgactcagcaattctacttctagatatatatgcaatagaaatgaaaacatatccacaaaaacttgtacatgactcttcatactagcgttattcacaatagaaaaataatagaaacaaacccaaatgtctgtcaggcgatgaatggatacagaaaaagtggtatattcatacaatgaaatattaatttggcaataaaaggaaatgaagtaatgatacatgctctaatgtggatgaaccttgaaaacattatgctgagtgaaagaaggcagacagaaaggccacatgttctaaaattagattgtgatatttgtacaatgctatgaataaactaaaaacattgaattttacactttaagtgggtggactttatggtatgtgaattatatctcaataaaggtgttactaaaagacaatatagagtgttctttgtttctctgaaggacaagtttttaacttccatttctccaaataagcaattatttgtttttataccaaattagcattttcagattccctactgatgttactggattaagctatgtttttaactttttgttaatttctacattttttgtttcctactattgcttctacattttgtgcactgaaggaggtagtatattgattttacacttacatttcttgtactttctgcctatattagtgttatccacatatccttttgtctcacatttatatttaatactgttagctgtgttttctaagtatgggataatacctttcagtatgctgtaggtgactatatatagatagtacgtttgtatttgaactatttggaagctgaccaaatgtttttattatcttgtagattttactttcctcgttggtattgcagtggcagcaacagagcctatcggcatggaatatctcgaggtgctgaagctcctcttcttgatgactttgtcatgtcttacctctttgctcaggtatgattatattatcttacttgtacatgagttaaatgataaatatcttgctgtttaataagtcacttaatcaggaaaaactttacatatgggaaaattgcagttctgtcttgcacagcaggtgcagagaagtaacaaaattgagtcttttagcactagtttttaatcccatggtttatggataatagaatctattttataaagtttttttggactgatccttttgaatttctttcttttttaggactttagatcattttaaggatttcgcaaagtatagactgaggtttacaacatgattcatgtagacatacgtggctaaaatattagtaacatttctttatggtttttaaaaaaatttttggacaatttcaggcttacacaatggacaatgaactgtagagaaagtaggttacataaaaaaatgagctctgatagtttgtttagctgtttataggaaggtgactggatgttgatacttagtctaagagctatattcaagttatttgttcactaatacagttatgtcaaatttttgtattgtgttggtatttcataatgctttcttctctattaccttgatttaaacagtaattgaaatattttgtcattaaataacttgtttttatgtgctgctagactagtaggaatagaaattaaaggaagaaaatatattagtgctcttgggtaaaaataggcacttggtatccccaaggtatcaggagttctaaatcagatttgctaatattgtaggaaacaagcccacagatcctcatggctcgcatttctgagaggaagcctagtaagcctagttcagtttatgaacaacaaaaggaaaaacatttctctattggggtatgagaccaacaaactttatttttattgtggtaagagatatataataaaaatgaccattttaaccattttaagtgtacagttcagttgtattaagtacaaatacattgctgtacaaccatcaccaccatccatctccagaacatttttcatcttcccaaatggaaacttcatacccattaaataataactctgtatttcccactcccaatggccttttgcaatcaccattctactttctgaatataaatctgccttttctatgtacctcatacaaatggagttatatagcatttgtccttttttgactggcttatttcacttagcataatgtctgtcaggttcatccatgttgtagcatgtgccagaatttctttcctttttaaggctgaataatattccattgcatatgtatactgcattttatttgttcattcatctgttgatggatacttgggttgctgctgtgaacatgggtaaacaaatatttccttgagtccctgttttcagttcttttcaatatatacccagaaatggaatcgctggatcatatggtaaatttataattttttttgaggaactgctacattgttttctgtagtggctgcactatttttcagtcctaccagcagtgcacaagtgttccaatttctcaacatcctcaacaatgctttgctttgtttgataatagccatctctatgggtttgaggtggtatcattgtgattttgatgcatacttctctaacaaccagtgatcatgagcatcttttcatatgcttgttggccatctgtttatcttctttgcagagatgttgcttgttggctatttgtttatcttctttgcagagatgtctactgaagtcctttgcccatttttaaatcaggttgtttgtttgttgttatattatagaaattattattctggatcttaactccttataagatacatgatttgtagatagtttttcccattctctaggttgccttttcattctgttgcttgtcttttgatggacaaaagttttaaatttggctgtattctaatttatctattttttgtttcctatgtttttggtgtcatatccaagaaatcattgccaaatccaatgttatgaacctttctttctgttttcttgtaagagttttatcattttagctcttacatttaggcattgggtccattttgagttaatttttgtctatcgtgaaggtaagggcccaacttcttttgcttgtgaatatccagttttcctagcaccatttgttgaaagactgtcttttctccattgaatggtcttggcacctttgttgaaaatcatttgaccaccaacctacttttttatacagctcctttatctgtatagccattatgaaaagagaggggaatggagagaggcttctaagaatagccttttgaaaacaggatattatgaggttacaactttctgttgcttttacgggtatattatttcacctgtgctgcagagctagtatattttgggggtaggctagttaagtcccatttataagccaagttttcccaaactattcattcagctactttagcctaatattaatactgcaatgtctagtatttttgatctagaaaaattttgggtgatttcagaatactcaattttatccttctaggaaggattgtcttatctagcatggcaaggtaattccaccatataattctaaattatgtctagatagtaccacaagcaattttctattttttaatgtttttacttctctaaatttgtgcccagaaaatatgatagtatttagattactctaagattgtactgttatcattttatattatatgcatgttgtagactatatatagcaaatgtgaccagtggcattaccagagtgtaagaatatcttgacatctttaaataaccaaaaaatagataagccactgaactgtctttaaagttcttaagacagtacctgtaggaagacagatttggaaaaggtaagcaaataaaaatcaaaagtaagatggcccttttaaattcagtttcctctgggaattaattgcctttatatcatcaaatatggctgctaagcaaataaactgctgacatgtgaacaacttttaattaattcatatctattcaacaacaattggatgtttacctcatgttcttggcatcatttctgattttgtgactgtgactgttttttatttccctggctaatgaagatgtaaatttcttaagttcaaattttgtcagctactcaaatgagaaaaggttttctttcttattttatttttttatagagattgaactcctgggctccagtgattgtcttgcttcagcctgtcagcctcctgagtagctaggtacaggtgtgtgccactatgcctggctaatttttttagttttggttttgtggagatggggtctcgctctattgtccaggctggtttcaaacacctggcttcaaatgatcctcctacctcagcctcccaaagtgctgggagtacgagtgtgagccaccacacctggcctgaaatttttcagtagttctaattaaatgaaatttctgagggtacatactataatatttaaggaatagtatttattatgttttggcatttgagactcttccatttgtaacttttctctagtgaatagtttattatgtttttagtattgccatcactcatttttcatatatttattgtcttctgatcatgacttccatagaatttccacatgagcagaatttgttatctaccagttcttttcttttctttctttttttttgagatggagtctcccactgttgcctgggctggagtgcaatggcgtgatctcggctcactgcaacctctgcctcccaggttcaagtgattctcctgactcagcctccctagtagctgggattacaggtgcctgccactacgcccggctaattttttgtatttttagtagagatggggtttcactatgttggccaggctggtctcgaactcctgaccttgtcatctgcctgccttggccttctaaagtgctgggattacaggtgtgagccactgcacccagcccatctactagttctatagggaaccaaggcaggctattaaaaagaatctaccaagtcattgatcatcttctacttaaacagtataacttacttgcctgttctcaaaagtgtggtgaaataagtgtttaaaattgagcaaaaatctgtctcctaccctgaattaattttgtattagcaacgtttaggcctttgttttgggtgatactgattatttgatggtgtggttcttaatagtttattttcttatatgaaaatatcttctatattttattaatagaaaagcaaatatacttttaaatatgtttcttttaataaaattagtttaaaaaggttccagtaaagctttaatttcatgagacaagttattacatcaagagaagagaaatacagatgtagagtatagagggcccttgtccggtttaaaaccttgattcgcattgttattttaggtaatatggctcttacctttttttctacaaagaaaattggtattatgtttagaatatttgtacttctgctttctttttctttctcccattacatgttcagtcagatttatctgtattcctaaatcctccaggtcaaaatcgtagaacctctgtgtttctctcttcttcattctttagacaatatatagttaataaagttatcagccttttttcagaatcttttagtatcttctgtttcctggatcagatccttattatttcgtatctgagccatacaccagcctcttaaagagcctccgtaaatacactttattttcttcaagcacttctatcattgctactactctgccaatggaagagacatgatgaaaacagatctccatagtttctaggatcaggtcattcaagggtacctgcagtcggaccccaacttacttttctaagttttaatccacattatttcttcacataaacttcaggccctaatcaaattagtttatgcatctgaacatatctggtgcttttgtgtgtgtgtcattccttctatttctttaccctgttttgtgtccatcatacatttctttatttttaaacacactgtgaagtttcaaatcttccatgaaaccctccttgattactccagctgaatataatcttaactttctccaagttcctgaaggagcttttgtgtggtgcttcctatatcatgtctggtgttataattatttgcttctgtttcgcttctaagctaaattttggtccccttgatgactgagaccacatcttatacagtcatgtgtcacttacttatggggatatattctgagaaatatgtcgttaggcaattttattgttctgtgaatatcatgtattgtacttatacaaacctatatgttatagcctagtatatgcctagtctgtatggtatagcctattattgctctaggctacaaacttatatagcatgttgctgtactgaatattgtaggcacttgtaacacaacggtaagtatttgtgtagttaaacatatctaaacataaaaaagatacagtaaaaatgcagtattacaatcttatggaaccatcgttatatatgtggtctgccattgaccaaaacattgttatggggcacatggctatttctttgtatccaacaccacttgtagtatgatacttccaacataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatcattttagagactgggtcttggtctgttacccagactagggtgcagtggtgtgatcatagctgaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaattatgattaaaatataatcatagattaaaacatgataatgaaacttacgatgagatatttccttcaaatttttggttttagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcaggtaattttcttttgcaaatccttacacataagtgtgagtagagattttatataattcgtatatattttctgtgtttacccatgccttttgattttgtaatactagttaagtactccttatctaaaatgcttggaatcagaaatgcttcagattttggatatttccagattttggaatattggcattgaacttaccagttgagcacccctaatccaaaatgctctaatgagcatttcctttgaacatcatgttgacgttcaaaaagttctggattttggaacatttcgtatttcagatatttgcaagagggatagtcaacctataataaaaaatcatatgggtaagttttatatcttgggagtaaaacacactttgtaaggtgaaattatttaaagagttgtactacaggaaatatcataggtattaaatatctattatttgatttcatttattctgagaaggctagggaagttcagaggaacagaagaaacacctggaggcatactttttgatagaagatcctccagttggctatataaatgacctgaataagtatttcccaaatggtggtgtatattttatttgcattagactcacgtgggggagcctgttaaaatcaaagatttctgggtcctaatccaagagatttggattcagtaaatctgagttgaagcccacaaatatgaatttttacagatgctctagggtattcttatacaaatggtccaaactctgcattcttcaaattattcttctgcatattgaacttgacaatcatggctaatataaaactgctttttaaaaaggtatatataagaatggtttaagtttgaaggcaaatatgtattttatatattacatacttcccagattaaaaatttgagtacatcatgagtgtggttaaagcttccttttttgaaattgttctcccaataactggcttcagtcatttctttgccatgtcatcaaaacagttacatacccaatttgcagagtatcaatttctgtatttctctctttggttttaaatattcttgttttactttcagatgtctgttaggtcttaacctaagggtgtaggccatagggtataattttaggaactcagaaatctagaagattccaaagcccaaaggaaaaaaaaaacacattcattcattcaacagctacttattgaatacttgctgtatgccaggctatagtagaacatagttggaggaagagtatcttagatgtcgttacatagaaactgaaggaattcaggggaacacagttgaagaacagaagctttgacccattgaagatgaatgttataaatatgaagccatctctagacttaagctatcgtggaatatttctgctttggaaaccatgctgtcatccaaagtcttggcacaatctttctatgtagattgtagtttcttccagtttgagaatcatgtcatctattgctcttatccctacattatttagtctagtgtcctaaacctaatgactatttagtaactatttatctgattcttttaactcatgctcttagccaggatataaacacagatgcaaaatgctgcatcatttttttttactgctttactttaaaaatagtgtagatattaaacattcatataagattccatgatattttaaaagagtttattgagataatttacaaatcataaatctcacccatttaaaatatacaatttaatattttgtattatattcacagggttgtataaagatgaccagaatctaattttagaacatttgcatcctttctgaaagaaaccccatgcccattagcattcagtcctcatcccactttcccccagcctctggaaaccacttatctttttgtttgcgtggattttcctgtctcaaacatttcatataaatagaatcatgcaaaatgtggtgtggcattttttttgtctggcttctttcacttaatatgatgtttccaaggttcattcatgttgtagaatgtatcagtacttcatttctttttattgctgaatcatttcattatatagatataccacattttgcttatttgttcttcacttgatgaaaatgtgggctgcttccatgttttggctattgtgactaatgtggctatgaacagttgtatatgagtaattttgtggatgtatttttttcattttttcttgtgcatatatttaggagtggaattcctggaacatatggtaactgtttaactttttgaggaactgcttaacttttcaaaagcagctgtgccacattacattcacactagcagtacatgaagagttccaactctttccgcacttgtttctgtctgtattttatccatcctagtgggtggaagtgctgtctcattctagttttgatgttcatttctctaatgactactgatgtttggcatcttttcatgtactttttggccatttgtatgccttctgtagagaagtgtctatttgaattcattgctcattttttaattgggttatttgtcttttaattattgagtttagaaaattctttttatattctggatacaagtctccacatataatcatatttatgatttgccattatttcctcccattctgtgtattgttattttactttcctgaaggtatcatttgtagcacaaaagttttaattttgaagtagtctaatttgccccatttttctttgtgtcttgtgccatgtggaaatgtggttttagcaacatggatgtctttcttggttttagcaagagcagtttctcttgaaataatggaacagaagccaaactggaatgagttgagggataaatggaaggcaagaaaatggaaatggctatgtacatgctttcaaaaagaggccagataggctgtggccagaaggaaatgtgggattaagagattttacattttatacgggacggacattaatttagcaagtcctttgtgcctgtggattctacatctaatatgccacagaatgaggtccagaaaggcttcctggattagatggtacttgagccttgtcgaatgagtaactagataggagatggatgattggaagaaagattagcatatattacggcatggaaaattatttaatggtacttcagaaataaaatgttccttagaagcacagaaataaattaccttctttagaatattgtacatagagatgaatgtacagaaaagtcagaatatttctaaatggaattgttttgatcacaaaggaattattaggagttgaagctggcctaacaaaataatatacagaagtatgtttgcataatgaaaatggcttccaacaaaatgtaacaatttccaaaattcaggtaaatgttggagcacagcatcataggaaatatttgtagcacagttcaatatatgccaaaatattatcttataaaccattaactctggtatgtgaaatagagaaaaggaatttttagagattcttattaactagactgaggattcatttcattaggggaagaagattaacatcttcttttgtaaacattgatgataacttagagtgtgtggatatatttatatcatcaaacaaaatcttaaagttttatactgtatggatgggggttatgtcaacttacgccacttggccactgtgttgtaaggcctacttaatcatggaaaaaggtggtaacttctttttcaatttttagatttatcttccaatttttgttttgttttgtttttctgtatgtgcttttttatccctagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggtaatccttaatgatatgttcttgttctttgttattttaagtacaatggaaataaaaacaaagtaattttaatcatttgcaacatggtattgcacttctcccatttgatagaagtggaagtttttaatagcgtgaacctatcaaggtcatataattctttgcctactattcttaaatggttttttcatttaattttttatgacaaaataattaccaatgactatattatagtttcagaaagatgtcaaattctaaaagtgattttaaaggagttttgcctttcactactagtgataacagaaggcataattataaaacttgttaactagaaaagattgatattaattgattttatgataatatatacctgctaaataatgaatttattttaggtttgcattgcaagttttgaatttgttaatatccgtgttgttcatagattgttactagagatttagagggatcattttttaatttttcatctttggtagtcacatttccagttttctggcagtggtttctactaatgttaattgaattgaagagtgccatagcacattttagattcctggcatcatttaatgccctcatttttaagtcaagcaagatacagcatagtcttagggttagattgatagagtaaatcacgtttaatgcttatctattgttatcaataccttttttattttaaagaatttggaaagaatgttgtcttcttaagtcttgttttaaaatggctctgtaaattctacccgtttttaattttacatgcttttaattataggatttacagttatattgcgattttcctaatattattgatgtcagtattaagcaagcaaaccaagagggttcaaatgaaagccgagttgtaactatccataagcaagatggtaaaaatctggtaagtttgctttatgattgaataatggtttcattttatagttctcagaaatgtgtattttagaatcttagtaccaaaattattttctggtaggaattttgattgtagttttaaatataactctaaacatcagttcagtaaactttttgataacatctagctttttgtattactatcaacaccatcttcctacagagtttcttgtacattactgtactttttttactcatttttatgattagcaaagcaccagttactttctcccccatccctactctagattatactagttctctgatgtaatgctcacccctgactaaaatattttatcaacagggatgtatatgtgccagttatactgcctaattaaaggagaaaaaataaatcaatgatgtctggaatttatataacaaaatgtaaatcaatcccaggtcagccccacccaagctgtaggacatggttgattctaaaagattaacgctttctctttttttaaatagcttcagaaatctaatttattttaatgtaaataggagaaatgaattattttatactttgctcttaagtttctcatttatcttctctgtcttctttttaactcagatgcttcttgacccttcctggcttaaactagtcctattaatgttatttgtctatttatcttaagtatttatatggcttacctgtctggctgttccagggttatattaccaaaattgtaactaacttgcaactcacttaattcagcatagttttctgttcttagataaaaatatgatagtacacctactgcctagtagactgtgagccttttgaaggtaaggatcatatttttatgtgtgtttgtaccccctacaccttgcacagtactcagggcctagtttagaaaaagcttgataaatattttatggatgcataaaaggatgattaacaattatcaacctcaatgtggatatataataaatgtttctgggagagtttattgatcttaatgtgaacaaactgtagtaacccaaagaacttctccatgggactgtatttggacttggcttaattttaagtctgcaatacagagaagttaagtaactttccaagggcacagtgttagttaagtggtagggctatttaaactcaaatgcatgctttgaaaacctaagctcttaagtgtgacactaacttctttgctaagtatccgtaaagctccttaaaaatattatactgacattttgttggaattgtgcaacaaactgggaagagttgacatttctttctcatattaaattttttattttagggatacattgtatttctccttgtatacaagtattattttatgtttttcagtaattcttgatcattttattcatattgatacatcatgtttcttgctgaattttattcatgatatgttatgctttttctgttgtttattaaaattaatacttcttctctgtgtattttcctaccaaattatttatggatataggaaagtaatttttgcttattattgcattttcccagtgtattatgtgttagtaacattttgtttttactgtcattttcctcttcattctggcatttatttctctttataattttggtaaaatatatataaaataaaatttagcatcttaaccatttttaagtgtacagtttagtagtgttaagtatattcacttttgcatccaatttccagaactcttttatcttgcaaaattgaagtctacacccattaaataaaaactcaccatttccccctcttcccaatccttgcaaccagcattctactttctttttttttttttttttttttgagatgagtcttgccctgtcatccaggctggagcacaatggcgcgatcttggctcactgtaacctgtgcctcctgggttcaagcaattttcctgcctcagcctcccgatagctgggattacaggtgcacgccaccatgcttggctaattttttgtatctttagtagagacggggtttcaccatgttggccaggttggtcttgaagtcctgacctcatgatccgcctgcctcatcctcccaaagtgctgggattacaggtgtgagccactgtgcccagcccctctactttcttattctatgaatttgactactctagatacctcataaaagcaggctgaaacaatactgtctttttgtgacaggcttatttcagttagtataatatactcaaggttcatttgtattacagcatgtatcaatttccttcatttttaatatatgtatgtattctgtgtcatgtatataccacatttgttcattcatccatcaatgaatattcaggtcacttttttactttttgacaattgtgagtaatgctgctgtgaacatgggtgtacaaatatctcttgaaaactctgctttcaattcctttggatatataccttctattagtccgttctcacactgctataaagatactacctgggactggataatttatttaaaaagagggtttaattgactcgcagttcggcatggctggcccaggaaacttaaaatcatggcagaaggtgaagggcaaggaagccatgtcttacatggcagcagaagagagacagtgtccaggggaaagtgccacttttaaaccatcagatctcatgagaactccctcactatcatgagaacagcatgggggaaacaacccccatgattcagtcacctcccaccatgtccctccctcgacacatggggattacaattaaagatgagagttgggtggggacgcagagccaaaccatgtcatacctagaagtagaattgctggatcatatggtaattctacttgtaattttttagggagccaccatgctgttttccatagcagcggcaccattttacattcctaccaggagtacattctccacatgctcatcaaaacttgttattttctgttttctgatagtagccatctgatgggtgtgaagtagtatctcattgtgattttgattcacatttccctaatgattagtgttgctgagcgtcttttcatatatgtattgccatttgtatatcttctttgaagaaatatatattcaagtcctttgctcattttttaatcaggttttttttgctgaattatagaaattatttatgtattctggatattaatcccttttcaaatatatgatttgcaaatattttctcccattccatagattgcttttcactatgttgcttgtgtcctttgatgcgcagatgttttaaagttttagctagttcaacttttgttgcctatttttctttttactttgttgagatataacatgaacccagtaaagcacactaatcttacgtgtatagctcaatgaatttttacatatttgtacatctttgtagccacacccacctcaaaaaacagaatagttctcttactcctagaaggtttccacatgcatcttcccacatattcacctccacccctaacttaagatacctatcatctaccatcacttagttttatctattaataaaggttgtataaatggaatgatactgtatgtattcttttaaaatctagattcttttagttagtataatgtttggagattcatttatgttgttacatgtgtcagttcattcctttttattgctgggtagtattgaattgtttgactgtacctcaaattttaaatgtattctgttgatggacatttgggttgctttcactttggggattttagggataaatttaccatgaacattcttatacatattttttggtggacttatgcactctttttttgtatatatatatcctagagataggattattgagtcatagtgatagctttagtatactgccaaacaattttttgtagttctatcagttcactcttctttcagtaatgcatgaaaattacagttgtctcatatccccatcaactcttaattttgtcagtctaaaaatgtcttagtttgtctggtggatgtgtactggtagctattgtagtttttattttcattgccctggtgagtaatgatgttcaatactttttcacttacttattgttcatctgaatatccttcttatgaagtgcctgtgacagtcttttgcacatttttcattgacttgtccctttctgatcaatctgtagagtctctatagattctaagtcttttgtaggatgtttgtaaaacgtatatagacatacgtcagagatatttctagttcagttctggaccactgcaataaagcaaattttgcaatgaagtgagtcacataaattttttggtttctcagtacatataaaagttatgtttacactataatcaagtctactaagtgtgcaacagcattatgtcttaaaaattaatttaaaacactttattgctaaaaaatcctaatgataatctgagcctccagagagttataatctttctgcttatgagggtattattttgatgttgatggctgctgaccgatcagtgtggtggctgcttaaggttgggttggccaaagcaatttcttaagataacaatgacatttactgcatcagtagactcttcatttcgttaaagttgtctctgtagcatgtgacattgtttggtaacattttacccacagtagaatttctttagaaatgagtcagtcctctcaaaccctgccactgctttatgtactaaactttattctaaatcctttgctgtcttttcaacaacattcacagcatcttcacccaggactagattccatctcaagaaaccatttttttatgcataagaagcaacttatctgtccaaattttatcatgagattgtagcaattcagtcacatcttcagctctacttctaattctagttctcttgctatttctaccacatcctagtgacttcctccattgaagtcgtgaacccctcaaagtcatccatgagggttggaatcaacttcttccaaattcctgataatgttaacactttgaccttcttccatgaatcactgatgttcttcctggcatcaagaatggtgaatcctttccataagtttttctatttacccagctccatcagatgaatcactatctatggcagcttagccttacaaaatgtatttcttagataataagacttgaaagttgaaattactccttgacccatgggctacagaatggatgttgtgtcaccaggtctgaaaataacatgaatatccttgtacatctctgtcagagcgcttgggtgaccaggtgcgttgtcaatgagagtaatactttgaaagcaatctttttttctgagcagatcttaacaatgggcttaaaatagtcagtaaaccatgctataaacaatagatgtgctgtcatccaagccttgttgttccatttatagagcacaggcagagtagacttagcataattcgcagagccctgggatttttggaatggtaaatgagcgctggtttgaatttcaagtcaccaatggcataggcccttagcaagagggtcagcctatcctttgaagtttgaaggcaagcactgacttctcctctctagctgtggaagtcctagatggcatattcttccaacagaaggctgttttgtttacatttgaaaatctgtttgttagtgtcaccatcttcatcaatggtccttactagatcttctggataacttgctgtagcttccacatcagcatttgctgcttcaccttgcacttatgctgtgcacatggcttcttttcttaaacctcatgaaccaacctctgctagcttccaacttttcttctgcagcttcctcacctctctcagccttcatagaatttaagagcattagggtcttgctctagattaggctttggcttaagggaatgttatggctggtttgatcttctatctagaactttctctgtatcatcaataaggctgttcactttcttataatttatgtgctcacaggagtagcactttcagtttccctcaaggacttttcctttggattcataacttgcctttttagtgcaagaggcctagctttcagcgtgtgttggctttcagcatgccttcctcactaagcttaatcatttctagcttttgatttaaagtgagagatgggtgaatcttcctttcacttgaatactcagtggtcattgtaggattattaattggcctaatttcattattgttgtgtctgagggaatagggaggcctgaggagagggaaaaagaaagggaaatagctattcggtggagcagtcagaacatatacaaatttatcacttaagttcaccatcttatataggcccagtgtgtggtgccccaaaacaattacagttgacccttggacatcacaggtttgaattgtgtgggtccacttatatgcaattttttttcagccaaacatggatggaaaatatagtattcacaggatgcaaaacctgcatatgtgtagggctgacattttgcatatatgggttctgcagggctgatttcagaacttgaatatgttcagattttggtatatgcaggggtcctgtaactaatcccccttgtattctgagggacaactgtacaatagttacatcaaaggtcattgatcacaaatcaccgtaacaggtataatagtaataaagtttaaattttgtgaaaattaccaaaacatgacacataggaagtaagcatatgctattggaaaaattgcactgatagacttgtacttgctccacttaagtttgtcagaaaccttccatttgtaaaaaaaaaaaaaaaaaaaaaaaaaaaaaaagggtcatatctgcaaggagcaataaagggaagtgcagtaaaacaaaatgtgtctgtatatcaataagagggatactagttagtgaactgctagttcaaagggtatgaatatttacaactttgatagattattaaaatacttctcaaaaggtgtttccaatgtatctgtacacctgttttcttgtatcctttgccaacactggatgttatcaatcttttaatttttctgccaaatcaatgggcaaaataatgctgtcctgttatatttcatttccttaattagaacctgagattgagcaatacctcatgtgtttataggtcagctttaatatttatacttctgtggattgccttttcatgtcctttgactagttttctttttttatttttaattgttttatacgttttattcccacaatgtatgttaggtatattcctttgttatacatgtttgtaatctccaagtcttttaattttgtttaggataccttttatagtacttgtttttttggctatttgtgttagctaaataccttttatagttcaaacatgtcacatgcttgtctctttattataatttttggttgaggactctattctgtgttctctttatgattatgtaaatattgttcattgctgggccaagaaatatgctgtaatcacattttcgttcttatataactttttccaggagttaattattgctttatgatttttcctttgtatctagctttattttcattttctacaagaactctgtaaagtagtggacttctcaatacaaaatttcacataatcaaacctgtcatatatgatagcatttttacttcttttctggagaagtacctcttcgatcacagcatcttactttgtagtgtggactggaagttttctgggtacagctattattttgtcagctgtaatttttggtcattcctttcttatcctggtaactatgttttcatctctcttatattggatctgattttctaaatctcatgtttgccctgtttttctaggtacagcctctggtatttgttggtatctttaatgtgattgagacaaattagaaaattaatttagagaggatttttacatttttatgatattgaattttcctaccatggttaatcttctatatatttaaataaaaagttgcataagagtgttttgaagtttttgttaattattgatattgcatcctctttgttacaaatggggcttttttcattatataactgactttttgtatgtaaaaatataatacgtctatatattttcccatgtaagtaacatgctgcatttttggctgactacatgttcacatatgtattaagatacaatcaggccgggcatggtgactcacgcgtgtaatcccagcactttgggaggccaaggcgggcggatcattaggtcaggaatttgagaccagcctggccaacatgttgaaactctgtctctactaaaaatacaaaaattagccgggcgtcttggcgtgtgcctgtaatcccagctttttgggagactgagacaggagaatcgcttgaacccaggaggcagaagttgcagtgagccaagatcgcgccattgcactccagcctgggcgacagagcaagactctgactgggcgggggccacaaaaaaatcatagcatagctacatatcctaacattttagtttgtagcatgaatactttagcagtatgtaattggtatgtagggctgatgccgtggctcacgcctgtaaccccaacactttgggagactgaggtgggtggatcacttgaggtcaggagttggagaccagcctggccaacatggcgagaacctgtctttactaaaaatacaaaaattagctgggcatggcggcatatgcctgtaatcccagctactcatgagggtgaggtgggtggatcgcttgagcctgggaggtggaggttgcagtgagccaagattgtgccagtgcacttcagcctgggcgatggagcaagactctcaaaaaaaaaaaaaaagaaaaaaggaaatgctcatgatttctaatgtcaacttttatatcatattaaatagatttctagctgagataactggtatattagtctaagaaggacattggaaaataaagtaaaatgatggctatagagtgaactataactgggaaggtatgataatctgtatttaggaggatcttaaatatcagacatgagaatttgtaattcatattgagtactgagccataaaagatatgagcaatttagaagaaaattgtatttaacatggaatgaagaaaattttcaatatttaacatggagttgactttctaaaaggtgctatttctttttcttttctctgcttaggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgtgagtaatacagacttaaaagtaaatttttagaaaagtaaatgctgtatttacaaagaagatttaacagagtgatacatgtatgtttagaaaaaaataatttgacaagttttttttaaacaaaaggctatttgcaatcagattacataataattagaattatttagtgtataatttaccatctgtatcccaatctataatatttataagttgtacaagtttaacatttgttaatcatgcctatgtgtgattcactcctgcatgttactaaaaaagaaagatctccaatttatgttttattaattttaaaatactgcaaggaagccacagtgcaaaatttgaaaattctttatgtttggatagtccatctccttctactgaaaggttcaaacacaagatatatatgatgtccacatttctagactagtgctatgtagaacttcctgcagcgatgaaaatattctatatctgtgctgtgtaacacagcagccactagctacatgtggctgtttagcatttgagatgtggctaatgcaaccgaggaactgaattttaatttaattttaatttctttacatttaaatagctacatgtggctagtaactatcacattggctcacacagttgtagatccttactttaatactgggtaaagctagctatcatgcataacatctatttagcttaagtcctaatgatctcttagctaggatgtggtttatgttgacaacagatttgaataactcgagcaaagggaaaatctgggatcatgagcatattatgttctttgcatttaacctacccctaaatatttgagaaaatacatcttgggtaatataaagagttgatttagtctatgcttaatatttatttagtaatgaatattgttgctatgaaaaagttgtactacttgaactttatgtctgtaatttacatgtttaatatttttaaaactccttgcctttattcatgtatccataaattcattcaaacattcttttatttatatttactgagtaactactatgtgcaagcattggtttgtatattagaaatatggtgataagtgaaacagaatgattctttcttttgtatagattatattttgcttttctttcagggtgtgcagcttcagaaaacataaaaaattttaaaaaccagtagtctttgtcagttgccatggttcttctcttagactttgttatcgtactgaataataaaatcatgcattcagatttttatgtcagtaactgctatggtagtagagatataagtattttctgatatataatctttatagttaaatgaaggtttctgagagtatggttttaaaaatattaactttgtaatcagcaggcagaaaaatcaaatgaacaaattgttctttgtgattttgtcttataaataccttttattggtttttaaagctatataattgtcccttgaagtggtttgaacttactgcaaaatagcttggtactttgattttttcctttgaaagattattgctaaacatataaagtagaggagacaattctgacagttttagatttgacttttgattgttttagatgacacttggtcataatattatggtgcttgatatattattcaaattgcttcttctttacctttaggatggattttgccattagtaaactgaagaaagcaggtaatcagactggactgtatgtacttcgatgcagtcctaaggactttaataaatattttttgacttttgctgtcgaggttagtatgtcacacttattagtggtaacactttatttagttcatttaatttcctctccatatttatttaccatatttcctttttaatactgagaattatagctttggatatgataactagtataatgcttaatttcctcagagattctgtacaaataaacaagttataattcccagggtttatataaaaatataaaataatttataatgtctatctttttattttgcatttattttattttctgatgttttggtgttaccagtgtgttaaaaggtatttcatcaagtgtcttgatgtttctttgtttgcaaaactggaaatctttgccacatcatgtagaacaaaataaatcggaagcaaattttctgtttattaacagtggttgcagaattagaggaaacagaattagagaaaactaggtcaataacaaacaaatagaaacattaaagcacttttaactgatgattttctaatatttttaagaatagtggtctacaatgcatgtttcaacggtaaaactgcaatgaaaccccactgttaatacagatcattttggatctcatctatgattatatactatcacttatgaggcaatttcatggtataaatcctaagaaactatagaagcttgcaaatttatcttgcttttttaaaacagagaaaaataagaactttgttattcaattattttaatttttataaaatgcaacttatatttggcatatgtagagggtagattacttacagaagggaggttatgccatcactttacctttgtgtaaaactggtaatctatcctaatttcaaagtatcctgttactataacagataatagtacattatattcaagtatgaattcaaaaaaatatatatatatattttatgttcactgtatgtgccaagcctaatatgagagctatgtattatagagtttatgctacagccctaccttcaggaaacttatctactggacaaacaaaaattttcaaatatacaaaaaattctaaatcgaacattgtaattatctagcataggcaaatatagacagtaacagacaggtttacaattattaagaaagggcagccaggtgtggtggctcacacctgtaataccagcactttaggaggccaaggcgggtggatcacgaggtcaagagattgagaccatcctggccaatgtggtgaaatggtgaaaccctgtctctaccaaaattacaaaaattagctgggcatggtggtgcgcacctgtagtcccagctactcgggaggctgaggtaggagaagcgcttgaacccgggaggtggaggttgcagtgagtcaagattgtgccactgcactccagcctggcgacagagcgagacacggtctcaaaaaaaaacaacaacaaaaaaaaaaaaaaacaagaaaggttatttggcataggaagaacctgattgaccttgaggtattggtagattttatataaatgtttctgagtagaatgaatatgtttataaaatgcaccttaaaaataggtgaacaagttcataatatagtgcataagacaaatatttaaaaactgcaaaatattaaaaatgtaatattaaagataattatacaaatacaatggtggtgcagtggaatggctgtatgttcacctttgcttgtgcaaagaggtgagcattagagaggacctcttagaaacagtggtacttgaactgagttttgatgaatgaataaaggttcattgctcagaagaagtgggtatacattcttaggtagaaagatagcatgaagaattatcaaggcatgaagcagcatggcatttgcttgaaatgatttaagtcatttaatatggctggaacgtaggttgtatgttggcagtggcaggagctgagattggagatggaggcagaaaccagctcatggaaggctctatatgctacatttgttttaggctttatcttataaatgatggaaaactattaaggatggtattgttgctattaattatcattgccttcttacatgctttttcataaaatcaacttttaaaccacttttgtaggctgagaaattgtaaattgcccttttgaggaactaagtacttctatcactatactggcactacatcggattcatggttcaaatgtttattctgttgcttgttcttgtgatatcattttgtcagaataatcactgtgatgtccattgtgactatccctccctttctttataattaaacttatacagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaaggtaagataattttctagttatttttaaattactggtcatggattgtttatgtggcgtgaagtatcttcagtacattgatttcaaaggatatatgaaagaagcagctctaaaagttaattttatcttattctattgtacaagcatcatcaaataagattgtttactttggttttggtggtctagaagtgacttgaagttcaattattctaaaatgagattttaaacataatgtgtggtatgatgtcatttattgaactggaagatctcactactaaattcttatgttgttttaagtaaaaattttcatatacttcgaggattttaatttctgtattttaaaaataaagacagtaaagttggaaattccttgaaataatgagccttactattaaaaattattaaaattcctgaaaaattgtatgagttaaggaagttactataattttgaattaatgaaataactggcaggaatacatcaaaatccaaattacattagttaaggaagtgattataattttgaatgtatgaagtaactaagaagaaatatcaaagttcaatgagttgacccctaaaataattttctattataaaaaaagaacaattaggagttattaagcatttcttatacgtagaacacatttcattttactcctctttggagcaattcatactttcagtgtattttgaagtgatatatatgtattttattttttcagataaatcaaaccttctagtcttcagaacgaatggtgtttctgatgtaccaacctcaccaacattacagaggcctactcatatgaaccaaatggtgtttcacaaaatcagaaatgaagatttgatatttgtaagtcattagatactcattactgtcttttttgtccttttaaaacaacatctgttttcttgatttacattcatgtgacattggaattattttgttatatacaaatttagttgtgatttaaatatttttcttatgaaaaatatgccaaccttgtgttagatgttagcaaaattaattatcttaattatcctaagaatggaatcttaattttctttttggaaatttaaaaatgattcttcacaaatctcaaattaaaaattaaaaatctacaaagacctatatcgcaactcccaagttctcaagaaagtaagggaaattcaaggggttaaaaataaagaagaaactgagaaaaaaatccagccatctctcagtgtccatgagggattggttccaggactacccatggataccaaaatctgaggatacttaagtggaacctgtggatatgaaaagttggccctctatatacatgggttttgcatcctatgaacactgtatttctttttttaaataactaattattttttaaaattatttatttatttattagagcaggacttgctgtgtcacccaggctggaatgcagaaatactatattttccaactgagtttccttgcagatgcagaacccgccctgccagtacagagggcccactggatttattgaaaaaaacccacatataaatggacctgtgcagtccaaacccatgctgttcaagggtcaactgtagtacataagatctgataatctggcagtcaggtggtgagggttgatgatcagccacatttatcaagggggttaagatttaagagcaatttaaaagggccaggtctcagacctgtgcaaggccacgagttaaaagtgagactatccctgagtaaaaccaggacacttaagtaaatacatcctcagtaaaacaatatatagaatgtgaaaaattcacccactagcaagcagagaagaaaaggaatattgtcatttttaactgcgcttctggtgaggaaaaggagtctctcctaagaatttgtcatcataagctttggaatttgggcttcattatactacctacatagactgagaaatcctaaattaaaagtggtactctcctaatattgtgtggtgcttggaagaaacaaaaaaatcttttcggaaccacatactcttaacctaggcaacccataattcccacagataaaagcattgcaaacacaagcttttaatagaaaatttagaaacatacaaggaaataatgcaggattaattaagagtcagtagaccaacaaacatcaaaattagaactccaggaacttcctatcacagaattttcagatacagactataaaatacatatacatgtttaaagatagaaaaggaattgaaaccacggagaaataacaagacattgttttaacaaacaaaaaagatgtcaggaaaaaggcatagaaatgataaatatcctcattgacattaaaacagaatatacaggatgaaaagtaaattacttatagctgaagagagatgtagtgaacctcaagacagatctgaagaaattaagaatgcagcagttagggagaaagaaatggattatatgaaagagggattaagtggcatggaaggcaaaatgagaaagacccaactcatatctgagctctataaggagacaatagatagaattagccagaatggtaaagacaagcatcttcatgtgagtaacaggaaacagagtggccaggtaacttgactaacattacaaatctaataaatagtagaccttggatttgaacacaagcagccttactgcagagtgcaggctttcaacaattactttgtaaagatatgcaagaaatactagtattagtagtaatagctgatacttaatgcacatttactatgtgtcatggactgtgctaagtgcttttatgtatttattcacttattgatcataacaatcctatgggaaaatagttattattctcatttttcagatgaagaaaccacgacagctgcagcacagagattaaatagcctgtacaaggtcatacaagtggtaataagagaaagtcagatattctgcctctgcagaccacattctctagtgtgctagtaggaaaggcaaagaaaatgattcccatgtaagcaaatgtaggtaaacactgactctatttttaaaaagtgacaattatagcccattcaggagatttcaaaaccgagtagagccaaaatacacttaattcattaatccttgttttctgtctcttattactatttaaggaagcagaataaaagcattaatttggagtcttaaatctggatttagattctaaggaaaatacttgcttatggatttaaaaaaattcttcctcattgaatgtattttcttgttcctacttcgttctccatctttactcattcttttcttttacctttttctcttgaagaatgaaagccttggccaaggcacttttacaaagatttttaaaggcgtacgaagagaagtaggagactacggtcaactgcatgaaacagaagttcttttaaaagttctggataaagcacacagaaactattcagaggtgtgtatgttctttatattgttcatgtagtttatgctgtttaaagatgtgctctcatatgcatacaacgtactcatgtgtgcagcttttcaaaattgtaatttttaaatgtgtcaaggacttttctgaggatacattcttgtggggctatagaattacagggtttgaaaattaccggattaaaaaaattaattccaaactaattatgtttagcattatgttaggagtgttattacatttctgcatatactgtggccttgattttcaaacttggctccccagagctttatgggttacacagaggctcctctacaattacatttatttgaaaaaaaaacaaaaaaccaagtttcaaaggcactgtactaaggaacatgcttagtgaaatctagatgcctctgggcatcatccagagatgctagctggcagaccccgtggccagttgccagagctctgaacatagcaagatatgatacttacaatatcttaaagggtgttggtgttagaagatgatgtgaaaagttcaagccaaagagttgttctaatccagaataccacagtattggtgattgtgattcactaatcatacccaggggttctagtcacagtttagttgaattagagtgatgttaaaactatgctagtatcctgacacagatgtcgtgatattttatctgcacattcttaattctttagcaagtgttatttaaaggctacatccatctacctcagtttcctatatctatctctgacatctacctctagttgtacttctgtcctctatttcaggtgttatgggtcaagcctgtttgactggcattattcatgattcctgtaccactcttgctctctctcactttgatctccatattccaggcttacacaggggtttcctcagaacgttgatggcagttgcaggtccatataaagggaccaaagcacattgtatcctcatctatagtcatgctgaaagtaggagaaagtgcatctttattatggcagagagaattttctgaactatttatggacaacagtcaaacaacaattctttgtacttttttttttccttagtctttctttgaagcagcaagtatgatgagcaagctttctcacaagcatttggttttaaattatggagtatgtgtctgtggagacgagagtaagtaaaactacaggctttctaatgcctttctcagagcatctgtttttgtttatatagaaaattcagtttcaggatcacagctaggtgtcagtgtaaactataatttaacaggagttaagtatttttgaaactgaaaacactgtaggactattcagttatatcttgtgaaaaaggaaagcaatgaagttaaaagtagaaggttacaatgcccaaacaatagagtattatagtaaacaaatgtctataaaacattttgtgttcatgatagcaaaagagattatggcaggttcaacataacattggaataactggccttttcagtacaaacttatctggaattatgaagacaaagcatataaatgatacacttaatttttaatggaactgacagaaatgattatgttgatatgatactagatatattttttggctaaatttaggtgttcacagaaactactaaaagtataaatcgtaccccatgctttaatactatacaggcatgcctcattttattgcaccttgctttattgtgcttcttagatattgtattttttacatattgaaggtttacggcaacccagtgtctagcaactctgtcagcaacattttcccaacagcatgtgctcatttcatgtctctgtgtcatattttggtaattctagcaacatttcaaactttaaaaaaatcatatggtgatctgtgatcagtaatctttaatgctagtattgtaattattctggggtgtcccaaacagagagaatataagaaggcaaacttcatagatgaatgcagtgtgtgctctgactgctccatcaatgagccattcctctgtctctctccctctcctggggcctccctattccctgagacaacaatattaaaattaggccatttaataatcacacaatggtctttaaatgttcaagtgaaaggaagattcacccgtctctcactttaaatggaaagctagaaatgaagcagcaaacgctgatgtggaagctgcagcagttatccagaagatctagcaaagaccattgatgaagatggcttagagaggaaggcatgctgaaagccaagacaagctgaaagctaggcctcttgcactaaaaaggcaagttatgaatccaaaggaaaagtccttgaaggaaactgaaagtgctactcctgtgagcacataaattacaagaaagtgaaacagtcttattgatgatacagagaaagttctagatagaagatcaaaccagtcacaacattcccttgagccaaagcccaatctagagcaagatcttaatgctcttaaattctatgaaggctgagagaggtgaggaagctgcagaagaaaagttggaagctagcagaggttggttcatgaggtttaagaaaagaagccatgtgcacagcataagtgcaaggtgaagcagcaaatgctgatgtggaagctacagcaagttatccagaagatctagcaaggaccattgatgaagatggtgacactaacaaacagattttcaaatgtaaacaaaacagccttctgttggaagaatatgccatctaggacttccacagctagagaggagaagtcagtgcttgccttcaaagcttcgaaggacaggctgaccctcttgctaagggccaatgccattggtgatttgaaattcaaaccagcgctcatttaccattccaaaaatcccagggctctgcgaattatgctaagtctactctgcctgtgctctatacatggaacaagaaagcctagatgacagcacatctgtttatagcatggtttattgactattttaagcccattgttgagacctgctcagaaaaaaagattgctttcaaagtattactgatcattgacaatgcacctggtcacccaagagctctgatggagatgtacaaggatattcatgttattttcaggcctggtgacacaacatccattctgtagcccatggatcaaggagttatttcaactttcaagtcttattatctaagaaatacattttgtaaggctaagctgccatagatagtgattcctctggtggatctgggtaaagtaagtagaaaaacttatggaaaggattcaccattctagatgccaggaatagcattcatggttcatggaaggagatcaaaatggcagcattaataggaatttggaaaaagttcattctaaccctcctggatgactttgagggatatggtactttaatgaaggaagtcactgcagagatggtggaaacagagaactaagaagtggagcttgaagatgtgactcaattgctacaatctcacgataagccctgaaagaaggaggagttgcttcttatggataagcagagaaagtggtttcttaagatggaatctactcctagtgatgatgctgtgaacattgtgaaatgacaacaaagggtttggaattttacataaacttgattgatcaagcagttgcagggtttgagaggactgaccctgtaaagttctactgtgggtagaaggctatcaaacagcattgcatgctacagagaaatctttcatgaaaggaagagtctgcagtgaatttcattgttgtcttattttaagaaactgccacagctacctgaactttaagcagccaccaccatgatcagtcagcagcgattaacatcaagcaaaaagattacaactttctgaaggctcagattatcattagcaccttttttggcaataaagtatttttaaaaagatatattctttgttttttttaagatataacgctgttgcacactaaatagactccattatagtgtatatacaagttttatatgcattgggataccaagaaattcatgacttgctttattatggtagtctaaaaccaaactggtaatatcttcgaggtatgcctttattttagtgcctcacaaagtttacattcaagaaaattgtttatataattccctattttccactagtaatgcagattaaatacacatctacacttgtatgacattttttcatatctttgaaaattgataatcttctcaaaagcagtggtttggaacctgttatatggaggtatctgagaggctcctgtggaccatgaaggaatccaggattgtttttggaagccaacacttgtttttctggcaaaatatgttttatatatttttttaaaaaagttttaaagataaagcagcgcaaaacatttctgtattttttgcagaattaaaagattaaatggagctagaactcaaattctcctttatgtctatagtactatagacaattgttagtaatttttgtgtgtagaagaacttcaggaaggtttgaatgtctaaaaagttatgtggaagagaaattgagaaattttcatttatttttaaaaaccagccataattcagtactaatatataaaggtgtgctggtatattatatattatacatttatgttatatataataatatataattgtttagactcctactcttgctgttgtaagtaaactaaaaaccaaaaatataatgctgtgtatccattaagttttctttaaagttgtgagttttgccaatttaatttctttacctataatggtcacatgtaagtataaagatttaaattacatatatttaattatatttatacttaagccttattattattacttatattttaatgcagatattctggttcaggagtttgtaaaatttggatcactagatacatatctgaaaaagaataaaaattgtataaatatattatggaaacttgaagttgctaaacagttggcatgggccatgcattttctagtaagtagtacaacctttttatcaaaagatactattttattttataaaacaatatacaaattatctttacctggaaacaaaaaataaatctgtaattggatgccaattcatgtaaaatagtctgtgttaggtgataaaaagagattactttaggcatatgtttatgtatgtaaaatcacttttgaaaaaaaagttttgtcatcccatcaatatcttagaactactaatagacaatctgtatgttgtgtcttttggatttagaaaattcaaccaaaaattatgcagaagtatgtgcttctgtatttttgggccattgtacattatggtccatgagaaagcggtgttgacagagaagaataccagggggactgccagtcatcagacccctcagggtgcacctatgtcctgctgcagaactgaagtagtatttcttaatgtcagctcccatccagaaacacaaaccatgtcagccttagaactcatgtgaaatggcattggtagttttaatttattcatttcatcacaagcatagattattgtgttatttaaaatgtaaaacaggaagcataggagtcataaatttccttttttctcaatgcatgcctccaaattattatactatcatgtatttttcttctttaaatctgttttgggggcttgaacatactaaatgctccagtacttgtggactgatatttgaatatatgtgcgtttaactctaataggaagaaaacacccttattcatgggaatgtatgtgccaaaaatattctgcttatcagagaagaagacaggaagacaggaaatcctcctttcatcaaacttagtgatcctggcattagtattacagttttgccaaaggacagtaagttctagaaggattatatataatgttactaagctttacttgggcagtggtgtaaagggcatgttgttaattttccttgaattccatttaatttgtatgttcctgattaataataaaattatcacttttagcaatttaaattgttagttaaatcttagtctctatttttctttcttataagcatataaccatggactgtgaggtgattttttaaaaacagttttaatctctaattatgtatgaaggataggattttatccatttttagtatgaagttttgtaatattccttgagccacaagtaaattttctaaatattcttttcttctcgtcactaaataaaaatttagcctgagattttaggatttttttctatcctctgtgaagaaattagtttaattatccagctaattctgactttttaaaaccttaaaaaaactttgatttgtgtttgttcatctttactacttaacacagtgggttaaaaatacaaatttcagtcagatagttgagaggggttttttgggtctagataattataactgaattttgttatcttagataatttctctaattggatgttctaaatttagattctaaattgatcaatttttgtgcactgatgtgtcctatttaagctaatagtacttaaacttaatgacttatctgacagtgaagacagtgataactgggcagtagtacaggagtagggagtatggcagaaaattcttacagggtcttacatctggtatcctggaaaattttatcctttggaatcggaagtgaagatggaaaaaaatgtattcatatggtgaaggtatttgtcaatcaatctatttgtctgtctgtctatgtcagaataccagaaagtagggttatattgcttcttcctttcttgaatacagtccttctggtggaatcaaagaccacagaaactttacttgagaaattccgtgatttgagcagagcccacctatatcaattccatatatctagaatattttggtgcaatttagccttccatctgccataaatgcttgttggtccttgggtttttttttttatctgcaagtgggaattgccatggctattaaatcattagaacatctctgaatgatgtaacattacctttactacttacgcattatgaagaaataccaaaaagtatcatggggcaattttaggataaactatataaaaaaaaaagatttggccaggtgcagtggctcatgcctgtaattccaatgctttgggaggctgattgcttcctaaagcgcttgggtggatcacttaagcccaagaggtcaaagcatagtgagctgcaatcgtgccattgcactctagcctgagtgacacagtgacaccctgtctcaaaaaaaaaattttttttttttgaaggtaaaactaatggaaagaggttgagaaaatggtatgccagttgagacactatggtttaatggaaagattagttgattcagaactcactgtacaggattctaattctgtctctgctgctaacaaattgtgtggctttgggcagattactcaatcatatgtctccatgttgtcattgttaaagatgaaatattgaattagatgatcttgaaggtcccttctggttcttaagcttatgcagtcatgtgcatgtgcacatccaacccctccaaaataaagaaaataggcctgattattcaaatgatttgaactttaaagctatttacatataaaagattggtttacttgtgaattatttaaccctactctgttcgtatcatttaaaagttcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagagtaagtttatatagactaagttagaattactctatctctgaactttcatatttctttcacatgatttgtattttttagcccatctaattttaaaaagaaggttggtgtggcattacacaatttattctcagtttgtggttctttaattatagaagctacaattttatgaagataggcatcagcttcctgcaccaaagtgggcagaattagcaaaccttataaataattgtatggattatgaaccagatttcaggccttctttcagagccatcatacgagatcttaacagtttgtttactccaggtatgtatttgaatgatcttattgattttccagctttctatctttattgtatttaatgaatcattactaatttttaattcctttaaaacattttcttgatgtcatttgggccctcttaatttcttatgttcatatggcttttcatgctttatacatattctaatctccttgactgagaattattttcatttttataaaaagaccttttctttttttttttttttttttttgagatggagtcttactctgtcgcccaggctggagtgcagtggcgcgatctcggctcactgcaagctccacctccaaggttcacgccattctcctgcctcagcctcctgagtagctgggactacaggcgcccgccaccacacccggctaattttttgtatttttagtagagacggggtttcaccgtgttagccaggatggtctcgatctcctgatcttgtgatccgcccgcctcggcctcccaaagtgctgggattacaggcttgagccaccgctcccagccaaaaagaccttttctttcagtaacctaattttagttttccatttagtgagttgtaaattatagtattttttttttgcttaaattgacttttaaaaaacaattctctttaacatttctcatattttataattgattgattctctaaacatgagctgtatttgttttgctttgttctctcctttttcaaaatactgagctgaaatgcatgtgtttgacctataggtgctttctaccccagtactactcacctttctcacaataagtatcagtatattaccttactttatgaatactaaaacttcttattttggaaaacaaaattttatcctttgcaaagtctctcttgaaggcctgtcagattatgggtaatgattaaaggctcccattaatataattgaaactatttgagtttccctgtatcatttagtatttttaactcacgattattttggtcaacttgaatgtatatcagtttagtccagagaatgttatttgctaatttaaggtgataatattctttatttctccagattatgaactattaacagaaaatgacatgttaccaaatatgaggataggtgccctggggttttctggtgcctttgaagaccgggatcctacacagtttgaagagagacatttgaaatttctacagcaacttggcaaggtaaattgtcagaattttttcaaatagagtataatcatttcatttaggaaaaacttaagagcgtttctaaagttcactttctacaacattttaaggagtgcttgtagaaaaaaaaggtttggttgtcagatgttggagaaatgctgtgttaaataaacagctatctttactgaatgaagggggccagcccctccacacctgtgggtaattctcgtcaggtgggaccagagactgagaaaagaaagaagacacagagacaaaagtatagagaaagaaaagtgggcccaggggaccagtgctcagcatatggaggacccgcaccaacactggtctctgagtttcctcagtatttattactgttttcactatctcagcaagaggaatgcggcaggagagcagggtgatagtggggagaaggtcagcaagaaaacatgtgaggaaaggaatctgtgtcacaaataagttcaagggaaggtactatgcctggatgtgcacataggccagatttatgcttctctccacccaaacatctcagtggagtaaagaataataaagcagcattgctgccaacatgtctcgcctcccgccacagggcagtttttctcctatctcagaaatgaacaaatgtataattgggttttataccgaggcattcagttcccaggggcaggcaggagacagtggccttcctcttttactaatcctccccagcacagacccttcacggatgttgggctgggggacggtcaggtctttcccatcccacgaggccatatttcagactatcacatggggagaaaccttggacattacccggctttccagggcagaggtccctgcggctttccgcagtgcattgtgtccctggtttattgagactggagaatggcgatgacttttaccaagcatactgcctgtacacattttgttaacaaggcacatcctacacagccctagccttaaaccttgattccatacaacacatatttttgtgagcttcaggttggggcaaagttacagattaacagcatctcagggcaaagcaattgttcagggtacagatcaaaatggaatttcttatgtcttccttttctacatagacacagtaacacactgatctctctttcttttccctataactgaagaacttttcagaggctttaacatgtaatgtgcatgaacatcttcaagaggaagatgaattaggcagtattattcaaattgacttgaccaagagactgttccttggtagcaggagttcattgttaagtgattcagtgaaatacagaaaggaatacataagcttttctgcctgcctttctgcctttagttatctcagggagaattaatcttattgcttagggtctaggattttgactgtgccatattcactagcagagactctgtctattaaaacgtcacacagtcatgtataacctacatattataagtaagaccagggaatgctcagttcttagtaggtccaaccatagtggtaagctctttctcgcataagcttgctaggataaggttctcactagtaagtaccatgttagtgttgtctgttattatcagctattcctaaattcatattttcctgaaatatctccagatgtcattgattttcctcttttctgggaacttatagcatttattgtttcttttatacaacttaatcacagtcttctgttgtttattagatcttggtttttgtttgcttgccctttttttccttgacttaaaaaaagttcctttagatcccaatagattactaggcacacaattttgtcatatattgtcaaaacaatggaatatatactggtatttaagaagtagacataacaaagaatacatcaaaagatcactaatttagattaacaaaagggaaacagcagactaaattataaagttatcttttcaagtaatttttctagttatgaaagtgatatactgcttatagagaaattggaaaatattacaatgaagatacgttccatttgttgtagtctctgcacaactacacaatttctttcaatagtgaaaccattctatatatacaattctatatcttgctatttttcatatatcaagattttcccattattaatattcttttgagacataattttaagtgaatataccataatttatttacaacattcccctttattgtaattttgagttaatgttcttttgctttttaacatttttagtgttttccatagttccgtgagcttaaaattcttttaaacataagtaaattgaagagactctaaggaaggcgttttcaaaatacatgtacaatgaaatatatttcttagtaatttagtttgtaggaaatgaaaggtaaatggtgtaatcattagtcagtcatagatattttaatgtggatatttcctatctgtatttaacaccataattttactttcatctttgtttgtttgaagtaattgatgtgttcagtggtttgtctagatatttgtactgccttactgaaacaatcaaaatgccattcctacaaaaatgattgcatgtcacctttccattttataaaaattagctactgtatccctttgttatccttttcaattagtggtatggtgaaaatattccaaagagggatatatatttaaaattattttcatatgttttaagccaagagaaataatggtatatttttttattttttaaaaaatattttcatactgttgtaaaaggagccaagaaactattgtgaaatcttttcttttgctatttgaaatctagagtgttttttgctttcttcctttatcctcatgcccacatatacttatattcttttttaaattaattttaacatggattatttgtgtaatagccttacatgtggatattaacagtgtaaacagtaccacatataaccatcaagacacctcaattagaatttataggactagaatgacagattcagatggtttaattacatttaaaaagttttctgaaaaaacttttgcaataaaacaaattgcccatcaataagtttgatatcttttaaaatgatttttggttatctgcacatgaagcaaacaaagtgtattccacaaaattcttaggcacagtctgagatagctgccagaaagaacagaaagagttgtcatttatgtcttgtgagtacaatttctgaaagttgaatgagggcgtctctttctggggatgagaagtttactgctctctcttattgcttcatggcagtactgctgggcaaggtaggttgtttgttttacaccatcactctgtaatacatactgtggagctctgtctacatctcccggcaaactgaaccatctcatgatcatagcattcatttctgggaactgctgacaggcaaataggacaggaccagtggctaacctgagattcacatcagctgatgttggtttgcctatgttagaacatgaggtgaagtcgaatacatcatctattagctgaaaagctattcctacattttttccgtactgataggtgatctcatgcaccactgggtcggggcatcctagaacagagactgctttacaactgttggctatcaggctcgcagtattcttgaaggtcttttcaaggtattgtgcaaatctctcatgctcattttcttttgacccgagctgaagaaattcaccacacaccaaatcttcaataactcgggttaaaatagatataacagctgtatttccagtttgtgccccacctatagatactacagaaagaattaaatctccagcaaggacagccttcttttcaccccagatcttgtgtgttttccttttcgagaacgtgcattatcaataacgtcatcgtgaacaagactagcagtgtggatcatttctgcaattaaggctgtggcgcgctggctagcttgcacatgtcgggagttattatgatgaatattacatgctcgggccattagtaccacaataattgatcgaaaggcttttccttttacatcaaagtagtactcagagatttccttaagttctgttgttgatatgagcggttcctttctaataccctcatacagacctttcaagtctctccaaccgagtttgaaaggatcggtgtatttctcaccactgtgtgttttgctgtacggggttgtgtgatgaaactgtgatatactatatacatttggacaggcaggtgttaaatgcttcacaagattaaaatagggtatctgagacaagtcaagtcccttctgcctatgagcctgcgcgggcatcggcagcggcgcgcggccccggcggccccgcaaggctcggggagcggtctccacgccgccggtctccagcaacagccgcgccgcccccgccaccagcgcgaggccacggtcggagtctgaaagtcgcggtaggatggtggctccgcctctggcccgcgatcctcctgccaggacctggagcctgaaacctcttatattctttatatcctttaccttctcgcttcactcctagcggttttgaaatcctctttattcctttttcctccatggtgcagatatgggattcagagatcaggatcttagtgcgactactttgaaattatcagcatcattctcaatcttctctgaatatgattcttattttcctctcttcccatcattagctaacatcttggtccacattccttgaatacttttagtactcattgttttctcatcaccttacctcctgccattattttggatgcccttccaatacttaaaaaaaaaattccttggcttctctaccccaaagttatgattatgttaaatgagttcctttgaactctataatcccatgtaataaccttacttagaaaatttcctaccctgaaatctccctgtctgactataactttatagcctttggcttttttcaacataaatgccttctttttgatatctttggtattgctagtgtctttcacactttcttcttattggaacgtaaattggtgaccctttctagagagcttctcatagagcagtttgtatcaagcgcgtttaaatgttcatatcttttaaactactttcgctggtatccacaattatatcacccccccttcccttgattatctgcttcactttccctattatttcctagtacgggaacaatacaacttagcatttttaaattgtgcttccatccctcaaacactaaaagaaaaaaatcagatataaatctttattgttttcattgaaaattggtttccaacattggttaggcacttatgactcttactggttgtattagtctgttctcacgctgcaaataaagacatacccgagactgggtaatttataaaggaaagaggtttaattgactgacagttacccatggctggggaggcctcaggaaacttacagtcatggcagaaggcacctcttcacagggcagcaggagagagaatgagtgccagcaggagaaatgccagatgcttacaaaaccatcagatctcatgagaactatcacgagaacagcatggaggaaaccacccgcatgattcagttgcctcccaccaggtccttccaatgacatgtggggattatggggtttacaattcaagatgagatttgggtgaggacaatgccaaaccatatcactcccttacttgatttctttcctggtcctatctcaaacccttctggttttctatcttaaatctttcttttcgctgtatttttcttcatctccttcttccataagaaaaatagaggcattccgaattaaaagtgagactgatttttgcctatcaaagtgacaaggatttagaaaaagtataatgatcattgttggcagggatgtgataaaatatacattttcccactgcttattggaacatcaaatggtaaccactgccagacagcttctaatgcagtgtgtatcaagtccctttgaaatgttcttatcttttgaacagctaattaagtatccttaatagagatgtacacaaatatttatttataagaatattattgcaatgacatgactgtatttaaaaatttttcttagtgtacatttatgtttccaatgttaaaattagtgcattcgtgtgacaatatacaataattaaaaattattaatttcaaggaatatatagtggcactagaaaataaattttatgaacacattgttaagtagaggggaagaagataaaacttatttcctacttttgttttctaaaatgtgttttggaataatttctcacaacagcctcatgagatagacattttattattctccactttaaggatgaaaaacctcattttagggagttctgaattgtccgcggtcacagagagagcaagttgtggatcaatattctagttccaatctgacttgagagtcctgggtcttgagagtcctgggtctatccaccttattgtgtggccttctaaactgtgtaattaagagatttaactttgagcctacatggtctaggttttttaaaaaactgacttcaagtatataactgaaaatatagtcacttagaatcttgtaactcaagaactacattgttttatcctgtaagaatgcaataatatccaaaatacactaatttgattaatatcaaaaacctatactttatttaaatgttatagcaacttaccaattctatgtacttaatgagttttaggtaaaaagagtggatttctttaaagacatcttcaaaaaaaaaaatgtagagtcatcccataggctaaaagtttcttacttcttaatttgctttggctgctataacaaaataccatagactgggtagcttaaacatcagacatttatttctttgaattccagggcctggaaagtctgagatcaaagttctggcagggattggtttctagtgaggtttcttcttggcttgcagatggccatcttcttgctgtgtcctcacatgggagagagagattgctctaatgtctcttcctcttataagggcactagccttgtcacattagagttccacccttataacctaatttaacttttatcacctcctcacaaggccctatctccaaatacagtcatattgggggttaaggcttcattatataaattttgggtaaggggtcactgacatttagcccataacagacacattccatccagatcactgacagtgatagcaaaaggtattttgtaaaaaaggaaaattcttcctggaagttagtgacaaaagtttaggaatcctcagcatgtcccttggcttatcttgacaattaatgctcatcatttatttaaatgcttttttgaagtaatttatatttcagcctataattccttttgaagaaattaaatttacagatttactacccacctgttgagatagtatttccttttcttgttctaagagttccttaatataagcttaaagatagtctgctgctgggcatggtggctcatgcctgtaatcccagcactttgggaggccgagttgggtggatcaccaggtcaggagatcaagacaatcctggctaacacagcgaaaccctgtctctactaaatatacaaaaaattagctgggcgtattggcgggcgcctgtattcccagctactggggaggctgaggcaggagaatggtgtgaacccagggggcggagcttgcagtgagccgagatcgtgccactgcactccaacctgggtgacagagcgagacttcgtctcaaaaaaaaaaaaaaaaaaaaaaaaaaaagacagtctgctaattccagctactagaattttctatataattataaaatttatttgtaatttgccttgaaaacttggtatttccatcctaatgtgatgtgtcatttagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtaagctgcccattgaaacctattttaaattcaaggtatgtgtttggcatcctgtgtaatataaatgtacaatgtcttaacgatctggacttatgccaatgcccagagggagaggcattctataatgactagagattgtgtttggtgatcatagactataactataggaagtatttggctagttggttaaacattcttttcacctcttgcttaagcttaccaagaaagtatcatttttaaaggaattgtttttgtttacattttctataaaaatatttttgaattcaatgttttttgttcgatatcaatgaggagaaaggaagttttctcatcagtttattttggtttgcctgaagagttatagaaaactgaaacgcaaatagtttcaaagcttttattcattcaaaagtttttgattcaaaaagactatgttcttaacaactatatcacctttaatgtataataaagttttgtcatcttagatttcatatatgtttaagtcatttatgtatgatagttttctaatatttaatcagtataatatggcagagtaaaacattatttccacctttatgttaaaaggtcggcgtaatctaaaattaattatggaatatttaccatatggaagtttacgagactatcttcaaaaacataaagaacggatagatcacataaaacttctgcagtacacatctcagatatgcaaggtaactaatatcctgattatttgctgtagatgaagcaaccgtgttgaagtagacattaggaaatcatctagacgttttcatagataataaagggaatatatagggttaagaccatttaaattgtttatatttataaaactagctgaaagaaaaatgttttatccatagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtgagtatatttcagtatgataaatgaaattttagagcacagacttcaaactttattgttgttatttaatagtttgccatttctatatttacagtaacagtgaacatttaagtcttttaagtcttacatttaactttttttttttaggtcttatagtcatggttatagtccacgtgggaaaatggcatatgctttatttctattaagtgttgtcttatttatagggattgtaggtttttcttcaaaactgtctcctatttattgaggcttaggggtaattattagtggtgctgtgggttgtggtattgtgttgaattttggtggggctttcatggggttaatagtcttttttatttacttgggtggtataatggttatttttggttatactccagtgatagctattgaggagtatcctgaaacatgagggccaagtactgatatttgaggggccttattattaggattattaatagagttgatactggtttggtgaatagttgaatatgatggggtggtgatcacggttgattttaatagcatagggagttgatttaatttttgagggggaggggttgattcatgaggattttgtaggtgcagctgccttgtataattatgggtgttggttggtggttgctggttgatcattgttagtatttttgtcgcaattgaaattactcagggtaatagattagataattaatagtagagtttaggcctttttggtcagatacagtaatggaggctgaagtttgggttcgtgaaatggtttttggtatagacttttctagtcaaactgggtctagtagaagtgaagctagattttggcttatgaataggcttaagtcggggggctgaatggtgaattgtagctgaataaaaacctagtatactggagaagttaaatgtctataatgggtactttaaggttgttagttatgaaattaagctctattgctagtaagagacctagggtggttacacctagggctgtgagctttaggtggagtggtatagttgtttggggggatgaagtagggataatactgttagtgatgaggaatccggcgaagatactgccgattgctaggtgctgaactgagttaattcggagaggattatcattaataacaatcagaattgtaaaacaaggttgtcctattacagcacctaaggttataaagtaagcacaagtaaatacataaaaacgttaggtcaacgtgtagctcatgaggtggcaagaaatgggccacattttctaccccagaaaatctcacgacaacctttatgaaatctaagggctcaaggaggatttagcagtaaaccaagagtagagtgcttggttgaggttgaataaggccacgaagcacgcacacactgcctgtcaccctccgcaaatatcattctagaaatattatttaaattctctatacatgaatagaggagataagtcgtaatatggtaagtgtactggaaagtgctcttggacaaacaaagtgtcgcttaacccaaagcatccagcttacacccggaagatttcatcacaacctggtcactttgagccaaccctagccccaaacctcactaaaaatactattaaaccatcgtaatcaaaccatttaccttagacaaaagaataggcaatagaaattcttatcttggcacaatagatacagtaccgtaagggaaagatgaaagaactgagcaaagacaagcccttataccttctgcataaagtattaagtagaaataactttacacagagatagccaagtcccccgaaaccaaatgagctatgcaagaatggctgaaagagcgtactcacctacgtggcaaaatagtgggaagattcatgagtagtggtgataagcctatcaagcctgctgatagctggttgtccaagatagaatcttagttcagctttaaacttacccacagaattacttaatgtccctgtaagtttaactgttaatctaaagagggacagctctttagaccctaggaaccaaccttcctacagagagtacaaaataacatcgccatagttggcccaaaagcagccaacaattaagaaagtgttcaagctcaacatccaagtatcttaaattctaatcactctacggaactcctaacattacactggtctaatctattatttaatagaagcaataatgttaatataaataacatgaaaatattctccaccgcataagcttacataagactggaataacccactgactgacagttaacagctagatattttacaataagcatcctattatttatactgttaatccaacacaggcatgctctaaggaaatattacaaaaagtaaaaggaactcggcaaatcttaccccacctgtttaccaaaaacatcacctctagcattaccagtattagaggcactgcctgcccagtgacatatgttcaacgaccaccatatcctgaccttgcaaaggtaacataatcacttgttccctaaatagggacttagaagaatggccacatgagggttcagctgtcatgagggttcagctgtctcttacgtttaatcagtagaatctgacctattggtgaagaggagcttataagcaaataagatgagaagaccccatggcactttaattcattaatgcaaataaaaactcaaaaagcctataggccttaacctactatctctgcattaaaaattttggttggggtgacctcatagcatattcaacctccgaacaacctaaactaagaccacagtagtctaagcgagttaatacacattgacccaataatttgatcaacagaacaagttaccctagggataacagtgcaatcctattctatcatatcaataatagggtttacgacctcgatgttggatcaggacatcctaatggtgtagccgctattaagggttcatttattcaatgattaaagtcctatgtgatctgatttcagaccagagtaatccaggttggtttctatctgtttaacatttctcctagtatgaaaggacaagagaaatacggcccacttcataaagtgccctccccccataaatgatgctatctcaatctaggaaatcaccacacacccaagaacagggtttcttaagatggcggagcctggcaatagcataaaacgtaaaactttacaatcaaaggttcaactccccttcttaacaatatgcctataattaaccttttcctacttatattcccactctaattgctatagcattccttacacttaacagttacgcaaaggacctgataccgtaggcccctgtggactgcttcaaccatttgctgacccaataaaacttttcaccagagaacccttacgaccctcaacgtctactgttaccctttatatcattgcctccaaccctggccctttctatcaccctcctcttctggactccccttcctataccccatcccctaattaattttaatataggcctcttatttattctagccacatcaagcctagcagtctattccattctatgatcaggataagcatccaattcaaattatgtactgatcggcacactacgagctgtggcccagacaatttcatatgaagtcaccctagccattatcctgctatcactactactgctaagtggctcaacttatatgcatgcatcacaatgccagaattactctgaccgctcctaccatcatgacccttagccatattatgatttatttccacactagcaaaaactaaccgagccccttttgacttaacagaaagagaatcagaactagtttcaggcttcaatgtcgaatatgctgcaagttcatttgccctcttctttatagcagaatatatgaatattattgtataaatgccctgactactactatttttctaggagtactacacactatgtattcaccagaactctgtaccataaatttcattaccaagaccctccttttaaccaccgtttttatgaatccgaacagcatacctccaattccactacaaccaactcatataccttttatgaaaaaatttcctaccacttacattagcattctgcatatatctcaatgcctttcctaatttccagcattccaccccaaacataggaaatatgtctgacaaaagaattactttgatagagtaaacaagagaggttaaaatcctcttatttctggaactataggaattgaacctatccctgagactccaaaattctccatgctacctattaaaccatatcctaaagtaagttcagctaaataagctattgggcccattctcctgaaaatgttggttatacccttcccatactaattaatccattagctcaacttattatctctcttactattttcacaggaaccctcatcacaatgctacgctcacactgatttcttatctgaacaggcctaggaataaatatagtagttcttacccccatcttgattaaaaaaacaaatctccactctacagaagcagccaccaaatattttcttacacaagcaactgcatctataattctcatgatgggtatccttttcaacaacccgtcctccgggcaatggacaataataaacactactaatcaattttcatccttaataataacagccctagtaataaagctagaaatagccccctttcacttccgagtcccagaagtaacccagggaacttctctaatgtctggcatacttctcctcacatgacaaaaactagcccctatctcaattatatttcaaattttcccatcaataaacacgaccagtctcctatctatcacaatcctatccattaacgtaagcggttgaggaggacttaatcaaacacaattctgcaaaatcttaacctactcctcaattactcatataggttgaatgatcccagtactaacttataatccaaacgttaccattataaatctgattgtttaccttattttaacaactaccacatttctagcacttagcctaagtataagcactacaaccctgtcactgtctcacacttgaaacaaattaacatgattaacacctatagtttcactaattctactatccctaggagctttacctccattaacaggatttctgcctgaatgagtcatcattcaagaattttcaaaaaacaatagtcttattaccccaaccattatagctatcataacactactcaacctgtagttttatatatgcctaatttactccatctcaatgacaatattccccacatccaataatacgaaaataaaatgacaattcaaaaacacaaaacccatattactcctccctccacttatttcttctaccttcctcttacccatctctccactgattctagttataacttagaaatttaggttaaataagaccagggaccttcaaaacccttagtaaatgaattatacttaatttctgtaacaaacccaaggactgcaaaactctattctgcatcagttgaacgcaaatcaaccactttaattaagctaagtccttgctagatcggtggaattcaaacccacaaaaatttagttaacagctaaataccctaatcaactggcttcaatctacttctccctccatgtggggggagggtggtaggccggagaagccctggcagcattgaagctgctcctttgaatttgcaattcaacataaaaaattacctcagggctggtaaaaagaggtcttgacctctgtctttagatttacagtccaatgcttactcagccattttacccttttttccacttatgttcatcaattgttgattgttttcaaccaatcacaaagctatcggaacactatacctgctgttcggcgcatgagtggggatagtgggtacctccttaagccttctaatttgagcagaattaggtcaaccaggaactctgctaggagatgaccagatctataatgttattgttaccgcccacgaatttgtcataatcttctttatggtcatatcaattataattgggggtttcggcaactaactagtccctctgataattgctgcccctgatatggcatttccacggataaataataatgagctttttacttctcccccactctttcctactcctacttgcatcctcaatagaagccggtgctggaactggctgaacagtttatccccctttagctgaaaacctaacacatgcaggatcctttgtgggtcttaccatcttctcacttcacttggcaggtattctattttaggagccattaactttattactacaattattaacaaaaagcccccagccatatcccaatatcaaacaccccttttcgtccaaccattcctcattacagcaatcctactcctttctctctcagtcctagccgctggcattaccacaatattaactgaccgtaacctcaacactactttttgaccctgctggtgggggtgatcctatcttatatcaacatttattctgattctttggtcaccctgaagtttatatccttattctatcaggctttgggatgatctcccatgtcgtgacgtattactctggaaaaaaggagccatttgggtatatgggcatagtatgagccataatatctattggcttcttagggtttattgtatgagcacaccatatatttacagtaggaacagacatagacacagacacatgagcatacttcacctccgctaccataattactgctatgcctactggcatcaaggtctttagctgattagctacactgcgtggtggtaacatcaaatgatctcccgcaatgttctgagccctaggattcatctttcttttcacagtaggaggtctaattggcattgtactagctaattcatcactagatattattttacatgatacatactatgttgtagctcatttccactacgtcctatcaccaggagcggtgttcgccatcataggaggctttaccactggttcccccattctcaggttatatgcttaatcagacctacgctaaaattcacttcaccattatattcataggtgttaatttaacctttttcccacagcacttccttggcctatccggtatgccgcaacgttattccgattatcctgatgcatacaccgcatgaaatattatctcatccttaggctcatttatctcattagcagcagttatgctaacaatttttataatctgagaagcctttgtttcgaaaagaaaaactataacaattgaacaaccatctagtaatttagagtgactttatggctgtccaccaccttaccacacatttgaagagccaacctacattaaacccttaaatgaaaaagaaaggaattaacttccagaaactggtttcaagccaatcaaaaacctctgtgactttctcgataagatattagcaaattcattacgtaactttgtcaaagttaagttataggctaaatcctatatgtcttaatggctcatccagttcaattaggccttcaagacgctacatcccctatcatagaagaaccgctcactttccgtgaccacgttcttataattattttcctaattagttcctggttctatacattatttccgtaatactcacaacaaaattaactcatattagcaccacagatgcccaagaaattgagactgtttgaactatcttacctgccattatcttaattttaaggcctctcatccctacgtattctgtataaaacagatgaagttaataatccttcccttactgtcaaagcaattggtcatcaatgatattgaagctatgaatatatagactatgaagaattaagcttcaattccttttttttttttttgagacagagtctcgctctgtcgcccaggctgcagtgcagtggtgtgatctcagctcactgcaagctctgcctcccgggttcacgccattctcctgcctcagcctcccgagtagctgggactacaggcgaccgccaccatgcctgggtaatttttttgtatttttagtagagacggggtttcaccatgttagccaggatggtcttcatctcctgacgttgtgttccacccacttcagcctcccaaagtgctgggattacaggcgtgtgagccactgcgcccggcttaagcttcaattcttatataaccccaacaccagacttaaaaccaggagaacttcgactccttgaagttgataaccgaacaattctcccaacagaaatacccatccatatattaatctcatctgaagacatcctgcactcatgaactatccccttattaggcctcaaaacagatgcaatccccagatgcttaaatcaaactaccttaaccactgggcgaccaggtctttactatggacagtgctcagaaatttgtgaatctaaccagttttatacctattgtcctagaactaatcctcttaaaatatttcaaaacctgatccacatctacactaaaatatcactgtaaagctattcagcatttaccttttaagttaaagattgacggagtctacacctctctgcagtgaatgcctcaactagatacttccacatgatccattattatcctgtcaataatcataactttattctccattattcagttaaaattattaaatttcatttatattatccctacaccaaaaataatcaaaacacaaaaacacaaggcttcctgagaattaaaatgaacgaaatctattcatctcttttgctacccctacaattctaggcctaccagcagtagtattaatcattctgtttcccactgtttccaacctctagtcatcaaattagtaaccgattattttctattcaacgatgattaatccaacctgcactaaaacagataataattacccataacattaaaggacaaacctgatcccttataataatatccctaattatcttcactgcctcaaccaacctccttgggcttctaccccattcatttacaccaactatccaattatcaataaacctgggtatagcaatccccctgtgagcaggcgcagtaattacagtcttctgctttaaaacgaaaaactccttggctggctttttaccacaaggcacacctatgccacttatccctatactagtaatcattgaaaccattagcctatttattcaaccaatagcattagctgtgcaattaacagccaacattatagtcagtcatctactaatacatttaattgcaggagacacactagtactattagctattagttttcccacagcttcagttgcttttattattctaatcctactgactattctcaaattcgccatagaccttattcaggcttatgtcttcacactactagtaagcctttatctatatgacaacacataatgacccaccaaacacatgcttgccatatagtcaaacccagcccctgaccactaacagaagctctctcagctctactaataacatctggcctggccatgtgatttcactttaattctactactcttttaaccctaggcctattaatcaacacactaactgtataccaatgatgatgtgatattatctgagaaagtaaatttcaaggccaccatacaacagttgtccaaaaaggcctccaatatggaataattctatttattatctgagaagtattcttctttgctggtttcttctgggcattctatcactctagtctagccccaatgccagaattaggaggacactgaccccccaacaggcatttttcccctcaaacgcttagaagtacctttctgaatacatctgtattatttgcatcaggagtttcagttacttcggctcatcacagcctgatagaaggaaatcgaaagcaaataattctagcactatccatcacgattaccttaggtatttacttcaccctcctacaaatctcagtactttgaggccccttttactatctctgatgggatctatggctcaacattctttacagccacaggctttcatggatttcatgttattactggatcaacatttctcactatctgcttcctccgccaattaaaatatcactttacaagatgtctgaataggaatagctccagtctgcagctcccagcatgatcgacgcagaagatggtgatttccgcatttccaactgaggtacctggttcatctcatcgggactggttggacagggggtgcagcccacagagggcaagttgaagcagggcggggcatcacctcacccaggaagcacaaggggtcaggggatttccctttcccagccaagggaagccatgacagactgtacctggaaaatcaggacacttttgcccaaatactgtgcttttccaacagtcttaccaaatggcacaccaggagattatatcccatgtctggcttggcaggtcccacacccacggagccctgctcactgctagcacagcagcctaagatccacccgtgaggcagcagcctggcaggcggaggggcgtccgccattgctgaggcttgagtaggtaaacaaagtggccagggaagctcgaactgggtggagcccaccacagctctgcaaggcctgctgcctttgtagaccacacctctgggggcagggcatagctgaaaaggcagcagaaacttctgcagacttaaacgtccctgtctgacagctctgaagagagcagtgtttctaccagcatggtgtttgagctctgacaatggacagactgcctcaggtggatccctgatgcttctgtagcctaagtgggagacacctcccagtagaggccaactgacacctcatacaggtgggtgcctgtctgggacgaagcttccagaggaaggatcaggcagcaacattggctgttctgcaatatttgctgttctgcagcctccactgcagataccgaggcaaacagagtctggagtggacctccagcaaactccaagagacctgcagctgagggacctgactgttagaaagaaaactaacaaacagaaaggaatagcatcaacatcaacaaaaagggcatccacaccaaaaccccatctgtaggttaccagcaccaaagaccaaaagtagataaaaccacaaagatggggagaaaccagagcagaaaagctgaaaattctaaaaaccagagggcctcttctcctccaaaggattgcagctccttgccagctggatggagaatgactttgacgagctgacagaagtaggcttcagaaggttggtaataacaaacttctccaagctaaaggaggatgttcaaacccatcgcaaggaagctaaaaaccttgaaaaaagattagaccaatggctaactacaataaacagtgtagagaagaccttaaatgacctgatggagctgaaaaccatggcatgagaactacaggacgcatgcacaagcttcactagccgacttgatcaagtggaagaaagggtatcagtgattgaagatcaaattaatgaaataaagcgagaggagaagtttagagaaaaaagagtaaaaagcaacaagataaagcctacaagaaatacaggactatgtgaaaagaccaaatctacatttgattgttgtacctgaaagtgacggggagaatggaaccaagctggaaaacactcttcaggatattatccaggagaacttccccgacctaccaaggcaggccaacattcaaattcaggaaatacagagaactccacaaagatactcctcgagaagagcaaccccaagacacgtaattgtcatattcaccaaggttgaaatgaaggaaaaaaatgttaagggcagccagagagaaatgtcgggttgcccacaaagggaagcccatcagactaacagcggatctctcagcagaaactctacaagccagaagagagtggaggccaatattcaacattcttagagaaaaagacttttcaacccagaatttcatatccagccacactaagcttcataagtgaaggagaaataaaatcctttacagacaagcaaatgctgagagattttgtcattaccaggcctgccttacaagatctcctgaaggaagcactaaacatggaaaggaacaaccagtagcagccactgcaaaaacataccaaattgtaaagaccatcgatgataggaagaaacagcatcaactaacgggcaaaataaccagctaacatcataataacaggttcaaattcacacataacaatattaaccttaaatgtaaatgggatgaatgccccaattaaaaaacacaaactggcaaattggataaagattgaagacccatcactgtgctgtattcaggagaccaatctcatgtgcagagaaacacatgggctcaaaataaagggatggaggaagatctaccaagcaaagggaaagcaaaaaaaaaaaaaaaaaaaaaaaaaaaaaaaaagcaggagttgcaatcccggtctctgaaaaaaaagactttaagccaacaaagatcaaaagagacaaaaaaggccattacataatggtaaaaggatcaactgggcaagaagagctaactatactaaatatataggtacccaatacagcagcaccaagattcataaagcaagtccttagagacctataaagagacttagactcccacacaataataatgggagactttaacacctctctgtcaataatagacagatcaatgagacagaaggttaacaaggatatccaggacatgaactcagctctgcaccatgtgaacctaatagacatctacagaaccctccaccccaaatcaacagaatatacattcttctcagcacgacatcacacttattccaaaatagaccacatagaagtaaagcacttctcaccaaacgtaaaagaacagatatcacaacaaactggctctcagagcacagtgcaatcaaattagaactcaggactaagaaactcactcaaaaccgcacaacttcatggaaattgaacaacctgctcctgaatgactactgggtaaataatgaaatgaagacagatataaagatgttctttgaaaccaacgagaacaaagacacagcataccagaatctctgggacatatttaaggcagtgtgtagagggaaatttatagcactaaatgcccacaagagaaagcaggaaagagctaaaatcgacaccttaacatcacaattaaaagaactacagaagcaagagcaaacaaattcaaaagctagcagaaggcaagaaataactaagatcagagcagaactgaaggagatagagacacaactcttcaaaaaatcaatgaatccaggagctggtttttcaaaaagatcaacaaaatagatacactgctagcaagactaataaagaagaaaagagagaagaatcaaatagagggaataaaaaatggtaaaggggatatcaccaccgatcccacagaaatacaaactaccatcagagaatactattaacacctctacacaaataaactagaaaatctagaagaaatggataaattcctggacacatacaccctcccaagactaaaccaggaagaagttgaatctctgaatagaccaataacaggctctgaaattgaggcaataatagcctaccaaccaaaaaaagtccaggaccagatggactcacagccgaattctcctagaggtacaaagaggagctgataccattccttctgaaactattccaatcaatggaaaaagagggaatcctccctaactcattttatgaggccagcatcagcccgataccaaagcctagcagagacaccacaaaaaaataattttagaccaatatccctgatgaacgtcgatgtgaaaatcctcaataaaatactggcaaacccaatccagcagcacatccaaaagcttatcaaccacgatcaagtcggcttcatccctaggatgcaaggctggttcaacatttgcaaatcaataaacgtaatccataacataaacagaaccaatgacaaaaaccacatgattatttcaatagatgcacaaaaggtctttgacaaaattctacagcccttcatgccaaaaactctcaataaactaggtattgatggaatgtatctcaaaataataagagctgtttatgacaaactcacagccaatatcatactgaatgggcaaaaactggaagcattccctttgaaaactggcaaaagacaaggatgccctctgtcaccattcctattcaacactgtgttagaagttctggccagggcaatcaggcaagagaaagaaataaagggtattcaattaggaaaagaggaagtcaaattgtccctgtttgcagatgacacgactgtatatttagaaaacttggtcatctcagccccaaatctccttaggctggtaagcaacttcagcaaagtctcaggatacaaaatcaatgtgcaaaaatcacaagcattcctatacacccataacagacaaacatacagccaaatcatgagtgaactattcacaattgctacaaagagaataaaatacctgggaatccaacttacaagagatgcgaaggacctctggacctcttcaaggaaaactacaaaccactgctcaatgaaatacaagaggacacaaacaaatggaagaacattccatgctcatggataggaagaatcaatatcgtgaaaatggcgatactgcccaaagtaatttatagattcaatgccatccccatcaagctaccaatgacttttttcatagaactggaaacaactactttcaagttcatatggaaccaaaaaagagcctgcattgccaagaccatcctaagccaaaagaacaaagctggaggcatcacactacgtaacttcaaactatactacaaggctaccgtaaccaaaacaacatggtactgctacccaaacagagatagaccaatggaacagaacagaggcctcagaaataacaccacacatctacaaccatctgatctttgacaaacctgacaaaaacaagaaatgggaaaaggattccttatttaataaatggtgctgggaaaactggctagccatatgtagaaagctgaaactggatcccttccttacaccttatagaaaaattaattcaagatggattaaagacttaaatgttagacttaaaaccataaaagccctagaagaaagcctaggcaataccattcaggacataggtgtgggcaaggacttcatgatgaaaacgccagaaacaaaggcaaccaaagccaaaacagacagatgggatctaattcaactaaacagctgcacagcaaaacaaactaccattagagtggacaggcaacctacagaatgggagaaaatttttgcaatctacccatcagacaaagggctaatatccaaaatctacaaagaaatttacaagaaaaaaacaaccccatcaaaaagtgggcaaaggatatgaacagacacttctcaaaagaaggcatttatgcagccaacagacatataaaaaatgcttatcatcactggtcatcagagaaatggaaatcaaaaccacaatgagataccatctcatgccagttagaatggtgatcattaaaaagacaggaaacaacagatgctggagaagatgtggcgaaataggaacactttcacactgttggtgggagtagtgtaaactagttcaaccactgcagaagacagtgtggcgactcctcaaggatctagaactagaaataccatttgacccagccatcccattactgggtatacacccaaaggattataaatcatgctgctataaagacacatgcccatgtatgtttactgtggcactattcacaatagcaaagacttggaaccaacccaaatgcccatcaatgatagactggataagaaaatatgccacaaatatcccaaggaatactatgcagccataaacaagggtgagttcatgtcctttgcagggacatggatgaagctggaaaccatcattctcagcaaactagcgcaaggacagaaaagcaaacactgcatgttctcactcataggtgggagttgaacaatgagaacacttggacacatggcagggaacatcacacaaaggggcccgggggagggatagcattaggagaaatacctaatgtaaatgacgagttaatgggtgctgcaaatcaacatggcacatgtatatctatgtaacaaacctgcacattgtgcacatgtaccctagaacttaaagtataataaaaatatatatacatcactttacatccaaccagcactttggctttgaagccactgcctgatgttgacactttgtagatgtagtatgactattcttatatgtctctatctactgatgaggatcctactcttttagtataaagagtaccattgacttccaatcaactagtttcgataatatctgaaagatattaaataacctgacactagccttagtaaccgacaccttactggccctactactactactaattacatttttacttccacaaattaatatttatatagataaatccagcccctatgaaggcagatttgacccaataacctccaactgcctccccttttccataaaattcttcctagtagccaacacatttctcctcttagacttagaaatcgctctaatactacccctgccatgagctattcaaacaaattacctaacaacaataatcaccacagcccttatactagttatcattttaatcctaggcttaatttacaaaagaactcaaaaagggttagattgaattgaattggtaaatagtttaagtcaaaagaaatgatttcgattcattagattataataaaccatatttaccaaatgccctctatttacatcaacattatattaccatataccatatcactactggtaaaattaatctatcaaacccacctaatatcatccctatgtgcctagaaggcataatactgtcaatatttatcataattacccttataactttaaatatacattttactctagcatctataatacccattatcctcctagtatttgctgcctgtgaagccgcagtgggccttgccttattagtttcaatctccaacacatacggcctagattacacacaaaatctaaatttacttcagtgctaaaaattattccgacaattatgctgttaccaataatatgattctctaaaaattctataatctgaattaacatgaccatccacagcctacttatcagcctcatcaccctattgttttttaaccaattcaacagtaactcatccaacttctcactagttttctcttctgatctgctgatgtcacccctcctaattttaacagcctattaccttttataatcctagcaagccaatattaactgttcaatgaatcacccccacaaaaaagctctatatttctatattgatttccctgcagattttttaaaattatagcattcacagccacagaactaattatattttatattttctttgaagccacactaattcctaccctaattattattatcacccgctgagggaaccaaccagaacgcctcaatgcaagctcatatttcctattgtacacactagtagggtcccttcctctacttgttacacttgtctacactttaaatacttcagattctctaaatatgctagtaatgatatttactgaccaagaactgttagcctccttatccaataatcttatatgactagcatgtattatggcctttatagtaaaaataactctattcggacttcacctgtgactcccaaaagcccatgtagaagcccctattgccggctcaacagtacttgcagcggtactcctaaaactaggcggctgcggtataatacggcttacccttatcctcagccccctaacagaatatatagcctaccccttcctcacactatccctatgagggatagttatgacaagctccatttgtctacaaaccgatgtaaaatcagttattgcctactcctctgtaagccatataccacttgtcatcatagctctcctaatccaaaccccttgaagctttacaggtgccgtcacccttataattacccatggagtcacttcatccctgttattctgcctagcaaattccaactacgagtgagtccaaaacggaatcatatacttacctgaggccttcaaatactcctcccactgatatagcctcatgatgacttctagcaaatctcactaatcttgccttacccctaccattaatctagtaagggaactctctgtgatcatggcttcattctcctgatcaaacatcactattatgcttacaggacttaatatactaattacaaccctctactccctacatgtaccaatcacaacacaatgagggacacttacatattacattaacagttaaaccttcctttacacgagaaaatacattaatatttatacatgttacacctattcttctattatcctaaatcctaaaattattatgggctttacatgctgtagctatagtttaaccaaaacattaaattgtggatctaataatagaagcctgcaacttcttatctaccaagaaagtatgcaagaactgctaactcatgcccccatgcctaacaatatggctttctcaacttttaaaggattggagtcatccgttggccttaggaaccaaaaacattggtgcaactccaaagaaaagtaacaaatatgtatttttccactactataatagccctaatcgccttaatcacaccaattattacgttagtcaacccctgcaaaagaagattcatacccaaattacataaaaatagccatcacatgcgccttcaccattagcctcatcccaacgtttatatatacagaccaagaagtcattatctcaaactgacattgaatgacaatcccaactcttaaactctcactaagctttagactacttctccataatatttattctagtagcactatttgttacctgtagaattctcaatatgatatataaactcagaccctaacattaatcaatttttcaaatattttcctcatcacagtattcttccaatattccaccaacaaactctttcaactctttatcggatgagaaggtataggaatcatgtctttcttactaactggctgacaatatggccgagcagatgctaatacagcagccctccaagcagtcctgcacaatcgcatcggcgacattggttttattttagttatagcatggttcctcttttcctccaacacatgagagattcaacaagcattcattctaaaccctacctctaatccccttccattaattcgccttctcttagcagcagcaggaaagtcagctaaattcggcctccatccctgacttccatccgccatagaaggcccaaccccagcctcagccctgctccactccagcactatagttgtagcaggagttttcctgctcatccgcttctaccctttaatagaaaataacctctgaacccaaacctttacattatctccaggggctgttaccaccttatttacagcaatctgcgctctaacacaaaatgatatttaaaaaatcatagcattctccacctcaagtcagctgggccttacgatagtcacaattggcattaatcagccacatctagcattccttcacatgtgcacccacaccttttttaaagctatattatttatatgctcaggctccatcatccacaatctcaatgatgaacaagatatttgaaaaataggactattcaagactttacccttcacttcctcttcccttattattggtagccttgcacttacagatatgcctttcttcacaggcttttactctaaagaccttattatcgaaaccacaaatactgtcatataccaacgcctgagccctttctattactcttactgccacctccttaactgctggctatagtacccgtgttattttctttgctctgcggactggccatgcaggagtggtaagggcccgggccacgcgcgacgcctgggggccctgctgcatcgcccgtttgttcggggaaggtgggggggacgcttcatgccgccgcgcccagcagggtttccatgtctgagatgcccgctctggccccaagagaatgaaccagccgcagaggatggcatccgtggacacggacaaggagctcagtaacctggacttcagcatgatgttcccgctgcccgttgccaacgggaagggccggcccgcctccctggccggggcgcaattcagaggttcaggtcttgagaactggcccagctcaggctcctggggcagcggcgaccagaacagctcctcctttgaccccagctggacgttcagcgaaggcgctcaacttgctgagtcgcacggcagccactctccattcacattcctgggaccgggactcggaggcaagagcagctagcgcgggcctattcctcctttggtagagacgcaggcgtgcgcagcctgactcaggctggcttcctgccgggcaagctggccctcagcagccccggacccctgtccccctcaggcatgaaggggacctcccggtactacccctcctacgccagcagctctggcggacagaggcggacagcggcctggacacgcagcccacgaaggtcgggaaggtcccgcctggtcttccatcctcggcgtacctgcccagctcaggtgaggagtacggtagggatgccgccgcctatccatccgccaagacgcccagcagcgcctgtcccgcccccttctacatggcagatggcagcctgcacccctaagccgagctctggagttccctgggccaggtgggctttggccccatgctgggcgggggctcatgcccctcgtccctcccgcccagcagcggccctgtgggcagtggcggaggcagcagcacgtttggcggcctgcaccagcacgagcgcgtgggctaccggctgcacggaggagaagtgaacggtgggcttccggctgcatccaccttctccttggcccccggagccacgtaggcggcgtctccagccacacgcctgtcggcggggccgacaacctcctgggctcccgagggaccacagccagcagctctggggacgccctcgggaaggcctggcctcaatctactctccggatcactcaagcaataacttgtggtccagcccctccaccgccgtgggctccccccagggcctgggagggacgtcgcactagcctggagcaggagtccctggtgccttatcacccagctacgacgggggtctccacggcctggagagtaagatagaagaccacctacctgaacgagggcatccacgtgctctgcagccacgccatgggcacggctagcaacgtgcacacgctgctacccggccaccgggcgctggccttgggcttcgccggccccatgctgctggtgggggcagcacgcaggcctggttggaggcgaacaccctgaggacggccctgcgggcagcgccagcctcatgcacatccatgttgccctctccagctagccaggcgccctccccgacctctcttggccttccgactcctgcagtgggctagggcgagcaggccactggggaaatcaagcgggaggaggaggatgaggagaacacgtcggcggctgaccactcaagaggagaagaaggagctgaaggacccccgggaccggaccagcccagacaaggacgaggaggaagatgaccttttccccccagagcagaaggccgagtgggagaagcaggtggccaataacgccagggagcggctgcgggtcccttaagagggctcttaaggagctggggcgcatgtggcaactgcacctcaacagcgagaagccccagaccaaactccttatcctgcaccaggccgtctcggtcatcctgaatttggagcagcaagtgcgagagcggaacctgaatcccaaaacagcctgtttgaaacggcgagaagagaaggtgtcgcgcgtgttcggaggcccccagatggtgctttcagctgcccacctgggcttgagtgaagcccacaaccccgctgggcacatgtgaaaggtacgcctccgtgggacgagccacccgccctcagccccgtgggctgggcccagaacgcccacttgaggccctgggcttcatccacatccacacctcacacaactgttgtcagcattgagccaacaccgacctgatgaggctcagagtgatgggggcaaggaaggtgagtgatgggggtgaggaaggtgacgctgggtccaggagctccctgggaccccggctcacccctcactgccctcgctccccctgcccccgtatctcagccaccatgtcaccctgtgacctgccccatggaccctgaaactgcatcttggccctgttgtctgggctggcaggagcttttttttttttttttttttttttttttccagtaaacaaaacctgaatgcaagcaacaaaacatacactttgtcagaaaagaaaaaaatgccttaactataaaatgtggagaaatcgtaacatatcacttgagggagatgctgtggaaacttggcttattcttcaaaagccagcagcaaattgtgcctaagcgtaattttttttaaggaaaataaaaagaacattagttatttaaaaaaaaaaaaaaaaaaaaaaaaacccggactgaccttggccaggctggatcagactggcctagagtagacttcagagggtgactcccctggtgggctggtctcagctgatcttgactgtcccgcctccacacagggcccatccatcttccccttgatcccctgctgcaaagacattgcctctgatgccacctccatgaacctgggctgcctggccacaggctacttcctgaagtcagtgactgtgacctgggacacaggctccctcaacaggagcgctgggaccttcccagccaccaccctcacgccctctggccattacgccatcaccagccagctgactgcctcgggtgcgtgggccaaacgctcacctgcagcgtggcacacactctgtggtccgcagaccaggtcagtaccttcagcatctactccagggacttcaccctccccaccgtgaagatcttacagtcctcctgtgatggcagtggacacttacccccgaccatccagttcctgtgcctcatctctgggtacacccaggtgccatcagcatcacctggctggaggatgggcaggtcgtggatgtgaactggtccatcgcctctcccatactggaggatgagctggcctccacacaaagcaagctcaccctcacccagaagcgctggctgcccgaccacacctacacctgccaggtcacctatcaaggtaacacctttgaggacagtgccaagaagtgtgcagattctaacccgcaaggggtgagcacctacctgagccggtccagccccttctacctgttcatccgcaagttgcccacaatcacctgtctggtggtggacctggcacccagcaaggagaacgtgaagctgacttggtcccaggccagtgggaagtctgtggctcaggtcatcctaaggcaagagaagcagtgcaatggcacgttcaccatcacgtccaccctgctggtgggcaccagagactggatcaagggggagacctaccagtgcagggtgacccacacccacctgcagtccacgaccaagatcagcggcccatgtgctcccccacaggtctacgtgtttgcaacgctagaagagccgaggaaccaggacaagcgcaccctcacctgcctgatccagaacttctggcccaaggacatcttggtgcagtggctgtacaacgaggtgcagctcccggacacttggcacagcatgacgcagccccgcaaaaccaagggctctggcgtcttagtcttcagctgcctggaggttaccagggctgaatgggaacagaaaaacgagttcatctgctctgtggtccatgagacagcgactggctcacagaccgtcaagtaactgttgtctgtaaatcccattaaatgtcctcctgccttcctccccactagggctctgtccagctgtgtggtgggaagggctggccagaccttctgtccactgttgcaatgaccccaggaagccacccccaataaacagtgcctgctcagaaaacaaacaaacaaacaaacaaacataaaaaccctagaggaaaacctaggcaataccattcaggacataggcatgggcaaggacttcatgactaaaacaccaaaagcaatggcaacaaaagccaaaatagacagatgggatctaattaaactaaacagctgcatagcaaaagaaactgatcagagtgaacaggctacctacagaatgggaaaaattttttgcaatctagccacctgacaaaaggctaatatcaagaatctacaaagaacttaaacaagttcacaagaaaaaaacaaccccatcaaaaagtgggtaaaggatatgaacagacacttctcaaaagaagacatttatgtggccaacaaacatatgaaaaaaagctcatcatcactggtcatcagagaaatgcaaatcaaaaccagagtgaggtaccatctcatgccagttagaatggcgatcattaaaaagtcaggcaacaacagatgctgaagaggatgtggaaaaacaggaatgcttttacattgttgatgggagtgtaaattagttcaaccattgtggaagacagtgtggcaattcctccaggatccagagttagaaataccatttcactgagcaattccattactgggtatatacccaaaggattataaatcattctactataaagacacatgcacatgtatgtttattgtggcacttttcacaatagcaaagacttggaaccaacccaaatgcccatcaatgatagactggataaagaaaatgtgacacatatacaccatggaatactatgcagccataaacaaggatgagttcatgtcctttgcagggacaaagatgaagctagaaaccataattctcagcaaacacaggaacagaaaaccatacaccacttgttctcgctgataagtgggagttgaacaatgacaacatatggacacagggaggggaacatcacacaccagggcctgttgttgggtggagggctaggggagggatagctttaagagaaatacctaatgtagttgatgggttgatgggtgcagcaaaccaccatgacacgtgtatacctacgttaacaaacctgcaccttctgcacatgtatcccaaaacttaaagtataataaaatttaaaaaaaaaacagtgaacatttattgtaggcttacattgggctaaatgcattttatggataatctcatttaatcctcataacaacccttggagaacatgtatgattattatctctattttaagcatggagaactgaatagcttacccaaggtggcatgactagtaaatcactggaccaggatttaaacccaaaaagtctgatcccagagttcatgcttataagccttcctaaccatgataatgctttaatctggcattaattgttctctaatttgggtaggtttgaaatttttcataataaatattaaaaatactttttgaggaaatgtcgtcatgataaacattagaactgcgttcatctaattacttttagggtatgagtgaaactaaaaagtaagactcatctaaaaataatcatctgttttggccatatccccagtgatacatgaatttaattgtttttattgttttcagaatgaaaaattaaagaggttaaataaaattagctggcaatcaaaaaatattagttatatgaagattcagagatttggttatacttaatgaatacaagctaataaatatttattaagactctactgtgctccaaatactatacagggaggtagggatatgaagataggcttagcatcagaaaaggactgtcccttagtagaaaggctgaactaaaaggaaaagtttgacgtgataggcaaattcaactgacaggtccactacccatagtcccttcaagagctcataattaggaaaagtcatatgtataatatggcactttcaataattaagtgcaataagtgtaagtgcaataattaaggtactgggaaaacataacagtacaaataattcagctgaagatttatgtaagataactaagatgacatttcaacgattggttgaattgacctctccctcatgaatgggattaaggcccttataagaggcttcatgcagcatttggctcctcttgcctttccactttcatccatgtgaggacacggcattcctctcctctaaaagatgtggcaacaaggctccccttggaagcagagagcagccctcaccacacacctgaacctgccagcacctttatcatggactcccaacctccagaagtatgagaaataaatttctgttctttataaattatccattgtcaggtactctgttatagcagcatacatggacgcccagtacatcatgttaatgagttcagaccttctttagtagacagtgcgtaaggtgggaaattagaggctttatccaggggaataacatggtgagattcatattttagaaagatagctctacttttgttatagaacagcagttctgaaagtgtggggactttagggtgtctgtgaagtaaaaaatattttcataataatggatgttatttgctcttttcactcattttttcataagtatagttttccagaggcaataagatatgttttctatttaaccaaacattgaagagacttgcaaaaatgtaaaacaatgtgactcttatcaaagtttattttggaaatagttgttttccataaaatacattacttatgttaacaggtaatggttttatcttaaataaattaataaatatttttatattttattagctttaatatttaatatggtaaatactggtagatataactcacagaaacaaaagttttttggcaacctcagtaatttttaagagtatacgaggaagcctgagatcaaaagctttgagaactactgacagaggggacgttgtattaatgagaggctaatagtagagaggcagctaattagattttatgaggatctaggccactggttttcaaaccttttaagtatatatgctcactaaaagaatttagaaaaaccacatcctcttacacatttttaaattgatagctaatttttttctttgtaagtagttataatgtattttctaaagtactgtaaatattgacatttaaataacagctatgtcaatcctttaaatgtgtccaactgaatctaaatagtgcttgcagtgagcggagacctcgccactgcactccagcctgggcgacagagcgagactccatctcaaacaaacaaataaatagtgcagcaatttgatacccacttatcacccacttaaaaagattatatgaatagacttttatttttttgtacaaactttgtatcattcctttttctctttaaaatagtattcccacttcccttctcattccaaattttgcataatatgttacactttgtatttggataatcttatgatcacctattttctttgtaaccaagatatgtatataagtaagttgaaattaattaaaaattttcctgtgaccaacaaacttgtaactattcacatttttcttctgggttatcattgaagttactaggatacagttttccaaagcaatgtaaataacaaatttggataattgctttaaaaattttattggtgaatggaacaatccctcccctccaattggtttgtatatcctcggatgaatattatttatttctataatgggacaagattaagcataaattctgtgttcattttgcactttacagatgtaaacgctgagaaaacttgtttgtgtaagtgagtggacaggaatggaaggagttttgttataatagtatcattcatttctatgacgccttctgagatatgcaggaaaaaagtacagtaatataccattaaaaattatctgttattgggcagtttcatttgatcagatccattatgtttcaattttattaaaagcagagaattaaaaccacttgactttcaaaaatgagtttactaaccagtcatcaggttcatctgttttctcaatttctgaaaagtataccaaaaagcttttaaaattaattccaactatatgttacactttcacgtggatgtaccttgtttaaactaatacattcagaaaagtttgaaaaaacagactattattaatacattattattaacatattttatcatgttttaaatatatgatttaaacacagcaaacctctcagctacctcaaaggttgagtagattttgtgaagaatgtccttcatacaacccatttggtaatgccaggcatcaaacaaatcacttaatttctggcagaaaaactcagacttcatttttcaagtcactaaatatattaataatatgtgatttttttaaaacctgagaaacaaatgacagaacaaatgcatggaggtatgtttattatgaagctaatgaagcatatccagaggtcctccttccaaggttcctttctaattttaaatagaaaattatgcactttcatgtataattttgtattctttgtcataatgaaagcctaaaaaaaaaaggcttcaaattatataagctttgggacctgtatctctgcctatacatgtgaaaaaatcatgagggcagtcaggataagctgaagatgatatatatatctggcataattaatttcatattatgaaaataagataatttctcattacttaatttgcaataaataatacagagtaaaatatggctaagattataacttatgaagtaaggtatatggtacatggcatggtcattccttcagtaaatgtgttagggggaggtatgaagtgaattctgactttggggaataattagaagcaacttgtatgaaaatcagaaataacttatttttcctcatgatcaaaattttcatatgtacttaatgaacacaaaaaatatatactgctaaaagcaaatcaggcagttagcatatagttttatttttatatttgcaagtagaaaataaatattttatacaatgaaatgaagttcattaaattttatgtaaatattttagaatatgaattgataaaataagtttgagctaacttattgaataataaacactgtcttagtccctttatgctgctataacagaatacctgaaaatggataatttataaagaacagaaatttatttctcacacttctagaggttaggagtccatgaaaaaagtgctggcaggttcaggcgtctggtgagagctgctctcttctttccaagatggagccttgctgcttcctccttcagagaggaggaacaccatgtcctcacatggacaaaagtggaagggcgagaggggccaaatgctgcatgaagcctctcataagggccttaatcctattcatgagggagaagccctcatggcgtaatcatctcttaaaggccccacctgttaataccatcacattaacaacacctgaattttggaggagacacatagcaaacactaaatctgaagtctgaaagaactcaatttttattcacaggattttgcccatgatatcatttttttaaaaactcaatttcatttaaaagaaactttgttatctatattgtttttcttgttcgaaaaggctcttttgttttaagctaacaatatggttgacggtaataactgggggaaaaagtgcctctgcttaaatgttgtaaaaaatcggtgaaacaggattttggactcctggaggatcctttactctttttactacagaagtacccattggatgatctttgtacattattcttcaccttgtgtgaagacctctgtgctagtcatgagataaggatgtgatgtaaactgtaacaatgggttaggagactgattggagatatttctaagctatactctaaagggacttagtgggtcattagacactggagtgaaagatgcgtcaaaaataattaagattttcaaattgagcagctaaatagattgtgatgctatttattgcataagaaacaaaataatcagcaagttttggaaagaggatggaattctgtttgcctatagatctttaatgtggaaatgttctaaaagtctggagcactaaacaaaggtcaaagatatggttataaatttgggagactttagtatataggtggatgatactatctaagggaaagtttttaaccaagagaggaataaatctgatgaagagaccctgggaaaccttcaatttagaagaggcagaatagtagtagtagtgttgggaaagtataattgaaaacaaaatcttccaacccagaaaacctttccacaaagatagaaggaaaacaattttatgattgagtaagcattagagcaggatgtgatgtgtatcacaagcagtcccctaagagatttgcaaagacagaaggaaatctcacccttttatatagccaacctgatataacccctttcattcaagttcttaggataaacattaactagtcctcaagtaagaagacttgacagcactatttgccacatacgtagtttattctaaattcacttggtaattggagtgactttgctaattggctttatacaaaggaaaatacacttttcatatcttcatgacaggaggtagttttgcagcttggaaggaggctcctgctgaagttaggcttctactcccacagaaactgggagtaagggtgctatcttccttgatgactgaattcccaagagatagttacacgttcttgagaaagacattcatgggtcacaaaactggcaagaggctttgaagcaagagatttttaaaagatttacatacacttcaaaaagacaaagaatttacaagttttctgaatgctctaagaacaaagaaggaggagtctttcttcttattttcaacaaggggaattaattttgttctttttaaatttgtatttacccttacataagtgatagaacagacagaaaaaaacagctgtggaaatgtgcgggaaattacaatgagtgctatatgaaaaccagaggaagagcatattttgcaaggagtgagggaatagtgctgtcttcaagaactttgcattccccttgtggaataaaactaacatacatttgataataacataactagatatgtaaaatttgtaaagactaaatgtaaaaagaatatagcattaggatgtttaattacgtagtatggactgccagtactataggaattcagtggcctgagggcaataagacctggagtaggcagggaaggatttgtggagattaggaaacttaaatgggattttgaaggagagattaaatctatgtaattcacatttttaatatcagtctaaaacacatctctgtagctgtctctataataaagataaacttagcaatggaaccatgatactcacagtccactaggccaaaacgttcccttggatagtgttaatgcttgagtgaacaatgacaccattgctgtgactttttcctttctgtattccttagtcacccctcttctggttaacaggttctttcttttatagctttaagtcttgccttggaaccaatttttttctccagcatatttatatggattcatttaaagcttaacttgcaaagagcagcttattttcacttcttagaaggtactctgcagttaaccttggtgctgtctacagagacaaaaataaatttctttggattttagttatctttctatgtcagagattcccaagaccatccccaggttgacgatttgctaggaagactcacaggactcagcatatatccatattcatggttatgattcattatagggaaataacataaagcaaaattaggcactctccgcctggcacatactaaagttacatactcccagaagaaaagtagatgtcagcataaaccgtattgtttgtacaaacaatctaggcatagtgagtcactcttatttagggaattgtggaatccctcctgaaatctaagttcacaggtgccaggcaaaaaggcccttttaatcatagaagcctcaggcctgctgtgataactcttttctctacatgtttttttttttaatttatacaatgatttgcaggtaaaatcaagagtccacatatcaagtaactgtcttttaaatgttattcatatatttacaggtatgctccagaatcactgacagagagcaagttttctgtggcctcagatgtttggagctttggagtggttctgtatgaacttttcacatacattgagaagagtaaaagtccaccagcggtcagtgtgctttttatttactttcagttttttgtttgttcgtttgatttttataaatttatggggtacaagtacaattttgctacatgcatacattgcatagtggtgaagtcagagcttttagggtatccaccaccttaataacatacattgtatcccttaaataatttctcagcatctactccaccaatggctcacccttccaagtctctattgtctatcattccacattctacgttcatgtgtatacattatatagctcccgcttataagtgaaaacgtggtatttgtctttctatggctgatttgtttcacttaagataattacctccatccatgttgctacaaaagacataatttcattcgttgttatggctgaatagtattccattttgtatgtataccacattttctttatccagtcatccactgatggacacttaggttgattccatgtctttgcttttgtgaagaatgctgcaataaacatacaggtggaggtatctttttgatacagtgatttcttgtcctttaggtagataccccatagtgggaatgctggatcgaatggtagttctatatttaggtctctgagaaatctttataatgttttccatagaggttgtacaaatgcacattctcaccaacagtgtataagagttcccttttctccacacccttgccaacatctgttattttttctctctctcatttttttttccattctgactggagtcagacatatctcactggggtaattttttctcttttttttttttgtcattctgactggaataaggcatatctcattgtgattttaatttgcatttctctggtgattagtgattagcattttttcatatgcctcttgtcagtttgggtgtcttcttttgaaaatgtctattgatctcctttgtccactttttaacacgattattagggggttttggttgaattgcttgagttccttataaattctggatggtagttccttgtcagatacaaagtttgcaaatattttctccgattatgcaggttttctgttcattctgttgattattgattttgctatgctgaaattttttagcttaataaagtctcatttgtctatttttggttttgttgcctatgcttttgaggtctttgccatgaattctttgtttacactcatttccattaaagttttctctaggttttttttctagtatttttctagtttcagatcttacatttaagtctgtaatcgatcgagttaatttttctatatggtgataaatatgggtccagtttcattcttctgcatatggcaatccaatttaccagcaccatttattgaaaagggtgtcctttcccatactgcgcaaagcaatctgcagattcaatgcagttcctatcaaaataccaatgtcatttgttcacagaattagaaaaaacaatcctaaaattcatagggaaccaaaaagagccctaatagcaaaagcgattctaagcaaaaagaacaaagctggaagcatcacattacttgacctcaaattatattataaggctacagtaaccaaagcagcatggtactcatataaaaaacaaacacatagatcaatggaacagaatagaaaacccagaaataaagccacaaatttatagccaactgatctttgacaaaatcaacaagaacatacattcaagtttttttttaacatgagaaaggatttatccaaagaatagtaagcctaggactcactttagagcttttattgcttatttttaaggcaatatcaaacaaaataatcccaaacctattcctaaactagcttgaatttttaaaaaggggatattgggaagctagttagtacagtctcttaatattacttttattaaatccagtaagctaattcattctaggaattattgcataagttaaaataaaccttccaaagtaatttttctcttggtcatcatagaattttttttaatatggaaaagtatgaaaaaataaaaatcatctctaatgcaattactcagagaagaccacctcaatattgtggtatgttacctttcaggcttcattttgtgtataaaagtatatacaaagaagtatataaaacttttataacttttataaaagttcacttatataaatatatattattttataaaattaaggtcatactgtgcagtttgctctccttctgtttcatgaagtattacagcatgggtaatttactgtattagaaaaatgtactgcaaatatgttttctaattgctgagtagcattccatcataaggctatatatgtctgaacaatcattttccattcttcagtcttttaagtaacacttcagtgaacatagtgaacatcctcatgcataaatatttatatttatctctgataattatcttagaataaaagtataagtaaaagttatgaactattttaaaatttttttaatttcaaaatgctttctagaaaagctgtgccaaattatatctcaacagcaatgcatagggatgtacatttcatcatttgccactattggttattatatttttatgtacttttgccaagttgataggggagaagttatatatattttaatttccatttcttttcttaatgtggttgactatatatttgttgggtgtttagggtgggtatgtatatatgtgaattatctcttctgtgctttgcctatctttatatttgtaattttttttcccaatttataagagctgtctatattgaaaataagtaaatgatgtttaagtattttcctagcttataattcagattttaattttataaactttgacatatgaaagttttctttgttgtatttatgcttattcattcattttttcttatattctcttttatattcaactttttatttcaattgaaatgtaatatgataaaaatatgagttttttaacaacaaaaaactcaaaggaaatatgtttttagttcatgtgttttgagccctcctcaggggatttgtgttgagtttattacagctatggaaatggaaattatagaagttccatatttaacagccttatgtttttgatcctaaaagtagtttgttttgaaaaggtttgaaaacatacaaaagcacacatatactaaattttttcccattgactggaggaaattgagaaagaattttgctacaaattaaatgtacaaaaaatattgaaagtgggtttgttttaggaatttatgcgtatgattggcaatgacaaacaaggacagatgatcgtgttccatttgatagaacttttgaagaataatggaagattaccaagaccagatggatgcccagatgaggtaacaatttttttttaatccagggtagtcatgcattttcttttactttttactcaaggacttcagttcacttcctgaaatttaatgtgcggagcttccagataaacagcataatcagatgactgtggaacaaggcatggttatgacatgtgccctgtattgaaaattaatgtcttccaccaattaaaagatggcccttagtgttcatttaattttggtttattttctcctttacagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttttgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaac

SEQ ID NO: 15699 - DNA, 8218 bp, Human
acaggcgacaaggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcaggtggggtgctcttaggacctatccccttaggaatgttgtagataccatccaacctgttgaagtaacgtggcctctggcctgtcacttcccccagtgtcttgtgttccgtgatgtggcccctcaggctcctgtgcacttcctggtcattcctaagaagcccattcctcggattagccaggctgaagaagaagaccagcaggtgggaagaacagggccagggtttggctgggaggagcccctggacccagctagaggtcttgctccctatgaatgaagccacctatgtccctccgctctctctatagcttctaggacacctactccttgtggccaagcagacagcaaaggctgagggcctgggagatggataccgacttggtgagtgacttttggcccttggtccctcacctatgaattctcattcctacttctcaatatgatcttcattcttcgacctctgccatgatcctgactccctaaccccaagctcaatttcagtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaattatgctctcctgtctttaatataaaattttataccacaaaggggaaagaaaactgattcagggctatgatgccccttgactggtctgagtgaaagacactgaggaggtccaacctgtggttaaatgttgcctgcagatatgtaagtcttcttgacaagtggtccaccctaggtcaagcttctagaaaagtaacagtaggaatgagcctaaatgagtaggaagaaactgaaagccaatcctggcccttcttcagaggtcaaaccaggttctaagggcgcttaggaggagggtggtcaatatgagggtcttttattagaggaggagtaatcacacccaaacaaaagcggctgccttttcactattctacgtctcaccattttgctcaagctagtttgtttattttcatccttaacatttgttaaagaccccactcacttttgagaatgaactaagcaaactaaggggaagctacttgcctctcagcaaacaccaagtaggctgtaatctaatgccacaaccctgtgcctgtttccaacatatccccataaagcatcatcttagaaaaccgcacgcaaagactgtttggacgtggagggcgaggtcttaagccagcggaaccctaaaaccccgtctgaggcggaatgccgccgggaccggaaagcggacctccctaacagcactaggctgaagacttccgccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcggtgagagccgcagctctggctgcaggcataaggggacgaggaaggtcagctgacttcctctgctgcgcttttgacagccatgtcgtgtttgctttctttcagatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagaggtattaaagttttggcctgctcccttttcttgaaggctgccctcagtttcttaggggaggcagtagtttacatgagggtgggtaccagaagggatattatagtcattcaacttgggatccacagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgaggtgtgaaatgtgagagggtaggccagaacgagcccattactcagagggaagaagaggaaggaatttctggtggggctgtggattctccagtggatataagggcggaaccccaaggttcttcttccttttctcaagttagtttcttctgggcctccttcttaaccagaccccaccttgcccaccccccaactctctcacagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagagagggacaggtatatgtacagggctgagctgcagagggctacaacttccatataaggtaggtttttttgtggctgttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccagtatgttcgcatctttccttttccctggaagtgggagagtggacatgattcagatgcttcgatgttagtccctttgtctccctctctttccctatgattcccataatcactttcaccctccctttccatgcccccctccccatggcctgccatcaccttcatttccacatccccccgaagctctagctggaagcatcctagctcatctagggcatccttggtggtagaggagacatggatcttcagcgctggggtgggtggaatggggaggatggtggaatgaggaatcaaagaaaaggcaatcaaataattggtgatactgtatagcaccgtgcccgaccaaccatccctgggaagctcccaatgcatatctattaggaccaaaatatgcccaacctcccaatgcatatctattagaaccaaaatatgcccgaggatgcgacactaaggaactgtggtctctcagattaagaaattggagggattatgaaaagaagaaaagggcaagataaattgaggccaacagtggggttgagggctaatgtcttaccttgaccattagactccattcgagaagcagtgttcactgtgtctccaaaaagacaataacggggcatcttcaggccaacaaccccagcacagactggccctttgagaagaaacaggttgggagagtctgggaaaggtggagactagggctggagtgagagtcagccttaccagtatggacccctatgcgtagcctcagctggtcatggggtcggtggcggatgcgaaaggaagaaactgcatctagtaatgctagggccatacgagcaatttctggtgcatggcgttgaccatttcggcctgggaggccagataccaccatgtaagcatccccaatcgtctccacctgattgagagggggattaaaaggtcacctctatttatatccatggggatgggaaaaagtagagggagacaagcttgacaccatcattaatcatcctgacatgctggagaccagaatattgactagaaaataagtgccatggtcctgagtctaggggagaggagatgtctagggaatctttaagtcttctttctccacccagcacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaacaaaaagttttactttttaaaatatattttccctcaccccactaaatcagtctggacccacatcctatatgattcttccatgtctggagaggactggagagaaatgttggataggctgtatttatactccaggaagacaggagctaaatctcatgatggttctgattagggaagtcaaaggattcacaagaaattcgactggagtgtacaattatagtgctggagctacatctgtctacaaagtacactccagcaccaggatgctgagtaccctggagggaaaactgatcatggggtgggtaaggtgtgtggggttcagggagactgagtttcaaagcgggtctctattaaagggtcttctattgaacagctctcaccttgtagacatcaaagttgtcaattatggcatcaaagcaggtatacaggtcattaagaagtgtcactacctaaaagggatagaaaagcagaggccctgagacttgtgcccaattttctaagaattcttaacccacaagccatcaaaagatgtgggaactctagaacaaactcatctttcctattatcaatgaggcttccccaggtccctacccacccaaccccacccgccacctctcacccatggctctcacctgcatgggggtgctctctgctgacaatgctgtgaagccaacaatgtcactgaagtagatggtaacactgtcaaaggcctcagcctgtacagtctctccccgttttaactgctctgccactgaactaggaagcaagggtgccgtatgagccaaactccaagagagcaggagtggaagagagagggaaagtgtatgtggctgcagcagagatgagctgtaacaagaaagctaggcttttcaggtgggagggaggaaagtggctgggaagacattacagtctaatgcaaggtaaggcacacaagtggcggggggttttgaggggaatccctgtgcatgggagctgtctcaagttgggactgttttacatacacttgctgaagcaagggtgtggtagagcagggtcttaagaagaagggatgggcagccagtaagaaggcagcatagctgatgtggagacagaatgacagcaaataatctataagcaggggtgctccctgtggccagcagggttctgagggtggggaggcgagttctcaggtgcctgatgaggcagagcccaacagagcagaatcccaaaagaaaatacaggaagggggacaaagtctcactggggtaggatttggtagagcagagcttcagccttgcgtttttcctccagataggcctgtgtgcgttcctccaccagcttctccaagttattggcatactgttccatgcgcagcaggaggttgtccaatatgctggtgccaccctccctagagggaggccaggataaggcacttgctctaagattctgaagattcccaggacttcctatccaacccaccctctggtcccacctgccccacttcatgcactaggactaatgagtcttctatccctgggaagcccctgccccataatgccctctcacttgttaaagcgccgaatgaagcccttaatctgtccaaagtctggccgctcagctgggtcctgagcccaacatcgctccatcagcaaaactagctcttcattcagttgggtccggtcaatgcttggccggaaatatggccgctgaccatttcgtaccttctggacaatctctgagggtgatcaaaggtttggatgaag

SEQ ID NO: 15700 - DNA, 38983 bp, Human
cataaaacaaatctcttattccttgcccctgattttactttttgaatggagggtatagcatggcagggagggatgagcgagcagtggagctgagcaatagtatatctgtgaatgggagggccataacgctcagagcgaggcagcaactgagaaacgtgggggaggaggacctgaggtttgtgtgaagcctttccagaaaggatgacacttagatggagttttgaaggatgagtagaagaccagcaaggaggaaaggaagttttaggaaaaagtaggtggcatctataaaggtatagatatacggagattcactagttgaactggaggcagtttggtatggctggcactttggcacagagaagggtaattttaggcagggaagagatggtggaaaggaagatcactttgaaagtttgtaggaggccgggcgcaatggctcttgcctgtaatcccagcactttgggaggccgaggtgggtggatcacttgaggccaggagttcaagaccagcctggccaacatggcaaaaccccatctctactaaaaatacaaaaattagctgggcatggtggtgggcacctataatcccagctactcgggaggctgaggcaggagaattgcttgaatctgggaggcggaggtagtagtgagccaagctcgtgccactgcactccaacctgggcgacagagtgagactttgtctctaaataaataagtaagaaagtttataggagacaggcaaaccacttgacagctgttaagatcgtccagacctaaaatgagggactggactaggggaagtccttgtatggatgaagaggaggagatagatttgaaagatatttagggggtggaattgacagcattttggagatatggggtgaagaacagaaaagacaaggatttgaaggcatttggatgaatgaaattgcataactcagagaacaattgaggaggaacagcttccgaaaagaaaatgagttcagtttgggacactgactttaaggtgtttataggacatagagcaggagatatctgataggcatttggagttgtcagttttgttggcactggtgtgtaggtactaatgagggcttgaaggtcaggtttttatcttactcatctttctcctgcccagcattaatcacaataccttgtatttaggaagtgtatagtgtgagagtgaatagcctgtgttccttatgagacatgatctggaatgttggggcagtaattttccctctcaagacctgtgtttccctttctataaagtgatggagtagaactagatcagtggttctcaacaactgattttgcaacaacctactatgttgggctcatctgtgagttatggcaagtaatttttaataataaagagctgatatttcctcaccttttaaacaagagctgatttatatcactccttcttaatggcattccagtgtgttttcttgagtgtgagaggatggggtggtgttacagttagtttgctggagtttcttcttctttttttttttttgagatggagtctcgctctgtcacccaggctggagtgtggtggtgcgatctcagctcactgcaagctccgcctcctgggttcacgccattcttctgcctcaacctcccgagtagctgggactacaggtgcccgccaccacgcccagctaatttttttttttgtattttttagtagagacggggtttcaccacgttagccaggatggtcttgatctcctgacctcgtgatctgcccacctcggcctcccaaagtgctgggattacaggcgtaagccaccactcccagccttggagtttcttaactctggatataccaatgggagagtcacacataagtggaggtgcaaaaaaagattaagaatcactgtactaaatagtggttaaggacttgaaactgaaaatttctatttctgatttagagaagtttaaagtttagttatatctaggagttattctgattataaagtttttattttggcaatttcaggaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatgggtaagatgaaagcattttcttattcttcattgcaacagtgtgctagaaggagcttgggttttgtagccatatgggcccagcttcaaattcctgttctgctgcttagtttttatgtggccttagagtagtcacttagcatctctgagcctcagtttcctcattatataatgtagtgaaaacttatattgtaaattattgtgaggaatggagatcatgatatagagcatccatcacaatgatgccgcttagtagatgattgataaatggtagctataaataatattactgtttgttattagttgttacattcaaacaaatgccacttataaatacatattgtatgagtataataatgtgattccatgtaaactgttttgtgagctgtaatggcaatctttaaaactggtttataggccaacagcatataaagtagtagatatggaacaagattttaaaaatctaatctgcaaggtaaagtagagagttacattactgtcaccattgacatttattttgctgacattaggtttgttattaatcacaggctacatttaaaaagtgaaagttgggccgggcacggtggcacatgcctataatcccagcactctggggggctgaggtgggtggatcacctgaggtcaggaatttgagaccagcctggccaacatggtgaaaccctatctctacgaaaaatacaaaaaaaaaaaaaattagccagttgtggtggcgcatgcccgtagtcctagctactcgggaggctgaggcaggagaatcacttgaacccgggaggcggaggttgcaatgagctgagatcacaccactgcactccagcctgggcaacaagagtgagactccgtctcaaaaaaaaaaaaagcaaaggttgaataatctgagagaacaaggcgtattacatacatcttgatgtatgtaataaaaagtcatttagtgcacccttgtggcatgaatatattaatgcagtctccaaagaggatcacaaatacaatactgtatctgaaagaaccttgcgttaaaataaaattgtccttttcagactattctttaaaaacaaggtgggaattcgctactaggaaatacttaaagagtagagaagaaacttaatggatagctcagggatccacagatttttttttttttttttttttttgagacggagttttgctcttgttgcccaggctggagtgcagtggcgtgatctcggctcactgcaacttccacctcccgggttcaagtgattctcctgccttagccttccgagtagctgggattacaggcatgcgccaccatgcccggctaattttgtatttttagtagagacggggtttctccatgttggtcaggctggtctcaaactcccaacctcaggtgatccacctgcctccgcctcccaaagtgctgggattacaggtgtgagccactgcgtccgtccagatttttttttaatataaaatgaattctggctatttaggagcatcctctcagtagaacagaaattttagctagagcctgagatgaaagtttgagtgggttcttttactgctctgagaaagctttgacaggaagactagtggaagagaggctctcagggaaatggtagtaggttttttatctgcctaccacagttaccaagggtggaagaatagtgtttatctgatgagaccgttaaataggaaatttgactagtacttaatgaaaatgcatgtttaaggtacattctaacacaagaaattggttgcttcttgggagaagaattggatgactgggagacaaaagtgagagacttttcaccatgaaatgttttcttaaagaaaaaaggtttggccaggcacggtggctcacacctgtaatcccagcactttgggaggacgaggcgggcggatcacgaggtcaagagattgagaccatcctggccaacatggtgaaaccctgtctctactaaaaatacaaaaattagctgggcgtgatggcacacgcctgtagtcccagctactcgggaggctgaggcaggagaatcgcttgaacctgggaggtggaggttgcagtgagtcaagatcgcaccactgcaccccagcctgggcgacagagcgagactctgtctcaaaaaaataaaaaaaagggtaaaaaacattttcccctaagtgtatataaaaagtgctgaccactgttaaaagtttagtctctttcttcctaataaaaaaattctctggctgggtgcagtcgctcacgcgtgtaatcccagcactttggtaggtcaaggtgggtggatcacctgaggtcaggagttcaagaccagcctggccaacatggcaaaaccccatctgtactaaaaatagaaaaattagctgggtgtggtggtacatgcctgtaatcccagctacgcaggaggctgaggcaggagaatcgcttgaacccgggaggcagaagttgcagtgagcctagatcgcgctactgcactccagcctgggcaacagagcaagacttcatctcaaaaaaaaaaaaaaaaaaaaaaaaaagaatcttaatcaggctgtttacacttatggtctatgctttttatgtttgtaagttatacttcaatttatttattttaatgtttctcacttcagagttggtgttagattgcttttcttgcatgttacggctctgtgtttaagaacatgttcttatatctttatttctccccggctttagaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtacgtatctcagactttagtcagtctaatggctgtttttgtcagaaaatgttccgtctatttcaatccttttggaaactattatggatagaatactctgttagcaatgagaaggccaaggttttagttcatagaccttgccctgtggtatgactttacctctctgaggtttaccttttctgtaaaataggcttagtggattgagttttaaaaatctctgctatatttatagaatggaatgcttttaatccattaaatatattagttataagaacgatcctaatatgtcaaaagggggagctataaaattataagtgtaatatgccatttcattttattttatttattttattttttgagatggagtcttgctctgttgcctaggctggagtgcagtggtgtgatcttggctcactgcatcctctgcctcccaggttcaagtgatgctcctgcctcagcctcccaagtatgtgggattgcaagcgtggaccaccatgaccggctaatttttctatttttaatttcaccacgttggccaggctggtctcgaactcctgacctcaagtgatccgcccaccttgggctcccaaagtgctgggattacaggtgtgagccactgcacccagctgtaatctgccattttactaaaaactgtaataatggaatggttaggaagtatgtacaccaagtcatttattatatttatttctggtgtgggattatgggtgtttttatgtttgattttctgaattttttttttgttttttgagacagagtcttgctctgtcatccaggttggagtgcagtggcacaatctcggctcactgcaacctccacctcccaggttcaagcgattctcctgcctcaacctcccgagtggctgggattactatgcctggctaatttcatatttttagtaaagacagggtttttccatgttggccaggctggtctcgaactcctgacctcaggtgatccgcccacctcagcctcccaaagtgctgggattacaagcgtgagccaccgtgcctggcctgattttctgaaattttttactacattggcaaaatggtcattttttttttttttttgagatggagtcttactctgttgcctagcctgtagtgcagtggctcagtctcggctcactgcaacctccacttcccgggttcaagcgattctcctgcctcagcctcctgagtagctggggttacaggcgcacaccaccacacctggctaatttttttttgtatttttagtagagacggggtttcactatgttggtcaggctggtctcaaactcctgacctcataatccgcccacctcggcctcccaaagtgctgagattacaggcatgagccaccgcgcctggctcatttttatttttaatgcttttcttatagaattgttggaatactcagattatgaatgttggaagcagtaagccataagtacttattaatataagggattatgatgattattaaaaagcaaaagtcatagttgtagccttagagtatatctttgtaaataagccctatgttccaaaatttttattgttcagtgctctagcttcctagaaattatcttttgctaatcagaggtaaaaaaatccaagtttacaaacagaatgtcagttggttaatttatagtaagagtactacctaggggacaaattaggactaataatctatttaggacctttcatttctaagaggcagatctattgaattataaaattaatgaacagaaaattgatttggttgggtcaggtatggtggcttaccctgtaatcccagcactttgggaggctgaagtgggagtattgcttgagcctaggagttacaaggccagcctgggcaacatagcaagacgctgtctctacaaaaaataagaaaattagctgggcgtggtgctgtgtgcatgtagtcctagttacctgggaggctgggatgggagggtcacttgagcctgagtagttgaggctacagtgatctgtgattacactgctgcactctagcctgggtgacagagtaagaccctgtctcaaacaaaacaaaacaaaaaaaacaaaaaacaataacaaaaaaaaaacacagaaagaaaaagaaaattgaataagcaaagagattttgtatatttttaatctagattacattacatcaggaaaggaattgggctttcctgctatataacgtactccattctacatatttctgttgttcagtctggagtgcagtggtgcagtcttgtcctcctgggctcaagtgatcctaccacctcagcctcctgagtagctgggactacaggcatgtaccaccatgcccagctaatttttaaaatttttttgtagagatggggtctcactattttgcccaggctagtcatgaattcctaggctcaagcaatcctcctgcctcggcctcccaaactgctgggtttataggcatgagccaccgcacctggcccattctaaatatttcttatgcttggacagatttgtaattatcaagggatcgtctagataatgctggtggaacaaccttctgtctcttcagtctctccttttagtatgcttccgatgaaacactcttggattctgttctaattataccattagctctctaggtattctggaaaacttgtatcactgaaaaacttgtaatgaatagaaaataataatgtgccagatgtggtggcacatgcctgtaatctctgtactttgagaggccaaagtgggcagatcacttgagcctaggggtttgagaacagcctgggcaacgtggtgaaactctgtctttacaaaaaatacaaaaatcagccgggtgtgatggtgtgtgcctgtagtcccagctactccggaggctgaagtgggaggattgcttgagtctgggagttcaagactgaagtgagccatgattgtgccactgcactccagcctcggtgacagaataagaccctgtctcaaaaaaacaaaacactagttttggccaggtgccagtggctcatgcctgtgaccctagcactttgggaggcccaggcaggtggatcacttgaggtcaggagttggagaccagcctggccaacatggtgaaaccccatttctagtaaaaatacaaaaattagccaggtgtgctggcacatgcctgtactcccagctactcaggaggctgaggcaggagaattgcttgaacccagggaggttgctgtgagccgagattgcaccactgcactccacactccagcctgggtgaagaagcgagactccatctcaaaaaaaaaaaaaaaaaaaaacaagcataaaacccaggccagatgcggtggctcacacctgtaatcccagcactttgggaggccacggcgggcagatcatgaggtcaagagattgagaccatcctggccaacatggtgaaaccccatctctactaaaaatacaaaaattagctgagcatggtggcgcacgcctgtagtcccaggtacttgggaggctgaggcagaagaattgcatgaaacccaggaggcggaggctgcagtgagccgagatcgcgccactgcactccaatctggcaacagagcgagactccgtctcaaaacaaaaaacagcaaataaccattagaaagcagaatgtagcaaaattgaattgtacttgtagggcttaaagtcctatttgggacaatttaagcagttctttatggaaagaaggacaacagaacagctaaaattgctttttttttttttggtctttaaaccagtgaaaaagaaaactcaagacaatgaggcagagccatccaccactgggcagtaatacattttatataaaacctgttcctgcttcttgatatgcaacttcttttttttttcttttttttgagacagagtcttgctctgttgccaaggctggagttctgtcacctaggctggagtgcattagcgcagtctcgactcactgcaacctctgcctcccaggtttaagcaatactcctgcctcagcctcctgagtagctgggactacaggcgcacaccaccacacctggctaatttttgtatttttagtagagatggggcttcatcatgttcgccaagttcgtctcgaactcctgacctcaggtgatccgccctcctcagccctccaaactgctgggattataggcatgagctaccgcacctggccttaatatggaacttctcatgctatcactctgcttacaggaagatagggttgggtaggccatatataacattgcagctttgtaaccagagtgttaatatataacaatcttaattttaaaattagcaatgttaaaaaggcatgttaaattcctaataatgaaaggcatatcacagtaaatataggactttacaacagaaaacaaaatgcctttatggaaaggatttatgaaagggctgaggctgctgaattatggatagatacaaagactggtaataatatcagaagtgccaggtggagaagcaggtgcaaactttgtatgaaatgtattcttgccagggatgagttgctctggctcattgtcttgcgttttacttttccctggtctaaaaagacttctagtttttgctactttgccatccttctttcataaagaaactgttgctgggcacagtggctcgcgcctgtaatcccagcactttgggaggccgaggcgggcagatcacaaggtcaggagatagagaccatcctggccaacatggtgaaaccccatctctactaaaaaatacaaagattagctaggcgtagtggcataggcctgtagtcccagctactcaggaggctgaggcaggagaattgcttgaacccacaaggtggaggttgtagtgagccaagatcgtgccactgcactccaacctgggcgacagagtgagactctgtcttaaaaaaaaaaaaaagtaaatgaaacaaaaagctggttctttgaaaagataaataaaactgttagaccattggcaagattaaccaagaaaagaagggagaaaatccaaataacctcactaagaaatgaaacaggagatattacaactgacactactgaaatacaaaagatcattcaaggctactatgaacaccttgacacacataaactagaaaacctagaagagatggacaaattcctggaaaaatacaaccctactagcttaaatcaggaagaattacataccctgaacaggtcaataacaagcagcaagatggaaatggtaatttaaaaattaccaacaaaaaaaattccatgaccagatggattcacagcagaattctaccagacattcaaagaagaattggtaccaatccttttgacactattctacaagatagaggaagaaggaaccctccctaatttattctgtgaagcccccatgaccctaataccaaaaccaggaaaggacataacaaaaaaaacaacaggccaatatccttgatgaacatagatgctaaaatccttaacaaaatactagctaatcaaatccaacaacatatcaaaaagataatccaccatgatcaagtgggtttcataccagggatgcagggatggtttaatgtatacaagtcagtaaatgtgatgcaccacataaacagaattaaaaatcacatgatcatttcagtagatgcagaaaaagcattaaacaaaatccagcatccctttatgattaaaactctcagcaaaatcagcatacaagggacataccttaatgtaataaaagccatctatgacaaacccacagctaatgtaatactgaatggggaaaagttgaaagcattccctctgagaattggaacaagacaaggatgcccactctcaccactcctcttcaacatggtactggaagtcttagccagagcaatcagacaagagaagaaaagggcatccaaatcagtaaagaggaagtcaaaccgtcactctttgctgacaatatgattatttaccttgaaaatcctaaggacacctccagaaagctcctagaacttataaaagaattcagcaaagtttctggatacaagattaatgtacacaaatcagtagctcttctatacaccaacagcgaccaagcggagaatcaaaccaagaactcaacccctattacaacagctgcaaaattaaattaaaataaaataaaataagtaaaataaaataataaaatgaaatataaaataaaataaaatacttaggaatatacctaaccaaggagtcaaaagacctctacaagggatattacaaaacactgctgaaagaaatcataggctgggtgcagtggctcacacctgtaatcccagcaatttgggaggccaaggcgggcagatcatttgagttcaggagtttgagactagcctggccaacatggtgaaaccctgactctactaaaaatacaaaaattagctgggcatggtgatgtgcacctgtagtcccagatacttgggaggccgaggcaggagaatcgcttgaacctgggaggcggaagttgcagtgagccgagatcgcaccattgcactgcagcctgagcaacaagagtgagactacatcaaaaagaaaaaaaaaagagagaaaaagaaagaaagatagaaagaaagaaatcatagacaacatgaacaaatggaaacacatcccatgctcatggatgggtagagctgatactgcgaaacacatcccatactcatggatgggtagagttgatattgcgagaatgaccatactgccaaaagcaatctacagattcaatgcaatccccatcaaaataccaccattattcttcacagaattaaaaaaataattctaaaattcatgtggaaccaaaaaagagcccatatagccaaagcaagagtaagcaaaaagaacaaatctggaggcatcacactacctgatttcaaactatactataaggccatagtcaccaaaacagcatgttactggtacaaaaataggcatatagaccaatggaacagaatagagaacccagaaataaacccaaatacttacagccaactgatcttcgacaaatcaaacaaaaatataaagtggggaatggacacctttttcaacaaatggtgctgggataattcgctggccacatgtaggagaatgaaactggatcctcatctctcaccttatacaaaaatcaactcaagatggattaaggactttaagatctgaaactataaaaattctagaagattacatgggaaaaccccttctagacattggcttaggcaaggatttcatgaccaagaacccaaaagcaaatacgataaaacaaagataaatagcctggacctaattaaactaaagagcttttgcacagcaaaaggaatagcagagtaaacagacaaccacagagtgggagaaaatcttcacaatctatacatctgacaaaagactaatatccagaatctacaatgaactcaaacaaatcagtaagaaaaagtcccataaaaaagtgggctaaggacatgaatagacaattctcaaaagaaaatatacaaatggccaacaaacatatgaaaaaatgctgaacatcactaatgatcagggaaatgcaaatcaaaaccataatgcgatgccgccttactcctgtaagaatggccataatcaaaaaatcaaaaaacagtagatgctggcgtggatgtggtgatcaggaacacttctacactgctggtgtgaatgtaaactagtacagccgctatggaaaactaccatttgatccagcaattccactactgggtatctacccagaggaaaagaagtcattatttgaaaaagatacttgcacacgcatgtttatagcagcacaattcacaattgcaaagtcatggaaccaaccaaatgcccattaatcaatgattggataaagaaacggtggtgtgtatatatatgtgtgtgtgtgtgtgtgtgtgtatctatatatatctatttatatctacatctatatatctatgtgtgtgtgtgtatctatatatatctacatctatatatctacatctatatctgtatctatgatggaatactatgcagccataaaaaggaatgaattaacagcatttgcagtgacctagatgagactggacactattattctaagtgaagtaactcaggaatggaaaaccaaacattgtatgctctcactgatatgtggaagctaagctatgaggatgcaaaggcctaagaatgatacagtggactttggggacttggggggaagagtaggagggggcgagggatagaagactacaaatatggtacagagtatactgctcaggtgatgggtgcaccaaaatctcacaaatcaccaccaaagaactaactcatgtaaccaaataccacctaataccccaataacttatggaaaaataaataaacttaattaaaaaaaaaagtaagtggagctcactttcagttttatgggataatataggccctattggtaaataccttgcgttgtttgacatagcactgtcaatctaaactttttaccttttaaatttttgctgaggaaccgtccttgggatcccagcctagggatgagcgaaactctcctagtcctttaacagagttagaaacacttgccacttgttgaatctggtaggtgatagtacaggaaagctcctgtgcattctaggaaatatgtttaatgcttgttcagcctcaaaatgccctgatatgcaacatattattattcattgatattgctgaatattcactaaaaacattagttagaaattgggaagagtcacattttttgagtgctttggaatagtttgggttttaaaacagtgaatttctagtgcctgctatttaaagttatgtttgtggcagcatgtctttgtaaaatgttaagtttgctgaatacttggatttgttgctgtaaattcttatcatttgactctaatttggatgccctgttcacaatttgacaaactgtttctatcgtagaatttttaaaagcacagacttagagtcttgctttcagaatttgcttctttctcttttaagattcttaactaatgaagcaatgtggtttgattttctttaaacaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcaggtaattgaacttgaaaatgaaattatgccacctacttttcccaattttatgtttctattacttcttttaactgccttcctatcttgctcatcttatcattgaagggcactctattctgaaatgcattccaattttcaaaggattaccaattttgctataactcaaaaagtttgtaatgtttttgccaagtccagtagaaacttaataataaaaagtctgtctactgtctactttagtctcatgtttagtactaatattttccctccagtttccaccagttaagaaactgcagaagccaagagacataaatcttagaagttgaagtgaaagatggtcgggcacggtggctcatgcctgtaatcccagcactttgggaggccgaggcaggcagaacacttgaggtcaggagttcgagaccagcctggccaagatggtgaaaccctgtctctgctaaaatacaataattagccagccacagtggtgggcacctgtagtcccagctattcaggaggctgaggcaggagaatcacttgaacctggaaggtggaggttgcagtgagccgagatcatgccactgcacactagtctcagtgacagagtgagactccatctcaaaaaaaaaaaagttgaagtgaaagaatctctagaaaagtagtgattccactatccacagtaaaatagccactaatattttttcttgctttctttcatatttatgttagctataccttaaagtaatcttgagctgaagcagtttaaatctggagtccccagccagtcccaaccggttcatcctcaagcctgccctggctgatcacttgcttaccagtggatggtactatagattttggtactgctgagaccttaggcgagttaatgggggtgtgagatattaatgagaaatgtcagaacatagcctaacactgaagaatttccaaacactggttatctttagctgacaccactcattgttgagttcttaggcttttttttggtaaaggaggcagaacccattctctgcaatgtcaagatatcaccaacttactctgaaagaacccctgtcttagtattcccttgaagaatcttttctgttagggagaacaaagtaggatattagttggaaaaaaatttaagaatacccaacccagattttttccaggtaatgtatcaatatttcaaaaatgttaatatttattcttttctgacctttaaattttttataaatatgtgtaatgtaactatgtatcattctcgttcagcattcattgtcaatgatatattctgtttataatacactttcctggctgtatatactttagaattagaggtattttttttctatgaaagtaaagggtcccaggtatatctaagtcatggctgccacttgcctctaccctccacagggtttttgataagctatacacagggaacaataggaaaataagaatcaaggcatcactttatcattatctggcttagtgccctgttccccagtacaggactccctccggaaaatggattatcgaagccttaagccaaagaggggctttcaactgaatcgaaacctgaatcttggaatagtagtggtgccttctggtgtgccatgtactacagtttgagtatccctaatcaaaaaatctgaaatctgaaatgctccaaaatctcaaactttttgagcaccaatatgacgctcaaaggaagcgtttattggagcagttggattttggatgttcagattggggatgctgatctggtaagtattacagaataacaaatatttcaaaatccaaaaaaacttgaaacccaaaatatttctggtcccaaccatgtcgaataagggatgctcaacctgtacaataattacagatgatgctctggcaagactgtatatagagagaagtggccaggccttctccagggaattagaccctgagtccatttacctaccttgcaacacaataaaagttaaaaaaattgagaaccatgcatgcacagctttggttaaatgagtggcacctgcccagtggtaagcatggtgtggtcagacctctgccttctaaccagtcaggttagcaattttcctccctaggtatggggtagttaggagggggtcagttgagaggcaagcagagggacattaaatattgcctccccttcatgtatctttaaatttttattaagtcatgcagttaaaatagaagccacagttatcagaatctatgtgtattttcttggagtttagttcatataaatgggagtgctatcccaccgagttcttgttagtgtaaaggtgagtgtagctgggcagaggctctctcatcagcttggtgtgtggagcctgagagggttccatttgggaactctcaggttaagagatacaggctgttggcctgtctttagcctcttaattgttgtttaaggtaaaggcttttactagggcattgataaaagttatttgctttgcctagttctgtttgaaaagtcccaactgctgctttttgagttcctagatgagtgaagcagaggacattttagatatccatcattcatgaaaaagccagtagttaaaattactatttccctaataactgatgtgaggtttttttagggagatttctttacgtgggctatacttgccaatgaaaatggtttctttatctcacaaaccatttaccaattggttcttttcattttcatagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggtatttacctttgctcatacttcaactgactaggctttatacatacgtgagttgttataaggtatgcatatatcagtactgagcatatattttgtgaacaagtgagtgaatgaggttaataaccagttgaagcctaaaatctatagtcgataaatagcacacagtgattaccaaatattttagatctctacttacattttattgtctttgtaatatcaattagcactaagtggttctttcttttttttttttgagatggagtctcgctctgtcgcccaggctggggtgcagtagcgtgatctcggctcactgcaagctccgcctcccaggttcacgccattctcctgcctcaggctcccaagtagctgggactacaggcgtcagccaccaagcccggctaattttttgtattttttagtagagacggggtttcactttgttagccaggatggtctcaatctcctgacctcgtgatccgcccacctcggcctcccaaagtgctgggattacaggcgtgagccaccgcgcccagcctaagtggtttttaattatggtctttcatggctgtgtttaagagagaatgtggttgaatgtttcatgaatatatgaatgctagtcttttattttctgggcctaatgtagaatcccttcagtcagtactttagagtatggtagttctaagtaaagtgccccttaagtataagtaggattattattaatgaatttgctaactgagctaggtcctgttattaacattagttcaagttctaatcctgtttacatgcagtggaatttaatggaagctgtaatggaaaagtgtgtatcattaaaggaaaaagaactggactagaaccaaggagatgagttctagctctgctctttctccagttcttcataattgccacctttctgttatatttagatcttcttcccttctcattcccagcatattactttactccccacttcatagagaaaatggaagccatgagatggaaattctttcaaattcctcaattcatttatttagaaaatatttagtaaacacctaccatgtactaggcactgggatttggcaataaactagaccaagaagagctgggctctcgtgtaacttacattctagtgggagaggagatagatgatagacatacacaaaagaaataagaaaaatatcaggaattctatatgctgtgcctgctgtaacacaaggtatatgatggactccattagattggttaaaggaaggcctctttaaggagatgacacctaagctgaaatctgaatgacaaggagtcagctatgtgaggatcagggagaggcagtggcaacagccagtgtgagggccgggaggtgaacttggtgtatttgagaaatggaagcgctattgtggctgtagagtagtgagcaagaggcagagtgatacaggtgatgttagagaaggaaacagatgcatgtaagccagggtaagtcatttggaattttttctaagtgtaatgggaaggaatgacatgacaagagttgcattttggaaagatcactccggttgctaatatacagaatggaatgtcggtggggggggcgggggggcaagaataaaagcagggagaccagtaagggggctgattcagttgctcagatgagagatgatagtggctttgatgaagtattagagatggaaaaaagttagatttgggtcttgttatagtacttgctgatgcttggatgcggaggtgaaaggaatcaacaaggaagcctagatttctgattgggcagtgatatgctgggaatgagaagggaagaagatgtaaatataacagaaaggtggcaattatgaagaattggagaaagagcagagctagaactaatctccttggttctagtccagttctttttcctttaatgatacacacttttccattacagcctagatttctgattgggcagcgatatggggacactgagggaggaacagatttggggagggattgaattaagagttctcttatagctatgtgaagtttgagatgcctattagatatcaaagcagacatggctagtaaacagctagatagttccaggaagagttagagttggagatagaaatttgagagtcattggtatagagatgatgcataattggttgtcagtttggctgctataacagagaccctaaataatagtggctgaaataagttaaatgttctttctttctcagtggatggcagctccacaatcatcagacttagcccccatctattttcttagtggttgctctagctattgcttgcaagtctctgttttagcctttggaagaaggaaaagagaagatgcctttcactttaaaggcaagacctgaaagttgcaaatctttcttctcacatccatcagaacttagtcacatggccacatctggctgcaaggcaagctgaggaatatagtcttttttgtttgtttgtttgttttgtttttgtctgaaatgatactgttctgttgctcaggctggagtgcagtggtgtattcatagctcatcgtaaccttgaattcctgggctcaagttatcctctcactttagcctcctcagccatgcctggctaatgtttttacaaaatgttttgtagagacagggtcttgctttgttgtccaggcttgtcttaaactcctggtctcaagtgatccttcctaccttggcctcacaaagtcctggaattatggatgtgagccattgtgcccagtctgtgttttgtttgttttctttccttctttcttttccttccttccttctttctttgtctttctttctttctctttctctctctctctttctttcttttttttttttttttttagtgaagcagtgctgggggaggaggaactggttgtgatcaattagttgtaaacaccagccagaatataatctttggctggggatcagatgcctggctaaaaattctgtttctagtatgaagaaaagatattgaagataatggcaccagccatagatagtatttaaaacccaggccaggtgtggtggctcaacacctataatcccagtgctttgggaggccaaggtgggatgattgcttgaggctgggagttcgaccctagcttgggtcaagatagtgatattttatctctgcaaaaaaattttagcgtgaacccaggaggcggaacttgcagtgagccaagatcgcgccactgcactccagcctgggcaacagagcgagactccgtctcaaaaaaaaaaaaaaaaagatagtgatattttctctctacaaaaaaattttaaaattaggtggacctggtagcatgcgcctgtggtcctagttactcaggaggctgaggcgggaggatcacttgagcccaggagtttgttacagtgagctatgatcgtgccactacactccagccagggtgacagagcaagactccgtctcaaaaaaaaaaagacttgtaaatagggcagagaatggagcccaggaccaacctctggagcccttcaatctttagagttctggtgaagagggaagggccagcaaggaagactgaagaggaacaccagtgaggttggagggaaacaaggagagtgtgctatctataaagcccccaaaataaaatgttttaaggatggggtggtggatactgctgagttcatttaagatgtgaaaggacagccatgcacagtggctcacgcctgtaatcctagcactttgggaggccaaggcaggtggatcacttgaggtcaggagttcaagccagcctggctaacatggtgaaacgccatctctaaaaatacaaaaattagccaagcgtggtggtacacgcctgcaatcccagctactcaggaggctgaggcaggagaatcgtttgaacctgggaggtagaggttgcagtgagctgagattgtgccactgcacttcagcctgggcaacagagcaagactttgtctcaaaaaaaaaaaagtgaaaggagaattgaaccatatgccaacatggtctctgtactttttgccactacacttaaataaacgtatataaatgtgcatgcccatccatcctttccttcttaccttttttatagcagggtgtgggcatgggtgtgggtgtgggtgtctctcctgcctgtctactgcccatccttctacctgtgttttcaatcccaaccactcctgccttctcagggacctatccatgagtgatcttttctcatccttctttatttaacctcctcatcatttaaacatgcctaagcctctcacatcttaaaaacaaacaacacaaaacaactcctttcttgaccccacacctctctccagatgttactcgtccactcttctcttcttagccaaacccattgaacagtgtggccattttcgctagatttactccctcatattggtcaggaaatgtctggagggaaagtgactgcctgaccagccaagtgaaccactggctgagtagatggaaggcagggcaggttgaaagagagtgaatctcatagatgactaggcaaatggtaagtggatgccaggttggtctaccttatttattttaataaacaaaaacttgatttgttctccttgggaataaaggaccctagggcccttaagtgtttgatgtactgaaatcttgccaagagtactttaaaaggtataaagtagaaaagttgaattttccctaacaaaagacttaacctgaagtcagctggatttcaggtctaattatgagcatagtacactgataatttctttattctttggatattcccacttccaaatccttgtaatgtgtcactggttttacctaggggagaatgttcttcatgtccgggatgctgacacccaagacaaaatattgcaagcactgcaccttcagtttggtaaacagtacccttggtgagtataaaacattctttgttgagtgatttaaaaggggagctaccttcagtaccattttaaagctacaatcactgtttaatcatcctaacagagctttccttcttatgcctacgggcccctagttgctggggagacagggattgctaatatcatacccattattactgttccaaaggttccaatgtagaatacatattttatttcttttttttttttttttttttgagatggactcttgatctgttgcccaggatagagtgcagtggcgccatctcagctcactgcaacctccgcctcctgggttcaagcaattctcctgtctcagcctcccaagtagctgggattacaggtgcgcaccaccacgcctggctaatttttgtatttttagtagagatggggtttcaccatgttgggcaagctggtctcaaaactcctgacctcaggtgatccgcctgcctcagcctcccaaagcgctgggattacaggtgtgagtcactgcgcccagccttattttatttgtttctcttaattaatacaacacttttgctacacttatttaaccttctttggctttctataaatattagaaaataatgtaactgattttttttaaaaagtctagttcagctttttaattaattttgaccaccctcctttctgtttcaaatcgatgagatttccctgtatttgaatatttctttctgaaaataattttgttttctcagaaatataaagataaaaactaaaaaaagcaaaaaaatacaggcacttagttacaatgttgctgaagagatctagatattattttatataaaatttttttagttctgtataattatgatttatagtttttaacttttaattgacagataaaattgtatgtatttattgtgtacaacatgatgttctgaagtatgtatatcttgtggagatgttattttatttcttttttgttattgttggttgtttttttttttttttttttgagacggagtcttgctctgtcatccaggctggagtgcagtggtgcgatctcgactcactgcaacctccgcttcccgggttcaagcagttctcctgcctcaacctcctgagtagctgggattacaggcacccacaacgcctggctaatttttgtgtttttagtagagatggggtttcaccgtgttggccaggctgatcttgaactcctgacttcaggtgatccgccagcctcgacctcccaaagtgctaggattacaggtatgagccactgcacccagcctatttatttctttaaacatgatttttaaaattactttttgtagagatagagttgctatgtctgtgttgcccaggctggtctcaaactcttgggctcaagcaatcttcctgcctcagccccccaaagtgctgggattacaggtgtgagccactgtgcacggcaggaagatgtcactttaggaagaagcatgaattatttttacctgaagtctcagtttccattacattataccctcactaccacttaacatgtatggcagaagcatataatttaattgactttttgtatattgcagttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaaggtaaaataactcctaaactcctaactttatatcccatatgagcgattgattttttttttaagtatatatagttggaaggtaagactagaaacatacacaagagcttgtaatcatttgctgatagtattgacttgtggatcctttacaatgtttgtctcactattttactgatcattaacatttcaaagaagtaaattctttgggaatccaagacggtagacttgacagtgggaagacccctttaggcatcagatcgggcttttgccacccaaaagacctgaaattctatacttggtaacagcttggagtgtggagtatgctgattactatcactgcccaggtgaggggtatcagcaaatggtgaagggagctgcctcttctctagaatgtgatcagttgtgtggattttccattttgcatttttacagttctgctctttattgagtacagcataccttcaatctgttaaccaaaccatcacccagtgttgacaggtgagagaacattcataaaaataacaaactgttcatgttaaagtgatctctaatgacttagaataaacctactagaaaaatcttggtttgaaatagtgtgagtgtataaagcttccagagacgatgagaaatagcaaagattttaaatgtaaagttgtaggaaatttattaataccattaggtcaaataaggaaagcaaaacaaaacataattttctcaagaaaagccaagaggcctcccttataaatactcttttaaaaactaatagaaggctggatgcagtggcttacgcctgtaatcccagcactttgggaagtccaggtgggcagatcacttaaggtcaggagtttcagaccagcttggacaacatggtgaaaccctgtttctactaaaaatacaaaaaaaaaaaaaaaattagctgggcatggtggcaggcacctgtaatcccagctacttgggaggctgaggcaggagaatcgcttgaacccaggaggtggagattacagtgagccaagatcgcaccactgcactccagcctgggcaacagagtgagactccatctcaaaaaacaaaacaaaaactaatagaagaatagtttcttaacagaaagatgatttattccatatgaaaggccaacatctttttcaatggtgaaattctagaggcattcccattgaaatcaagaagaaaagaaagatgttttgtgcagcattatctcacataattttggaagttatgagggaataaaggaaggaatagcaaaaatggagattattgatagggtaaaacaaaaaacattattaatagacaaaaaaatgcttggctcccaccctggactggttaaattagagtctctggggatgggggccaggcatcgctcttcgttaaaagctgtccaggtgattctgatgcacagcgaagattgagaagcactactctagattttttattctcttaatttaaaaaaatttttttttagagacaaggtcttcctatgtttcccagactggactcaaggtcctgggcttaaatggtcctctgcctcagcctcccaagtataatagctaggaccacaggcacatgccactgtgcccagctctagatgtatttttgttttttgagactgagtcttgctctgtcgcccaggctggagtgcagtggcgtgatctcggctcactgcaacctctgcctcccgggctcaagtgatttttgtgcttcagcctcctgagtagatgggactacaggcttatgccagcatgcctggctaatttttgtattttttgtagagacagtggttcaccatgttgcccaggctggtcttgaactcctgggctcaagggatctgccagcctcgacctcccaaagtgctgggattacaggtgtgagcgaccgtgcctgacctagatttatttttaatgacaatcctagtgacagctctaaccctatatttgagatataaaaatccactaataacaaaataatataaatggaaagagagatcttattcagaacaacaacaaaaactcctaagaataactgaaaccaggaacgatgtaatctatataaagaaaattctaaaactttactgtaagacataaagtcttgaaaaaaatgccctggatggaagtgctgattatttttaagatgtcagtgttttcccaatttgatttataagatcaacataatctagtaaatatttcaatggtatttgttttacatttagtaaaattattgtaaatcacagtggaatttctcaaagtttaacattaaaagtacaaaagtcagttgtgcaaagaaaaaagataaagacaagtaatcaggagggactatccctgtttggtattaaaacatatcaaaaagcacagtaatgtgttttatttttttgagacagggtttcactctgtcgcccagactggagtgcagtggtatgatctcggcttactgcaacctctgcttcctgggttcaagcgattctccagcctcagcctctcaagtagctgagactacaggcgtgtgccaccacgcccagctaatttttgtattttttatagagatgggatttcctcttattgcgcaggctggtcttgaactcctgaggtcaaagtgatctacctgcctcggcctctcaaagtgctgggattacaggcgtgagccaccacggccggccatataataatttaaacaatgtggtatttctgccagccaggatggaaatttaccctaaggaaatagagtatccagaccatcactgaattcagttacaggagatgattaaagctcagctacttagttgcctcagtgtttttttgtttttgtttttgagaaagggtctcactctgttgcccaggctggagtgcagtggcgtgatctcagctcaccgcagcctgaacttcccaggctcaagaaatcctcccagcttagcctcccaagtagttgggactacaggcatgtgccaacatgcctggctaattttttgtagagaggaggtctcactgtacctcccaggctggttttaaactcctgggcccaagcgattctcccgccttggcctcccaaagtgccgggattacaggcgtgagccactatgcccggtcacctcagtaagcaagaaagttttgtcaacctgaaagagtaaactatggtcttttaatgaactaggctcaaattagcgaacattgaacttaagcttaagaaaggggcccggccgggggcagtggctcacgcctgtaatcccagcactttgggaggccgaggcaggcggattgcttgaggtcaggagtttgagaccagcctgggcagcatggtgaaaccccatctctactaaaaatacaaaaattagccgggcgtggtggcaggcacctgtaatcccagctacctgggaagctgaggaaggagaatcgcctgaacctgggaggtggaggttgcagtgagctgagatcgcgccatagcgctccagcctgggcaacagagcgagaggccatctcaaaaaaaaaaaaaagagaggggcccatcttgctgcctgtggagttgtcattgcttcaacagccccatattaggacagattacaggaactacttgagcttaccccagggctggcccagaccaggcagtgggtccttccccaagcagtcatctaagactgcggggccatcctatagcagtgtctaatttgtcatgaaaaagatcacaacactcacaatatgctgcttagctaagaccagtaagacggaacttgttgttttctcttttagggtgaaatagttaagaagtatactcagttcaatcctaaaacctatgaagagaggattaatttaatcctacagatgtgtgtggaagctgcagcagaagctgtaaaactgaactgcagaattttgggagtaggtaagattgtaaattataaatccaagaaatgctcattttaatgtacaaaatttactaacttgtgatgcatgcctgagcatcaagtcagtgtctgccctgtgcatagatggctctaggtgctgtctgtgggccccaagcatggggacttcctgggacaccaacaagcattaggagagaagcactgacagttctagaaatctttaaggtgctatggctttaattcacaactgtctaatatttccttgcagtccttggtaacgtttgtcttaggagatctggggtgaatgaatctgtgttcttaagacaagaaagtcagcatactttcctgagattgctcatcagcattatttccttgtgtttgtggtggagcgcaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggtaagaggggtagggggaggttggttcaggagctagaatgtatattggagcatgtcttcaacatggtcaggtggttacaactctgccttagccttcacttcctgcatgactagagcctgaaggtgagccacatgtggccttttctgagcatgtgcccagccttagacatgcctgtggccttctaaattccaggaacttgtcagagctattcaaagctcttatttcccagagcttctcatttcccagcttttcctcccagtctttttggttagtgtgttggatgccccagctgttatcctttgccctagacagcacagactaatacattttaccttgaaatgtttttttttttttttttgagacggagtctcgctctgtcgcccaggctggagtgcagtggcgggatctcggctcactgcaagctccgcctcctgggttcacgccattctcctgcctcagcctcccaagtagctgggactacaggtgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaaatgtttttgataaacatccttcatgtaaccccctcagcactaggatagttcctagttagttaagatgaaagcaggccctttgaggtggtcctccagggaggtgacaggcaggtcaaaacaaacaaccacaattttttgaaaataagttcgtcctgccccgtcaggtactggtatccagtactgtttctgtacaccagtactgggagtgtggactgttgttcaaggtcaccaccaagctggagagtgggtgatgggaccagggtaggttacaacaccagaaagttctcttatcaagattcagctggttttgttttgtttttagacagggtctcaccatgttgcccaggctggtcttaaactgctgggctcgagggatcctcctgccttggtctcccaaagtgctgggattacaggcatgacccactgcacctggccctggtttttgtttttcttttttaaattaagcattcctctgtttgttgcaaactttggttagtttccagagttccaaaaaggttgattctgacatttttaccagttttttcctcactttagtggcagaatggacctttggagttccctgctctgtcatttttttatgacatcccaatttgttacttttgtttttttactctattttatttttgttgtatatattttaagtgtataacttgatttttaaatgaggaaacagacttagctaataagcggttaagccagcatctgatacagatatgtctaacttcaaaacttgtatgtgcttaaactctacattacaccactatccctttaagctcatgtacttatttatttatttatttaaagagtgagtctcactctgtcacccaggctggagtgcagtcgcacaatctcagctcactgcctcccagattcaagtgattcccctgcctcagcctcccaaatggctgagattacaggaatgtgccaccacacccggctaatttctgtatttttagtagagacaaggtttcaccatgttggtcaggctggtcttgaacttctggcttcaggtgatctgcccgcctcagcctcccaaagtgctgggattacaggggtgagccaccacacccagcctaagctcatgtactttagctcatgctcatcctcttttagttccagacacagttttagcaaacttggataccatttcctggctcagagcagtgactaagctgtaaatcagagggctaggggttgaggaataagtgcccaagaagtgacagatggcaagacaacccttaaaagcagagccttctcaggcacaataccctttactcctttgtaactgctaaacgccataacaaaagacagtcactgatatttataattattgaatcacagatttttagacatggcagcatcaaaaaaggcaaaatcattatttcatattttctgcttcaggaagcaggtagtgtgtgatacattttaaaagacttatcttgggtattcctcagagcagagcctgagacaaggatttaggtacaggtatggttttttggaggtgaccacaagaagcaggagggtgagtgggaagaatgaaacagagcaggaagaaagccattaaggatatattaacattattgaagttgacttgagggcaaagggggctgaactccactagcacctcctaagaagcctgcagaacagcatccagaattgtcctgtggatctgctggctcctgccttgcctcggttgcaggttgcccctgggtgctgtgcctgcgtggctgagtaggctcttgcttcagtgttagagaaagccttggtgcagaaagatggacagtgtgtgctgggccagggggtctgctacccacaaggtgggcatgcatttttgctgcactgtccccacagctgtgtttgaaatcacagtgacccaagcagatgggtcacagggcatcagaggatctgctaaaaacatttccatccaaaatgctgccagagaatgctttgatgcctagtgggcttcagctgtctaaagaagtatctatagaccctcacatgccaaagctctgctaaatagatgaggcgttgtgatatcatagttttctgtttcaggtaaagcaccctcagtgatttctatccctcgctgtaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatggttggtgtccctctctcgaggaattaagtaaccaaatagtagacaagtacttcaaagtggaaattccaaagacagctgaacactgaagccagaagtttcccccttttcacttcttagggaaagagcagggctccctcgcactaaaactgcacagtcttcttggctgacccatattgccactcttcctccccaggggtggtggtggacagaggtctagagttccaagacagcagggaagatttccttcagttttgttttctcagccagtatcacagggagggtacttaatacacattttaatgaagaaataaatggacaaaacatgttatgtatatatcacacatacatgcactgtatgtgtagtatatctgtgcttcatacataaaaacagtgtagatttttggcccccaaaaccaatttgtgagcatatgctgaaggaaaagagatggggagtggaggccgagagtgcaggagagaagtgtatagagccctacagtagggttctgaagaggtgggaagagatgagctgcaaagccaggcagagggtccacgagagggcatggcgagccgagatgatgggtgtatgggacaggaagcaaaaaggtaggggatcactgcctggtggtgccccctatgagagaggtaagaagtatgctcgtctgttggcagtgggggtagaaggactgggaaggtggtgaaggtatagaaaagcgcagtcagagagaatgggtgagagctgtgagggcccaggggagacaggagaccaccagttgatgtctaggttgcagtttgcacagctggggatttttctccttcagggtccagatattctagcagattagtaggaggcagattgatctgagttggtgacgggcagaagacaaggactacagataaccacagaaatacctgctgcttactgagcatttactgtggccagcacttaactaaatactttatgtccatgatctcattccgttcctcaaataaccctgccaggggaggcactactggtctcatcttctaggaaggaggaatgtgtacaggtgaggtgacaggcatggggtcatgcagctgggagtggcagagctggcactgaccccaggcctgtgtctgttcctcagccactgtgcctcgctgccatagaacgcgtggcgctggcagatggcacagcattgtgtctgggatgagtaaggaaggagtgaatgtgggaggagggtgataatttggagaaaagaacacttcaaagactgtctgctactggaagtgagaagtgagggagccagaggggtaggaggctgtcgtcagacttgaggtttttccaggaagataggttctgggttatgtacaaccaattagcaagagggtagcaaaggctttaggggcagtgtatagagatgtttgtgaacgataagctttgcaattgtgaaaagaaaacaccgtcttcccatgtaggggcttgctttccacaggcccagtggtgagcttggcctccccacagctcattagtgactgcttttccttctcactctgttcagaggacctgctcttggtggaagggatgtcagtgccaaaagatgaggctgtgggtgcgctccatctcatccaagctgcgaaacttggcaatgcgaaggcccagagcatcctaagaacaggtgagcatgtggctgcaggtggctgtgctgcagggggtggcctcagatatcatatggcccagcccggccccagaagagaccctgcttccctagggacaggtgctttgcagtgtctgttcagaggtttctttcctaattactcagaggtaaaaagggaattgcattcaaggtatttggcagcattgcctttttcagcaggtggttggtttggtttgacaactataaaaatgctcctttcattttacaggaaatttagagaaatataggacagttgtaagaaaaaatatcacttagttttcccatttggaggtatcaactattaacatttccttcgagtctttctattcatttttttgcctagtggagatcatgtggtacacccggctttttccacttgaggctgtcacatgatcattttctcatattaagaatcaaccgtgaactgcttttaaaacactgcctcccactgcatgccgtggatgttctttaacatttctgctgctggctcttttctgccttcctctttggtattttgattttggcttctctcagaaactcattttaatttttgtctccctatagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataatccttccagctgggcgcagtggctcacgcctgtaatcccaacattttgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacacacacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaatcctgttgtattttgttttgttcgtaactcattagccaaaagcattttccttcccagaagagatttaattgttgcactgcttacgttttgaaggttatataacttccttaaggcctctaatatcattgctttcttaaccaaaaaaagtctattaatagaaagcatggctgggcatggtgcctcatgcctgtaatcccagcactttgggaggctgaggcagaaagattgcttgaaccctagagttcgagaccagcctgggcaacatgccaaaaccccatctctacaaaacaatacaaaaaaaattagccaggcatggtgcagtctcagctactcaggaggctgaggtgggaggatcacctgagcccgggaagtggaggctgcagtaagttagttatgatcatgccattgcactctagcctgggcgacacagtgagaccctgtctcaaaaacaacaaaaacaaaacattgctatatataacattgaaaatttggcataaaaaagcaaagtagcccccaagaaagaggtttgaaactaagtgttaagcatttactgagtccctagacccactccctctttttatgaggccccatgtgggtctcatacaggcattagaaacaatcccaaattactattgctgtgtaacctcaaaactgaagagcttaaaacaacagtaattgtttcacgtcgtggtttctgtgggtcaggatttgggaaaggctcaaacttgacagttgtagctcaagagtatcctgcacttgtagttgtcagctggaatagcacgaggctggctggccaggcatctcccaatgtgtgtggttacagggtctctcaggtggcctctctgtgggctagtttgggcttcctcaccacatgggtagcttcaaaggtagaattttttatgaggcggctcagggccaccagctagttgctccaacaaatcaaccatcagcagcactgccttttatgacctagccttggaagtcatcccagcatcacttttgtcacattattcagtcacctctccatctagagaatgtcacagattttgttgacatttaaaattgccacctcccacctcaagaagcccagctggtgtgggaggcaagactggtccagacgatggcaccaagactaccaaaaataagctgccccaggtagatggccatgggagttcaggggaaggggggtggcctttgaactagttcttaaattggattttgacatttggaatgggattagcaggtcccgtaggaacaaaagtctgggaacaatgattgcttgattgtaataagatttgactaaagggggaggaataagcagaggccagaaatgtgggccaggtcaaggaaagcccaactaagcttggaaacggggaggtagcaggaaaagtaatgaaagctccttccagccaaaaataattaacattgaagagatagtggcctttccttcttggcaatggcaacacctaacccccatcctgagcatagtattacagtttacctcaatctccagtttggaagtaccaggtagttataagcagattactgaaatatagctttaataattgcttggaacatcacctaaaacgagccaggtactatgccaggttctgaagacagataatgaacttactggtgtctgaacaaagcacgggctcctggaaacacctgtggtagatcagcatggtccagtgcagctttctgcgaccatggacatgttctataacctgtgctatccgagtgccacctaaccacatatggctactgagcacatgaattgtgactaggactagaaatgtattttaaattcatttaaatagccacatgggcctggtgaatactgcactggacagcacaggtctagatgaaggattttacaagagaaatatgaaccaagtgcttgggatggcacagaacccaacatgtgctacaggactcaacagtaatggggctagccacacatgaatgccgtcctgactcaggcttactggccggatccaa

SEQ ID NO: 15701 - DNA, 21296 bp, Human; identical to SEQ ID NO: 14504

SEQ ID NO: 15702 - DNA, 21296 bp, Human; identical to SEQ ID NO: 14504

SEQ ID NO: 15703 - DNA, 91538 bp, Human
atttttttttttcttttaattgagatgggggtctgacaacgttgcctgggctggtctcaaactcctgggctgaagttatcctcccaccttggcctcccaaagtgctggaattacaggcatgagcaactgcgcccagccgcaactgttaataatgatagcatcatgactctttggcccagtgactgtgtcaatagtggtactattactctcagaggggaattgttaaaataaattaaaatgaagaccaggtctgcagaattcctgagcagatagtcaatttagtcctcataagtgaccttaaacttacttgagttaatctgagctatttcttgtaaatgcatatattaaagaaaaacagaacaagctcaaccaatcagaagtagtccacaaacttgtataactggaggccttttagtgggatagaccaaataaggcaactttataactgtaaccaatcaaatattttctttttattactttcccattcactctgtaaaaatctgcttcttcgacagagctgagccccagaaccacttctggtttgcagcttctcaattcatgaatcaccgcgtgctgaagtaaactttaaaattttattgtgcctcagtttaccttgtacacagaagcaacagagtcatcagaggagatgttttagatattttaacttattcatgttttccttttgtaaactcgaaagagaggataaatgtaagagcccaaaaacataaaaaccaactttaatatatggattttgtttagaacttgaaaaattgtaaaaagaaatcatgagacaataagaaaaatgtaaataatgactggatatttaataatattaaggaattttaaaaatgttttaagtaatttagccccaggtgtcttcatgagaatttaaaacggtggtcatgctttttcaaaaaaggaggaaaaagggtttaattcaggaacacacagagaaaaaaagagacaatgaattagctttgctagccagtggcttaaacattctccacgtagctgctgggctgatgggtggggtgggacccacttccaacttgtctcttggacaaagtctatacttctcagccggatattcaaggctctccacatctaggtatacaagcgttctcctatcctcttttcctttcaggaataggtgcttaatagtaacatcaaggccaggcacagtggctcacgcctgcaatccccgtactttgggaggaggaggctgggggattgcttgaggcgaggagttcgagaccagcttgagaaatatggtgaaaccccttctctgcaaaaaaaaatataaaaattagccaggcgtggtcacctgcgcccgtggtcccagctattcaggaggctgaggtgggaggatcgcttgagcccgggaggcggaggttgcagtgagccgagatcgcgccactgcaccccagcttgggcgacagagcgactcttgtctaaataaataaataaataatttttaaagtacatcaaagacacattgaggctatatgtgccaaagagctctagtgatgaacccttgtcagggggccgtgtctgcgggaggccgaaggatcccgggtgacatgctttctttgggtgcgaggcagcgtctcggcagaaagaatattgcgagtattactgagggtacgtgaaggagagaagcccctttggttcggccttggactaagccctcgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacattaaaaatcagtaaaccctgtcccccgggggctggcaggcttgaggagagaaattcttgctctacaagaactaaaccaaggatggataggaaactgttaagtgcttattgattgcttcccgcttgctggccttttgagtgcacgccgactccttccgtccaaaagctctctcggtaggagatggggtacagcaggagattgaagtaactcgaattcaaggcagaaatgtccagaggaaatgaagggccatgtatgagtgcacagagggagagaggacatcgacctaggatgagtggaaagtggagtgattccccctagctgtactagacattgaaagatggctaggacgtgtgcatgcaaaagtggtgaagtgcattgcttacagggagacaggcagagacaccttaaaaaaaaaaaaaaaaaaagcaaagtcagccgggtgcggtaggctctcccctgtaatcccagcactttgggaggtggaggcgggcggatcccttgagcccaggagttcgaggccatcctgcttaacatagtgaaaccccgtttctactaaaaatacaaaaattagccgggcatggtggtgtatgcctgttgttccagctacccgcgaggctgagatacgaggattgctcgagccccgggaagttgaggctgcagtgatatgccactgccctcggaagtgagaccctgtctcaaaaaaaaatcaaagtcagttccaacaggggtattaactatagctaggtttcaaatttagctgtaaactatcccaaagaataaaagagaaaatgctgtgtattcttggctaaatcagattactttcctgggccccatttttctccctgttaaattaaaagagattgaactgaaacacttacaaaattatgaaatactagttgtccattctcctcccacaaccagtcagttctgcaggaggtagtacagtggagtggttaagaacattgagcaaattacttagctttaatctttttgtgctcaaatagccacatttattataaatggtacctcacagattttattatgagaatcgaggtaatacatgtccagcatttagcgtagtaagcagtgaaatattagctattaagtatgttcgggaaatactgcagatggtaccctgtcttataaattcacaaaacacattagattcacaataaagggtccaaggattcctgtggtaaaacaaacaaacaaacaacaaaaaaaaaaaacaagaaacttttttgctgggggaatggcagtgattgctaatgagtatgaagtttcttttgggagtaatgaaaatgttctaaaattagatagtggtgatggctacacaactctgtgaatatactaaaaacaactgaattgtacatattaaaagggttaatttcatggtatacaaattgtagctcaataaagttgttaaagaaagaaacttgtttgctcataaaattctttttttcttcataacacctaaagcgcacttcagaaaatgctgggttagttgatttctaaaggcccttctaagctctaaaagttcatgacaacatatagtttgcattgtttgataaaaaaaaaaattccaagtttgatctaaaagtgagacatgttccttatactaaattctaggaagcatgtattgcctggttccttactaaaggacattgagtaatataatggacaaaggcttccactgtgaattgtagaaagtatagaaaatgcttttcaatcctaaacagaattaagaacacaatataaaattgtatttcagtgaaggctttgcttgtattcctgctcagtcttccttcccttcttaaccgcatccaagattgggtacttctgtctgctctggtataaggctttgcaggttattgaccccctctattatacaactttgcaaatcttattaccttgattattcctattcctgggggatggaggtgtgaaagtgaaatgacttgctcaatggttttctctttggaggatgagaagggaccctatcctgcagtatcagcatcgtgtgtcatggcacctgataatggctccgtttttatttaagttgctttgtaatagtacaaaagagggaaggatataaccttaagggccaggtttcagtaagttgacatttaaggaattaggtaatagtaaacctagaatccagaagaagaaagtaatgaattttaagttagaaaaagcaaacgcctatctggagcaaagtaataagaagcagattctcttaccaaagaagtatcttggcccacactgtagaaagagctaggattggtgatagaccagatatgacagtttattctggtatgcagctgaaagtttctgtctggcatccataaatttaagcaatctttcattaataatacttttcactgtgtgccacttgtagaagaaaatgggaagaggtcaaggaggttatttttatatattataaatgtggtttttaaaagaacaaaagagatattatgaggtttgtttatccaaaaaatactatatgagtacttattatacgtcaggcactgttctaggtgcagagctgctgctccaaggagcttacattctgagaggtgatagacaataaatagataaatatgtaacaaaatgatttctaggtatgataaggatgccatgaaggaactaaaccaaatggctaacacagagaattgtgtgagtagttctttgtgtaaaagaacttcaaaagagtttataagagctgcctctttgagaaggtaaagtttagaactgagatccgaaggctgagaaggtggtgggtagtcttatgaaagacaggggtgaggtccaggaagtgcagaagccttaaggcataaggaacaaaaggttatatggttggaatgtagtgaccaacagagtatgctagggctagatggtgcagagcattgcaaaaaaccacataaggattatggattttattctgtgcacagatagaaaccaatagagttttaagtaagagtggtatgattttatttctattttagatcattattgctgctgaatgaaaaaaattattgtagtggggtaagagtataagcaggatgactagaaggccattgcagtagttcaagcaggagataagggttgactcaagagtagagtggtgtggagataggagaggggatatttaaaatatgttgctgatggattagatgtgggaagtgagggaagaaggaattaaggattactcataggtttttttttaatcatgagcaatttaataaaagttgatgccatttactgaagtagggaagatggaggaagagcattttggaggagggttgtaaggtaaggaaaggagagaataaaaagttctatttttgtacatgtttaggatgaatattagtaataattgcactagggccattgcttattaagccaaattccatacttgtgagtaatccatttagcaaatatttattaaactattaatactgacagacactgtgataggcagaggtataaagtggtaagcaaaaataggggcttaagtttagtgggaaattcagacaggaaattcaccccaaaatgtataatacctacatggctaatattatgtggttatattagtacatacctatttatatcctaaatctgaagaatatatttgaggaaaaagcatatggtttcatcaggtatatagcacatagtatgatggatgctgtaaagcacataggtaacttgaacaagactataagtggagtattaagagatgtgttctgaccatgagataattgggagctatacttttagatcctttgtttagagatgggagccctgctgcagtggggaagggaattatctaaaaatactgactgttgaagaggacttcagaagagtcatttgctttagttgtttcataatgatcaatgtctaggttacagctcttttgactctaaggaacaaaacccaaaataagtcaggattagggggctggttatatagcatttaacaggaaatcacatggaaagccaagggtaggaaattcagcacatctctacctcagggactgctacaggaactagaaagttgacaggaaccaagactgacaggaaattagacttcccgtgtgttcttttagagacagtctttatctcacatggcttctctctgtgcatctcttccagtttcctctctccctcaatcagcttcctttttttttttttttttgcacatagtttccacaccctcataaaatgtcagcttcccagcctcagctcttcttgaccttatagctgcagagcccaccaccaactggctgcctgcctcttacctgagtatgatttagtccaatttatcttttgatttaaaaatcatatgatgttttctaaattataggtgagttaccatatgaaatatggtactgaaatagtattaatatagtgagagaaaattttttgtacttttttcctgttaaaaagacattgtataactataggatattactacttttttttttagtaggttttaggggaacaggtggtgtttggttacatgaataagttctttagtggtgatttctgagattttggtgcacccatcactacagtgtacccaatgtgcagtcttttatccctcatcccccgctcactcttcccctgctgccaccgagtccccaaagtccgttgtattgttcttatgcctttgtgtcctcatagcttagctgccacttgataaatgagaacatacaatgtttggtttttcattcctgggttacttcacttagaataatggtctccaactccatacaggttgctgcaaatgccattatttcattcctttttatggctgagtagtattccatagtgtgtgtgtgtgtgtgtgtgtgtgtgtgtgtgtgtgtacacatataccacattttctttatccaatgggcatttgggctgattccatatttttgcaattgctaattgtgctgctacacacatctaccacattttctttatccacttgttgattgatgggcatttgggctgcttccatatttttgcagttgctaattgtgctgctataagcatgcgtgtgcaagtgtctttttcatatgacttcttttcctctggataaatatctagtagtgggattactggatcaaatggtagatctacttttagttctttaaggaatctccctactgttttccatggtggttatactcatttacattcctaccagcaatgtaaaagtgttcccttttcaccacatccactcccacatctgttatttttttattttctaattatggctattcttgcatgagtaaggtggtattgcattgtggttttgatttgcatttccctggtaattagtgatgttgagcattttttcatatgtttgttggccatttgtatatcttgttttgagaactgtctattcatgtccttagcccacttttttttttttttttttttttttttttttgttgagacggagtctcgctctgttgcctaggctggagtgcatctcgtgatctcggctcactgcaagctccgcatcccgggttcacgccattctcctgcctcagcctcccgagtagctgggactacaggcgcctgccaccacgcctggctatttttttttgtttttttttttttgcgtttttagtagagacggggtttcaccatgttaaccaggatggtctcaatctcctgacctcctgatccacccgcctcggcctcccaaagtgctgggattacaggcgtgagccaccgagtccggctccttagcccactttttaatggactgtttgtttttctcttgctgatttgtctgagttccttgtagattctggatattagtcctttgtcagatgcatagtttgcaaagattttctcccactctgtgggttatctgtttactctgctgattatttcttttgctgtgcagaagctttttagtttaattaagtcccatgtatttatctttgattttgttgcttttgctttagggttctcggtcataaagtctttgcctaattcaatgtctaggtgggtttttccgatgttatcttctagaatttttacagtttcaggtcttagaattaagtcttgatcaatcttgagttgatttttgtatgacgtgagagatgagaatccagtttcattcttctacatacagtttgccaattatcccagcaccatttgttgagtaggatgccctttccccactttacgttttcatttgttttgtcgaagatcagttggctgtaagtattttgctttatttctgggttctctattctgttcctatgtgcctatttttatacaagtaccatgctgttttggtgactatagccttatagtataatttgaagcttccatttgaattttaggattgaaattcaaattttaggaactagaattgttttttctagttctgtgaagaatgatgatggtattttgatgggaattgcattgaatttgtctattgcttttggcagtatggtcattttgacaatattgattctacccatccgtgagcatgggatatgtttccatttgtttctgttgtctgtaatttccttcagcagtgttttgtagttttccttgtagaattctttcacctccttggttaggtatattcctaagtattttattttattttttttttttgcagctattataaaagaggttgagttcttgatttgattcttagagtggtcactgttggtgtatagcagtgctactgattttataccttgattttgtatcctaaaactttattgaattcgtttatcagatctgggagctttttggatgagtctttagggttttctaggtatacgatcatatgatcggcaaacagcaacagtttgacttcctctttaccaatttggatgcccttgatttctttctcttgtctatttgctctggctaggacttccattattctttattagtcagtgaatctaatttttgagctgagcactgtgctaattgtaccaagaagcttacaatcaatctggggataccaagagaacccacatgaaatgattagagaagagttaagtgttaaagtttcctactctcactagaatagtagggtcttaaataacaaaaacatcaacatggcctagagttgttggagaagaaaggcttactaagaattaagatgatagttaagccttgcaatatgtttggagtcagcaggaagtgggcatcaagcatttcaggcagaggactgcattctaggtaagtgtagattttctttgctaaaagtaatagaagtttagggaagggaaggctagagaaagactttgaaattttagaattggaatagcaggaagccattgtaggaccttgattagaagagggatgtcatgaaaggtctgttaaaaaaagtaatctggcagtcatattggtactacaattgacttaatataattggctgctgcagcagtgcaatatgaggcaagcagtggagaaggatgtatgtaacttgcaaatgattcgggaaaaaaacaaaatatgtatctatccatacatacatacagatagatatggcagtatgacaagatgttagcagtgttgaattgaggtggtgagtatgtgggtaatcctctcactatttggcgcttccttggctgactgtatactttatgcagatatacccacgtgtatatttttaaagggttaaatgtgacaatttcatgaatgtatttataagttaaagttgcagttctcatttaaatgttttttaagtgattgtcattttccaagttgttttgaaaattaaaatttgattaaaaataagattttacattaaaaaacagatttttaaattaattttttaaatttgaatgatctttttccagtatcaactcagatttagtttttttctcctgaagtgtgtaatacacactcaatgcacgtgcacacacacacatctatgtatgtatatgtgtgtgtatatatatatttatacacatacacactgttttagttgttctttagggagacattaattagagggaatcttttttttttttttttaggaaacaagaattgcttttcattaaccaactgaattatagcttttgtgagacatctgtggcaaaaatcccttttaacttcaaaaatcctataattctatggatatttcttagttttggattagggtgtgtatttgtttttttaaagctagttggctttagaagctgcgtttttctgcatgtggctggagcatgtgcttcctgcttacttgcctgtctttagtatacacatggccaaaaccagcagctgaaactcgatgtttctaattattggataattctgcttgcatattttcaggctacactaataccttcttaagcccaaaaaatgtggcctttagtaatcaatttttaatttttattttataatcacagactattggaataagaatgcaagatacgacactcatactgatgtctttaatgaagataacacctgtgttttttattttcatcatagcagtgtcaaattttattttgaatcattccatctttatctgttcaattccattttatgaaaataagcagagttttaaactattattcttgaagaatatgttaggatcaaattataaacccagaatatgtctagaattcattatcttctcttatagaaagcattaggcctgggagagttttgttttgttttgttgtattgtaatagttgaatgacccaattaatcccttttagttgctctgaaaaagataaagacccttaaatgccacattaattgcatttgaattcttctcccattgataacgaagtcatatgaatggatgtctatttgtagacatttatttcttgaaaaatatgcaacgttaaagattctaataagctttagctatttcaaaggaagaaaaatgtgtgcagatacaataatggctaagggtaagaagagagtgtagaaaatgtgacggagcagaggtcccctgtcctgttcgtggagagtggcaatgccctcaagagaagacatatgctgttacagaggaacatttggttgggaggaggaaagaagttattaccagaagactttaggcttccctctttcatcccattttgtcagaagtatcaaaaagtcttttggaaagactagaaggaatatatgccaaaatgtcaacagatgttgtggcaggacagtggaaatataatttttctttttcttcttgttttccaaatttttgaggttttttaaatgaaaaaaagaattattttaaaaatttaactttgagggatactcccctatagatttgaccttcaccatttaattggaaaaaaaggcttttatagttatatttttagtaagacctctgttagtggagttttaattataacacattttgtgtttctgtttgaaatagacctttgctccaagaaattgtttttcaaaaatccctaggtccaaatcagactcctgtctgcctgattgtttactttttgctgagcctttttctgtttattgggaccatatgttatcttgaattacctttgcttacgaccagcaggattttctgccctcacatgaactttgtgttagaggctagtagtagaaagtgccaacttctagagctcttcaaaagagcacatcagtgtcactcaggagagccttttttcctgactatcctcccagtctaatgagggtagggacatagcagagtcttaggagatggatgtagtttcgtgtggcattgcagaggagttgttataagaaagcgtcggccaggtgtggtggctcatacctgtaatcccagcactttgggaggccagggtgggcggatcacttgaggccaggagttcaagaccagcctagacaatatggcaaaaccccatctctactaaaaatacaattagccgggcatggtggtgcatgcctgtaatcccagctattaatacttgggaggctgaagcacaagaatcacttgaaggtggaggttgtagtgagccaagactgcaccactccactccagcctgggtgacagcgcaagactctcaaaaaaaacaaaaacccttatgagtgcttcggtcctcccttgtgttagcccttcatagaaagtaactacagccttactacaatcaaggcaccttttttttcttctgaaatgtagtgaaatttttatgtgtccttcagaattttgtaaaccaaatgtttagaacttcaagacatgttttgacatagaaatagtattagaaagccagtctcaaaaaaaaaaaaaaaaaggctagctaaccccacaagtcttttatgaaactgatctatagtaatatggcagtaacatcctagaccctgtcgttgttttatggaaaagtgatttccagtttaaaacttagaaacttggttggtaagatctgaagaggacttcttttattcatttgtttactcattcatttctcctcaataccaatcctacttttcaataaaaaaagttctacttttatctaatatgtatactgaagttgtacagatttcatttgaagagaggattatgttgcatacacacgcacagacacacaggttgaatatatatatatatatatatatatatatatatatgtaaaaacaggtgttttaaaccattgtaccagatctacctgcctgaaatgtagtatttttccctcctgtgtcttttgacttgccaattctagacagctgctgacaatgccaactctatcctcttttcagtcttctgcgctctacaacagttacatgcctgtgatgattatcgctatagccaatttatgaattcctctggagccataatgctgcttggcaacctttttccttttctctaatttgacatttctttctctaagttgatgaagcagtgttgttttgaacacaggtttgagaaacatatttatagttgtttcctttctctattttccaaagtggctgtttcaggcctctataatttcaactcaagcccccaaccctatctcagccctatctattttcagatctaatcactatttcactgagaaaatgaggtgctgtcaatttccctgttaatttatcggtgtccttgaattctttactcttgtctagattttgtcctactaccaggtggtaacctgggtgaagttagagagcataacttttgttcactattgtatccctattcctaaacacagtgcctcttttaaaacccacatgcccttccaggaaccacctcatttctctatattctgttttacttccaactggatataatgtaattcagttctgccacccagaatcagcatctaccccgcaagttaaagggcatggtccccaacaagattgcccttaatccagacactagctttagttcaagggtccccaggccacccacacttttgaccaactggctataaatccacggttcccatgaccccctcaggttcaataatttgctagaccaactcacagaactctgggaagcactatactttaaataatggttttaatataaggggtacaattcaggaggaccagtcaaataaagagcctcatagggtgagatctaggagggaatgcagagcttctatgtcctcttatggaatcaggtgcatcatcttcccagtacatcaatgtgttcaaccaggaaagctccactgagcttctatgtccagagtattgattggggtttcattacataggcatacttgattgaattattggtcatatggttgagatcaatctgcaatcccccttcaatccctggaagttgggagatcaggttgataccatgtggctaaaagccccagctctttaaacacatggctgttctttctggtgttgccagcctccatcctgaaactatctaggtcaggggtgtctaatcttttggcttccctgggccacactggaagaattgtcttatgccacatgtaaaatacactaacactaatgcaaaaaaaaaaaaatctcgtaatgttttaagaaagtttaccaacttgtgttgaaccacattcaaagctgggcctgggccacatgcagcccatgggccaccgtttgggcaagcttgataggtgagaccatgggtcaccttgttagcataacaaagacactcctattactcgggaaattccggtgatttagagtctccctcccaggaaccagggagaaaggccagtcaaattatttattatacagtgttctacaactgctcaaaagtagacttcctcaaaagaattgtctgtattttcttgaattgtctcttgaactcactgcagtcaggcttttgccctttatttcacattgataacatttatttaaggtcatcatcaatatcttccacattgccaagtactgtgatcagtttgaaatccttattacttgatagcagtatctaacatggttaacatcttcttgaaacattttatttggctttttggacaccattctttctcttaattatcttcccatacattgaccgttctcacctgtctctgaaggagggaatgcattgctcagttctcagatcttgtccctccccagatgccatcatggctttaaatatcatctacatagtgtgtctcccaaattcccatctccagtttggagtcttcccgaactcatatattcaactccctactcagtatattattttagatatataataggcatctcaaaattatatctaaaactgaatttctgatcatctctctctctctgagatctcctcccttagtcttttccatttcagttaatggtatttctagatatttctgttttcccactttcttggaccaaaaaccttacagtcattcttaattctttttcttccatatttcacttccaatccattagcatatcctgtcagctttatattcataatatatccagattcggactacttaataccatctccactgctgccaccctagttgaagacactacagtctcttatcaagactactgcaatagcctattagtgtttcctcccttactcctgtgtattatatttttaacacaggaaccagagtggtctttttaaaatgttattctgattatgacatgctgctcaaaacccgtgggtggttttccatccttctcagagtaaaagccaaagttcttaccatggcctatagagacctgtatgatctggtccccctctctgatcgcattatgtcctactctacccttcagtcattcttttctagccacactctttgctcttctttgaatacaccagaaactttgcacttgctgtttctgccttttggaaaattcattgtggctcgttcccttactttatggtatctgcttgagtgacaccttttcagtgaagccttcctagcctgccctataaaatacccactcacttccacacacacatcctccttactctttaacttgttttattattgccataacatttaccaccatttcacattcgtattctctctctctgtctccatatatatatatgtatgtgtatatatacatatatagtttaatatctgctctttaagtttcaagagaacagacttatgtttttttgaatgaatgatcagtgcctagtacttaagctgctcataaaatttttttaagttgataaatatcttggaagaagaagtattccctgtttctttccagggatagtgccttctcataaacacttggttttatcccctttggagtcctcttgagacttgttctgtcagaggaacattagctctctactgctcttttctgtctgtaaagaaggtcaagtcttttccactctgaaaaagggagaaaaaatcttggaaccttgcatctttgtataattactactttgtttccttcccatcgttgctagacttcttatgactctatttttgatgtctgtacttactcacctgtggtttactccttaatatcattcacttctaccagttccacagaaagaacctgtgaagctcaccaagtggctaattagtaaacccatttccttttttcattcttcagtctaacttgactcttgtggtgcatgacactactcctcctgtgatgccactctcacggttaacctgcctttctgactattccatctcagtctctttcctttctttccatatctcagatgttactcttctttagaatctgatgctatgttctcttctcactagaaactctccctagacaatatcattcatttccatatactcctttatgctgatgagttccaaatttggatctttaggcttggctttacctgcactccaggcctgaatttctgagtttactggaatttccatcaggatattctataggaacctcagattcacatgctcaaaacaaaattcactatctttttatcagttgactttttattattggtttaaaaatagctctagtccatatggtaattgtaaggattagataagaaaatgcatacaacaaacttagtcaaattctgggacatagaaagcacacactaaatagtagctattattattacatgacagtctcccctattagactgcaagcttcttgaggacagggaccatgtcctcaaacctaacactgtccttgacttgtaataggtgctcagtaaaggtttgttgagttaaaattaataataataataatcatcatctactgaataaatggtttgtgtaaccatctgaattagcttagtcatcttgtttaacagtggaacaacatttgatgtttattttttctccctaggtgcattgtgttgtaatcattcaaaggataaccaaatgtgccgtgatgtatgtgaacaggtaagattacataataattacagaggcagccagacacagtggttcatgcctgtaatcccagcactttgggaggccagggtgggaggattgcttaaggccaggggttcaggaccagccaggacaacatagcaagacccctgtctctaaaaaataaaaataaaattatagaggctactagttatacaactatttattaagtataattgtttttggagaagtctgttggatagtaccttaactaattgtccagggttcacatcaccaataatggggcaaagtgactgtctgctgacatgatacactgagaaggaaaatattataattgcataatttgaattatgaagaagtagtcgggcaaacccagtttgaggaatattcctcaaaacatcagcgcctgtactctttaaaaatgtcagtgttataaaaacaaagaaaggctaagaaactgttacagattaaaggaaactaaagagatgtgacaacaaaatgcaatttgtgatcctggattggatcctggaatgaaagaaaattgctataaaggacattatcaggataaattggtaaaatttgaatatagactggatattaaatagtagtattataccaatactgtgatcctgaatttggtgattatattgtggttgggtgtgatggtgtccttgttcttaggagatacatactaggatttaggaatgaatgaacataatgtctataacaaatgctaacatagtccttcaaaataatagtatgtaataatagtttgtgtatatatacagagaattaaagcaaatgttgcaaagtgtttaggatgggtgcatcttgatgaagaccatgtaggtattcactgtgctattcttaaaagttgtctgtaggtttgaatttttctggttgaacctgtttatgaaagttccactgaagcactacccattcataaagccctacctttctttcaggcttggtcatgtatgtctagccttagcactcgagaaacaatagtctcaatcatcttttagaggagtcttcaagtaataacctggatcttgttatttttaaaactgagagaactacttaactgggactataacttctcataagcaataataatgtagacgtagaaagattttgcaagatacggtctgattataagacatgacactgattcagctcatctaaatggctaccggagaattcagtgacatgtcaaatcactattgcaaattaagtttgctgcacatttactgccagaagaatagctttttaaagcaaaaatggccccttgatgatatcataaggaagcttttaaagtagttctgctactttgggaaacatgacttacctgacttttcactttgtttcttgctttttctactgatgttctatagggtgaatgatttttaggaggtatcttgtaatgaggcaccagcagcaggcaaggtctaatttcttaaaatctggaatgctagaaattatataacttagcaaattaattgaatactatagtcaccctaataaagaacattcttccccaaccaagttcttaactaattgagaaataaggcagataggtccaaaaatattactcctattactggttacacagatgtcgaatgtgacttttatctctaggcacacactaagtgacagaattagacttactcccagaggaggagaggtaagggctgtgttacatatgtttactttcccctactaaactcaatggtcggctaagtcgccatcctgatcatgggagaagtgtatcaggggtgtggagagagaccagggctgttaaaactcgtagagctcacttcaaagagaaggaaatgctgtgagtgaggaatcattatttcttcaaccagtagggaatgcagacaggatggagtcttgatgacatttagattttgaactgagtaaacagcattcttgatgactctaggaggttagggaaaagatatggtttgaggagaaggtgagctgttgaattatcagtgaaaaccactatgtgaagatagggatttggaattaaaacttttggaattagaatttagataagaagtcagggctggtagcttatcatattcagcaaaatatgtgtgatggtttacagtgaaactgtcagcagtgtcagatgccaaagaaaagtcaaggagtttgagatctgagaaaaggcccttagtttaaaaaaaaaaaaaaaaaaaagccaattagtggagattttaaaaacatctccctgcagcagggatttttgtttgctttgtttatgatgaattccgtggtgcctagaacagttaaaacagtatctaacactcaaaactctcaataaatatttgtagatcaactggagcaagggagctaaaagtcacactgcaggcattaaaaattttttaataaaaatatttacagttatgtaattttttggacttacaaaaatgtattcagtttttgtatatgtcttacctgtatatattatgaattccttgaatatagggattgtgtctcatttgcctatgttgtattcatgtccctgctcatgcaaactaattagttaatatttttgagttgattggtgaagaaatgggtacaatgaaaggaaaaagctggaaaagttagtaagtgcaggaagtaaagattagtttcaagatggaaggtttttacttgtttaaagacaaaggaaaaatgagttataacagaggaaggagataagtatgggtaaaaaacttctcagaattcaagactgtaaaccctatggtctgataatttctgccttgagtggcatacaagtttggttattaaattttttgctctgagatgatttgtataattatagtatatattctagtatgtattctgaataagcattcatctttctttttaagtgtgattactagttgtttagcaagaaaagtgactttatattcaagtctaccttattatctgaaagtttacatagtacctgctggtttatttaagctaaatgtatttctaataagtatgtgtttatcagtttaattcattctactttatgggatcataattttagagacagaagggacccaatagattatctaactttttaattttgcttattagctattcaggaaaccagaaactgggacctaaattttattttacacttttccctaagtgccatgccctttactatacccctttacatgcattatttcatttaattcttacacccagcccttgaaaaaggtattgtcattatttgtatattataggtaaagaaattgaaatatagaagacttaaataacttaccaaggtcccaagccaattagttgaggaacagggactcaaactcaaatgtgtctgattacgaagtccatacccttagccaccaggatataactacctcctatgaggccaagtagtttgcccagtggtattcagagtgtatttccaactctcagttctatattctttccattgttctaacctgtttcaagtacttgtaggttttttgccttttttgtttgtttttgttgttgttgaggggagatggaattgcaggaagaagaaatgagtgagagagcatagccttccctgtgctttttcctagtctgctaccaatgtcatatctttcgttttttcttcctctttctctttttcattctttcttatctttcattattgtctttttcaatcgatttttcttttctttcactcttccttttgtctttttataatagaaaattttaagtatatacaaaggtagagagaaaagtgtaataaacccccatattcagcttcaatattattaagtcatgaccagttgtgtttcatttaaatctccttttactttccccactatactgaggcaaatttatgtagcagcaaaatctcaattgtcatattatttggtccatagcttcagtttggagctacaaatgatatgtcatttaaaaaaaaaataaccacaatactgttattacttctttgaaaatgtaatattcaaaaatctagttattcagatttcttaattatttaaaaggtttttttagtttggatcagaattcaagtgatatatatgtattgcagttggttatatgttttttaaatatcttttgatctgtaggtttctccttgcaatttatttgatgaattaatttgatcatttgtcctatagagtttcccatagtccaaactttgctattcacatccccctggtgtcgtttaacattttcctttttcctctgtgtttcttagtaattggcagttagatttagagcagagctatccaatgacactttctacaatgatgaaaatattctagacctatatggtagccactagccacatgtgccaggtgaacacttgaaatgtgcttaaagagactgaggaactttaatttttaattttatttaattttacttgatttaagtttaaatacccacacatggctaacagctaccttagccagatccagagacttagttttgtttaagtcttcccccaaaaatgtctctttttgtgatgttaacagtcattgtgataattgtctaaatgcattaattcactaggcgttgcaaaatagtgatattctatctcttttcacttcttaattgtagttggtagttttggaggaaaatggctaataaataagctaactggagataaatcctttttcactgtccatagcattcatggattttaccgtctcagctatttgcaggtaatcatgaaggtctgtctgatatgtgtaatgatttattatttactgaaacaccaaattgtaattgcataacgtcctatttggaagtgagccatttggcttggtgagtgaacctttgtcagctcatcagcatcaattaaaaaaaaaaaaaaaagctttgtttctatcttacagcattttatggagaatttatgtgccataatgctgtttatgaatttgatcttcaccagtatcacgggtttgatgacagtctatttttcattgttaccagttgactaaaagtaattaagaacagtttagaataaacttatcttttttttcttccttctctcgctctctaacccccagcctctaaacaggttggtagcctgggtttctccactttttttggtcaatagaaaagggtctagacttgctgtatttggacttttcttgcttatttgcgaaactaatcaatgctttttaagaaatgttacctcagcttaacttagatcattctgaaggttttccacttataaaaggagccaggcacggaggctcatgcgtgtggtcccagcactttgggaggctgaggcgggcggatcgctttgagcttaggagttcaagaccagccatggcaacatggtgaaaccctgtctctacaaaaaaatacagaaattagcctggcatttgtggctcatgcccaaggtcccagctacttgggatgctgaggctggagaattgcttcagcctgggaagtggaggttacagtgagctgagatcacaccactacaccccagcctgggtgatagaatgggactctgtcttaaaaaaataaataaaataaaagaacatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggctgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacactatgttttttgcggcattattcacaatagcaaagacttggaaccaacccagatgtccaacaatgacagactggattaagaaaatgtggcacatatacaccatggaatactatgcagccataaaaattgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataattaataaataaataaataaataaataaaaatttaaaaataaataaataaaataaaaaggaagttggaaaatattctagacaactgataaatctagaggataataagttttacctcttcttatttcttatagaaaaatgccacaaaaacttttttttttttgtcaaatagattttctcctcaaaaagtgaatcccgactaaaacatctgttgcagcgagccccagattattgcccagagacaatggtaagtcttattgtaacttaactgtagaagcttctgtctaaatgaaactatccaatgaattactttcagagttagcaaatttttaaatgtgattggaatttgtggtcaaaataaaatgttaagtttaacttaaatacttaaaaaaaatcttcatataaattgctagatagaatattgtttttcttcttttattatcctatgatataaatctaaaaacaatcttaaatataaatgtgttcctatctttaaatttcattatagtattttatctggggtcgggcgtggtggctgatgcctgtaatcccagcactttgggagtctgaggcgggtggattacctgaggtcaggatttcgagaccagcctggccagcatagtgaaacccgtctctactaaaaatacaaaaattagccagacatggtggcacacgcctgtagtcccagctactccagaggctgaggcaggagaattgcttgaacccaggaggcggaggttgcagtgagctgagatagcatcactgcactccagtctgggcagcagagtaagactccgtctcaaaaaaaaaaaaaaattatctggaacttagaattttatttattattatagtttgactaattttatgaaaactataataactaaatctgtttattttgattttggaaaattgaatttgggataagggaaaatatatgacttattatcttccaattttctgacatactgtagatatattgcttacctatctgaatcatgtaactttaagaccttttaaaggtctctaatacttgggctgtcctcagtgtttgggatgctcatgtgccagaccaagaaagtgtgagtttgtttgcaagagcctctttagatatggtggcttatattatgtgaaggggaaaataagttgatgattaaatagttctgactgacacattccctttagtcttcagttttgtctataggcttggaaacagtgattccagtaagtatcctgagtaactagactcatcgttaatgctctcagatgggaaaagaacaaggaatatttctgtatctcagctttgttccccccgaatagctgattgatgtgcctgtagttctagaacattgactgtgtagacatagccataatcaaattagctgttcataatttctgtagaaattaattgtcatatttaggaactggttatctacataaaagccttttgttgggtacacttttaggttgaaatttggaattgtatgaattcatctttgccaggtaagcaataaaagtgtaacatttagcacttaattttaaaaacttactgtgtgaatgtaaaattggtgtcattgtcctggaacctaatttatactctggagtttctatcctctccttcccttcaacacctaaattttttttttctaagacacagtcttactgtgttgcccaggctggtcttgaactcctggcctcaagtgatcatcctgccttggcctcccaaaatgctgagattacaggcatgacccaccatgtccagcccaaattttcaaatacataatttattctcattcactcaatccttaactttgttctcttgtctccacttctgccattctactgaaactagtctttgaaagattaccaggatctcttggttcctagatcttcgggctctttctcagtactactctctttgactttcttgaaacacttgatattattgattactacctccttatgactccaccttggcctcagaacctattctgccttgccttttttttttgcagatggagccgtaaggactatggttatttctgtgtgtggtcttcttcccttctgtcttcacattcaccttagtaatctcattccttcccagaactgttaactaatcagctctgagaaggtgactctcaaatctaaatcattgtttgtaacttctagatatctttgtagacatctctacctggatctctgcatccaggtgccatctgaagcacaaatccaaaatcaaactcataactgcacctcttgtgaatgatactagactggaaacccccaagttatattttactccttgttctttctagttccattgactctccccttgcaaaattacacctgtcctgtctatttctagttcaagtctttattcttacactcgtgggatagaatattataataaccttataactgatgtttcaacacattatatctttctttcctatcctcttcaaaaataatttatcaggggatattcactcccatcagaataaaacccaaactctctagcctgacactcatgatctcccaggattacagcctatttgccagccctggatagagctaatttcttaaaaaaaaaagagtataccttatgtatctctgaattctagaggctatcgcactgtttaaagtttgtatttcaaactggttgcctttctgaaattgcccacctccttgcctgtctcctagttatgcttgtacccagcatccttagtatcctgtaattttctacacacacacacacacacacacacacacacacacacacacacacacacagttgctaacaaactgtaatctcccaaataggataaatcatatattttatttattccataatttcatagcccacataacacctaacagagtgccttgtacatagtaggaccttagtaaatataaatgctttttggataatttagtatgttctaagaggccactggatacctggaaacagcagcatacttcattatgatataacaagtcacagagtttatgacctatgttgattccatttaaaattctttccaacatgtgaggaacctgaatagcaagcagcaaagatttagaagaaactatactaggcaatgaggctagatgtgaatttgttaccctttgtacccttaagacacatagtgataagcttataatatgcagtatttttggtcaatttttataattggggtagtttattatattttgagagctttgtctatctgtgaaccatttatttgccttgttttactttttagcagaatgcttctatttgttgtgtgaagtcctagtttcatttggggaactatgttacttactgccttgaatccctgacattttttttcaaatataaataataatccaacttacttcagatatagatactcaaatttatgttttacatagaagcagcataaggcaattttaaaggagataaggaggaatttgcagcattcctgcaagcataaggcttttctcttttcataattatttcttgcatctcctacttttttttttttttttttgagatggagtttcactcttcttgcccaggctgtagtgcaatggcacaatctcagctcactgcaacctctgcttcccagtttcaagcaattctcctgcctcagccttccaagtagctgggattacaggcatgcaccaccacacctggctaattttgtatttttagtggagacgaggtttcactatgttggtcagcctgatcttgaactcctgacttcaagtgatccacccacctcggcctcacaaagtgctgggattacaggtgtaagccaccacacccagtcttttgttgttgttgttgttttggttttttgtttttttgagacagagtcttgctgttgcccaggctggagtgcagtggtgcagtctcggcccactgcagcctccacctcctgggttcaagcagttctcccacctcaccctcccgagtagtttggactacaggtgtgtgccaccatgcccagctaatttttgaatttttagtagagatgggggttcaccatgttggccagactggtcttgatctcatgacctcaagtgatctgcccgctttggcctcccaaagtgctgggattacaggtgggagccactgagcctggccctatctcctacttttgccttaggattcattcactgacatttatgattgcaaaaggagtttaaaagcaaattggaagcccgggcgtggtcacttacacctgtaatcccagcagtttgggaggtcaaggcaagcacattacctgaggtcaggagttcaagaccagcctggtcaacatggtgaaatcccatctctactaaaaatacaaaaattagccgggcatggtggcagacgcctgtagtcccagctactcaggaggctgaggcaggagaattgcttggacctgggaggcggaggttgcagtgagccaagatcgcgccactgcactccagcctgggcaacagagcaagactccatctcaaaaaaaaaattagaacactttttataattttatcatctttcagtttcacaatcatttggttggaagagtcactgctgaacatcaattgaaccagaataatacatggtcattttgccccatgattaaatgtgcccatcaaagccagatatacctgactcacaaaaattgcccctatttactaagtatcagtttttaaacaggatcatgaattttatgctattctaggtatttactgttttgaatacagtaatacttgtgccctttcttgttagtctgcttatgttaaattaaaatctttgcctctgattaacagtctaacagtaagaaagctctcttccttgctttccttcccttgtacgtcctctggtaaagatgttacctacccaagagtgagaatgacttaaagagcatttagggtgggagggaaaagagaaaaaacaaaagacctgataattatgctgtgagggactttgaaagagactgatagcagtggaagtaagggtaaagggaggtccttaataattttgaggccctgctgtctgaaccagttttcttatggacagctgctttgacttttagtagtagccttgaaacatctggcatgctatctgtttttattgctacttatgaccaaaacatttaaacattttgtttttaaggtgtgtttaagaagtctgatggctgggttggcttaggctgctgtgaactggctattgccttggagtgtcgacaggcatgcaagcaggtaacactgggtagtcaggctctcaaacatcatggagtgcagtttggttttagctgtgcacatgtcttgggccttgcccacctcctagctttgcagaggtaacccgtaaaaactgcaaatttagcattttttgtatagaccatttccttttagacttgctgtttttttatttatggctgctgcatatggcctcagcctgcttttattctttcttatcattccttgtctctgccatgcaaaaaagaatattataggaatttaggtcatccatactttgcctgcaatcatgctgaatcaatgctgatgatggctgggtaaatgtaggctatgcttggatgagaacatttgacacagttggctcattttttcatctccttttctctgtttcatcatggctttaccctgagtgtgttcttatatcccttctctgctcctaagatgaatctgactcatacactgagttattacttatctttgatttgatatagttctgccccaattcagcttaggtgcctgagtttgtcctcactttgtatgttttagtagtggtttctcagagaggaaaaactagcctcttggttcctctactgcaagtggcagaaatagacttaactgggaaactagaagtggttagatggacctgaaaccacagttggaaagccttctcttattttcttcttctagggacttatctcagataagagtatatgagatatggtatcaccttcactttcacagagacgactatcctatagcctgagcaacagtctgggcagcacatgacctagctgtctgctgctgtcctccaggcattgaggtgaagctgagttgcagaggatttgaagtataatgaatttagtgagttgtaaaacagttgctggcccattcttcttcttgttctccctgtcctcatcagctggcctgttctaaattgcactggcctaggtgatagaacaggaagaatggagcaaggaaccagagctcacagctctggaatggaaactgactcatgtggaaaaacagccacccctcagcagattttttttggcttcttttatatagaaagtatatacttaaatatggcaaatagcttgctacttctctaagcaccagtttcctcatctgtagaggggttagtatcttctttataaacttgttaagagacttacacaaaaataacttgttaaatgcctggcatagtacctcttccctatttagttgccccctccgttatatactcagcaagttcagaatgaaagtttagaatgtgaagagttaaagaaaaagcaaaatgtaaatgccctggcagagcttcacaagaaaatttgctacagagtggaattcagctaaaaaaaaaaaaaaaaaaaaaaaaaaatcctctgatttacaatttccttcaaagacatctagtttctgaaataacaaaaggactgtgttgttatgtgaaattaaagccataaaagttagagcaaagctctagaatattgagtagccctacagattatgtttgttttaaagaaattgcatgaaatttgtttgttgtattttaggaaatttaaaatatttgaacataaggttttccttgatgaaataaaggatactatatcagtaattaacaaatgctaatttatgttctttttgccctgtgctgaatagcatgtataataaattaatggagaaatttgttggtttttaggcatcttcaaagaatgatatttccaaagtttgcagaaaagaatatgaggtatgcattttatttaacaaatgtggatagcctattcagatgttatcagaattaacaaaattacttaaatttttaaaatgaatttatttttatacaacttcccttttaccttacagaaaattttgcattgacaaaaatgtcatttactgtgttcggaaatgttatgattttagttgatttttgttgaaatgaagtattaattttaaagaaatgcctaaatctcacatacaaaggatttaacctataatatttttataacaaagcaactagttgtacccaaggttgtgaaatagtttttctcgtgtttcatgttctcttttgtctcatctcctatctcttgacccatccaggtggtattcatttctataaactacctctaatcataaagaaaagtaataaaagaaagaaaatcacagggctagtgtgaatagctcagactttcctagaatcttgcatttgggggaaaaaatactaagttacaaaagctatattaaatctgaaggactctcatctcaatagtgggatttctaacactggtatctagatggggtagatattaaggcaggggtatagcggaagtattttacaccatacaaatatgtgcagaagattgtgcctgatatgaaaaaacctcctcattggggctactttgttcattttctagaactctgttcttaaatgtgacaatattacagtttttgtagtgtaaggctatgtaattaaggatacttaagtgcatatatctcatgcaccatttttatatacaaacattgggattcctattgctgtgttttcttggagaaggtagaataactctcttaactacttctaggttatagtttttattttttttcttttctcaaagcctgtatctcttatttttaaacttgacagtcttatttatcttttgttcctttgtactgtttgctaagttgtatctattcctctgaagacaaatttccaaattatagctctcctccgttcttattgaaaggagccctgctacagagaagtaaaagatctttattttcttatctctctatctttgaaataaccagttttagtttctcttgaacaaagtggctaactgtgataattccttcttttctcctacatgatgtctgacactgtccatcttccatagcctgtcctccgttattttagtgtgcttccttctcttgtctggatttctgcattgccctaggaagtctgccagtatgtgttgatgaaggacaagacaggaaaggtaagagagacaaactgtcctatgatagaaatactaagaatagtttacttttcccagtctatcttccctaatttggcctagaattaagcaaccattttccaaaaatctgtatggcaaaaggatccttttgtttttatattaaaagttgatcccacaaattcttcaatataagactcaatttgatttcttacatgttatttagaaacgaaaatagagataagagtactttaatgcaggaagggttctgcattataaacctcacataacagtcactgtcatgattgttgaagtctagtctagacataaaagctatttgttataaagtgaattgggtaaatttggtgtaatatagcctattttaagtggactggttgtttatcaacatcagaataatttatgaaccaggcttttagtatcttttccttaatactggaatgatccctgggatgaacttgtagatgtatgagccatttctataggcttgcaattttaagggtagcatttaccctggagagtagttttatgtatagtttgatttgagtttcagagaatgagtaattacatttggaggagctaatgtttttcttttttggtaagctgttgtagagttccttttgaagggatttgctaagaaatttacttaaagttttaaaattttaatgccatttaagattttgtcttgttctagccaacctaagataaaccagtttaatataaagcattgttacatcagattttatagagtctggtttttttcttatgcaaattaacaagtacctgttgaatacttagagttttatatattagaaacagcattaactggaagcagacttagtttagaattctgattaagcaacttttagcataactccaaatactaaagaattatatttaattgagtcaggctaattaaaatatatactgcacacataagggctcagggaaataagaaagcagagcaagaatgtttggagttatcaggaaaaacgttgcaaatgagagaggcctgaaaggattggtataatttgggtaaagacctaaagacctaagactgtggatcaaaggtatgttatcaaaaatgcacatggcttatgcaggaggaaaagagaagacagacctattttgggctgcaagtctatgctcagataggtaaagtgggaccaaatcctaaaaagatagcattttgaggctcaactcattattaatgagagggtgatgatgaagattctgtaaaaggagaccaatatataacaaataacaaaaccaatattttagaaacttaaattcataatcctgtgcaggctaagttttagatcccacaaacccctctagcttagctaaaaagaggtaatagcttagctaataaatcccagactaggataatagtaatagagtcaaatattcaagaataaatcagagattcaaaggcagaatccatcagcaagattcgttatgatggattgaatatagatggtattcagggagataatctaatcttttaagcctagtttcctggcattcatttactattcttctatacttaaaggtactagttaaaacttctctttctggcaatagggcaggcttgctacctggaccagtcctccaggtgaaaataacttaaaatgctagatgaatttgctggaaagaaaatacggaatgctcaagccaaaaactaaatgaaggcaggaatccagagaagtaagaacagtaaagaaggcattagctttgagggcatttgctgaatcaatttttatagctttgtagcttcacgaggctcagaagtcaggagacaaatcctgggttctgattgaaggtggaaaatctaagtgaaatccccttcccttcccaccaataaatttgggattccaaagggactatacacttagtattagggtgaccaggaaatatgctcatctccctttccagggggatctgcaaggaaaactgcttctctccaacattagtcttattccattgaaaattcataaccctaagctggtcttcccatgagtttgcagcccaaatttgtatcaagtgagtgtttgtaaaacctcaagctgagaatttatttcaagtggttctgaaatggtagtggccctcagatgcttgagaaaaggtaacacagatcctctctggaggaattgatcttgtatttcagacctcttgggatttccacggataaagtcctaaggaaaaataagcagttcataataaaaaaaagtcacagaactcaccagaaaacatgatttgttaaataaaagccaacaggaacaatggtgaatagaatcagacctaaagatacttcagatatagaaatgatcagatgcagactaaaatgtttaatatgtttaagaaataaaataggcttacaaatatgaagagcaggccgggtgcggtggctcacacctgtaatcccagcacttcgggaggctgaggcgggtggatcacctgacgtcaggagtttgagaccagcttggctaacatgatgaaaccctgtctctactaaaaatacaaaaattagctgggtgtggtggtgcacacctgtaaatcccagctactcgggaggctgaagtaggagaatcacttgaacctggaggtggaggttgcaaaaaaaaaaaaaaaaaaagaagagcaagcatactttaaaaagaatcaaagagaatttccagaacagtataattgaaatacaaacacaatggatgggtgttataatagtttaggtacagcaaagaaagtaaattggaagatagaactaaagaaattatatggaaaagaaacacagaggggcatggggctgaaaaatagtttaggacacaggaaggatagagtgagaaaatcctctctaactggagtactagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaaataactatcaatctagcattctatatccagcaaaaatgtatttcaagaaaggcaaaattaagctatttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatggtgtgttagggtctttacattaaaagacccatatctcagaggtgattaggaatccagactaaagatgaggagaattatcatgcccacagtcaaccttgaagtaacccttgaaccttggagtgaatgaaagctccatagaagagaaagtgtaaaaagaatagagagctgggttttgaaagagaatagaatcttttagaatctaatagaatctaaaataatccattcttttgaaaaaaaaaaaatagagagtagagagctgagtttctttagggaactagaaaagaaggagccagatactgatctgaaattgatcaaaatggaatgagatattccaaaaacagataacttcctatcactggaaatgttcaagtaaagacttactggattcatcatgtgaaggggatttttgcaacagacaggagatttgatgatctctcttccaactctgtagctctcttattctgatgaatacctaagaaataatatatccttcactacttaagagtacttcttttgagaatcacacttgttttgattgtggggtcaccagaccctggcctgtaggagctatccaaatcaaccattagcttgataactcctttatgggcatgttcaagtatcatggacttgctcagttctaggttctctgccttttcacaggctttgtcctttggcctacctaaaagtattggttaggccacatggggttcatgaatgtgttgtgaagctacaaccagagatgatattcaaagtattcagcagctgtagttacataggcaccaacagtcagaacagatgctggctgtaaaccataggaatagccatacttgtgcacattggctgattagaactaaaggaaaaatgagttcatgttttccagggggtgtgaaatacagtgtagattctttttgcatagtcttcgttcacaggttggctgtgaacattttcttctagccaccaaaattatgatttaaaaaattttttggttgttgatggttaattttctttcttgaatgtcacaataagcttcattaaggtaatatgaggctgatgaattcccagagactggcaatggctataaagtgatgagataaattttagtttgaagtttgtaaatccattttatacttttaatggcagaccttacctgccattctcttaacataatggccataaatataaatgcctttacatttgctgtgtgagccactgaagtacaatgctacaaatttgccatcatacgttttatatttttttacttgtttcttccttctttcacagattcttctctaagcttttctttatattttcagaaatgtcattttcatgtctctcctttctttgctagctttcttcaatacacttttttgatgttatatcattaaggaaggtgagaaactatgaaggaaagttagtagggggtatttttgtgaggactaacttttttttagtcttaaggcagttaagttttaaactaaacagttgccaatacaactaaaatattgttctgccatggggctctggttctgtgagaatgctaaaattaagactgttgaggattctgtcttctgttagtcccacctatcagtacacagctaaatgtatagaatggtgcaggtatgtgttaaattttaattttgggattttcacattgttcaaaattcaaaatggtatacaatgaattatgtttcccacagccatccagttcctaaagttactagagatatttgagatattttctgcatataaaagtaaatatatatatgtatagtcctcctctaccctcctttaccacaaatggtagtttactataccctttgttctgcccctggatgccagtgtttggtgtatatttatgtatgtctacccagactgtatactgtttcctcaggaaatgtcacaataaaatgttctgcttaaagatttctgtgtatctattaattttattttgtttctttttctttcaaattaactttggttctagatttactaccagaagcataaaggaaaagggatgaaaaattagcccaatttagagataagaggagcagggatatcaggaccaacaggattctctggacagctagaagcctcctaagcttcagtgtgattggatctgtactgcagtggttctaagaatagaggagaccatctagttgtggcagatcacagcctaggctatggacagttttgttccttgcccagtcagcttttagggattttaacaaaaggaatcgtgtgatactttgccccagcaaagccctcaggacctaaaagtaaagcatcttttagtttatgctgaggcaacttcaagaattgccaggatatagtaaatagaagactatgaatgagaggctttataaatggtaaaatgctgtaccggtatactgtatcacagtagatttgagccgttacctgcagctgatgagctccaaaaagagcgaaacctattaggtcctgcagtactggcttaagatagtattaaactttgtatgttgttttggtttgtcgtatttgttttgtagttgggggaagggagtaactcctatttagtctccttgctgctagtgtatttccttttccagttcattcttctcagaagtcacctgaacgagatgattccaaaagggaatttgatcaaatcagattagattgcgacctggtctcatcttaagtggccaaggttttccccttaagcaatctcatctcccatagatttaattgttcttatatgctgacaacttcagaatcttcattgctaacctttttttttttgagctcctgaacactattggatacatgtacttttgatgttcccttggaacaacaaacaatcaaaccaaaattgattgattttaaatcaaccaaattgattattactttctctaccttttctgcctccccttccctcccttccacccctaaacagcaacacacagacacacacagacacacacagacacacacacacacacacacacacacacacacacacatccatcccaaaacaaaacttatgatttttcttgcatttcttgtttggttgtaccaatatgatccttccaggcacatcaacttaaatgactgagaggtattgtctactctttcctctttctcatcacctcctgcaaattactgtctctcaagcctaaagagttgccttctaaatgtaccttaaatcagtctccctttcagatcctcaggtattgccttagcttaggtctttctgccacttttctggatacctataatagctgccaaactagttttcctgtgtctaatttctcctcttatctactatatccacttctagattaatctctttaaagaccaaatttgatccatgtcactaccttccttaaacccttcagttgcttccctgtagaacacagctcatgctcctcagcccagtatcccaagcttttctcagtctagctcctggttcttctctctgttacatttaagcagcatgctacttatagtttcccagattgaccctgttgttttatttgttagttgtagttgtacaaattgtttgttccacctggaattccttcttctgaatcttggaacaaaaagtatagtatattggagctggcaataccagctccctaccagctagggagtactgcttgttaaatattcagggattttgcaagccagcttgtaacttaaaatcagccatgggtggaggtatttgcagcgtgaacatcagcaaatactgcaaatccagattttctccacaaccaccccccacaaaaaaagctggttccagaacatcattacctctattgaactagagtaacctttgccttaaatcctggtttaaatggtaccactttaaagcctttcctgcccattcatcttctctccacacacataaaattgatcactacttccaagccctttgcatgctttattatagcatttgtcgctctatagcataactatgtttacatgtctctttttaaactaatccctgagttcctgggacagagttcatataattatctttgtctctgtcattcattcacttaacattcattgaactgatacacactgaaccaatatatttaatatgtatcaggcattgttctcagggtacaaaaatgaaaggatttagtctgcaagaagctcatagtccatgggaagagagaaatccaaatagtccattacaatacagtgagacaagtacattgctagaatgtattggagcctggaggaaaaaaccctgcctagggaaatggggaagtctttcacagagcaggtaagacttaaaggatgagcagaaagctgttgcctgtaacaaagtgctacagtcagtacttttatagatagaaaaattttatagactttttcccactctggagaacagaattattcaaggttctttgtaacacagtatatcagctttacgtggaaactctgtgtaaatgtcttacactcttggaatgcatggagaaagtgctcattttctactgtactgtggagaatgttttcattctgagtactatctattatcccaataatgttgtatagtaaaccatcccaaaactccatagcttaaaacagtaacaatttattatttctcacaaatctaagggcttactaggcagttctgctctggccaggcttagctgattccagctgggcacactcatctgtctacaatcagatggcaggtcagcctggggctgcctgctttaggaagcccttggctaagtcagctcagatcttctccatgttttcccctccctttagcagactagctcaggcatgttcacgtggtggtggcaggagtccaagagagaaagtggaaacatgcaagtgtagttcgggcaactgcttactccaagcttgctagtgtccactaggccaaagcaaggcaagtcacatggctaaggccagagttactgtacaataaatagatataaggaaatgtgaaaaattggggccattactgtagtcagttcaccacaagcacatactctgtgctaggctgtcttctagaccttgtgtttctctgcagatgttacttgccagtgaatttgcttccagctggttgggtgccctgtggtgataatgagcaaatttttctgagcagtctagacctataaagctcatttctgttttgagtgttcatttttatttgcatatctgttgaaatgacacattatttggaaggctgaagaaatttaataatcacttgtttagtgatatttccaagtcatgacattaaactccttacatattctagtcatctatactttttgacattcatggtatccacaaggaaaaaacaccttgtagaggtttaaaaacatttatgtttttaaagaacagttatatttaacctctcctacttagcatttcataagctggatttcttctatgaaatgtgaaactttaaactggaagaaatttcaacccatctgtgaaaaggaaacagatttttatttattgaggccttagaaacaaagtagcccctttacttttaagtaatagcatagttaagtagaaagtactgggcatataaaacattaacataacagttaataaaatgtgctcttttgggtctttgtccaaaagtaactaaatcatccaaaattcaaacctgtaatttttttttacaagattcatatgatcagtgttttgttgtcatcatctttatcattgatgaaaatgagagagagctggagtagtcagtagtaaaagggcagtggacagagaaaggattgaaacaagtggacaaatggaggaatgaaccatttttttcaaatccaaaagccaaatcaaattggacagccagatatacgtagcaagcaaagggcagagccagggctagaacccggactgccctaccagtgctcttccatgacactgcgttgtgagaatagtctggtctcactgtattgcaatggactatttggatttctctcttctgaatgcacccaaagcaaggttgaatgtttgttcatagattaatctatttaaccagtttcctattttaaaaatcaatagaaaagggtcactgaagtggcagaaaataaattgcagagcgaacttctgggctagaggttggaccagcagagtctacttcccaggtgcacccaaagggtcttccccaccaaaaggaaaaccagtgtggcatgaaggatcacatagggttccctcaactttgatttactctgtttttgtgccaggtttgcccacagttcatatgctcccaacagtggatcaaagggcttgtactacctggaattccctcttcctgaatccatcctaacacacccccacctagtaatatattggagctgacatctaccagcttgggagtactaattgtcaaatattcaggaatttaatcgcgagagtagggcagggaactagttattgagagcagctaccagaggaaagattttaggatcaaaaataatttttttaggatcaaaatatttttaaggaaaataatattaacctcaagaaaatggtgaccttttttggttacaatttaaggagctgattttaaaaataggggactggttaaatagattactctgtgaacaaacattcaaccttgcattggctgcattgagaaaaacaacccagactattctcagtgcagtgtcatggaagagcactggcagggcagtctgggttccagccctggctctgccctttgcttgcttatacatatctggctctccaactagatagtgacagcttttggatttgaagttctcttgagaccctgtcaactccagtatgctgacatgttctttgcatctttgaggttatggtagatcctcacctcagcacccctatagttttgacctattcttgactaacatgagtaggggagggagagggagcagttatatgggggcacattgggtgtggtattggtaagcaggtcaaaagaggctccataggagtgaatacgaaccctcagttacctccaaaagtcagaaagttacctttcaaaagtcagatggcagacttttgaaagacttaaaaattgactagctaagacttcaagacaggctgacgtaagaaatgaagaaactattaagttaatcctataactcattatgtgtatgtcctaagccctctcagactaatcagcagtattaaagtggtaaaaagatagagttacatatagtaaatttaggagtcattcatcaaagagggagatatgatcagtctattaaatcatgataggtgtaacagaatttattcatcaaatgctggtatactggaatgaaggaacattcttttgaaccttaaaatgggtaaagaggcaagatggtattaacactaaagtgttagtggttaatggtaattttcacatgatgctgccatgtgaaaatagaaaagattagttcaacaaattcaggtaaacttaggcacaaaaggtctattaatgaacatcaagagaaataagagatgcttgaagaacatctctgaactctggatgtgacatcaagggaagcaactgtgccgttttcctttttcttcaggtattgggagactttttctgtaaggggccagacagcaaatattttaggcttggagatcattcactctctgtttattcaactttgccatagaagtgtgcttagcgtgaggtagccatataaaatatctaaataagccggcatgcacccatagtcgcaggtacttgggaggcagcagagtggaggccaacctgggcaacatagcaaaaccctgtgtcttaaaaaaaattttttaatttaaaaaagtaggtaaatgaaaaaaataattaaaattttaaaagtatgtaactgaatgggcatgtctgtcttccaataaaaactttatttccaaaaacaggtggcaggcaagatttggcttgtgtgccatagtttgccagcccctgttgtgagtaaaagctattgtccataagtatttcccctttctaggccttggcctctgacttctattaaataaggaagttggactagatgatttctcacatttcgcaggttttatctcctttagtagtacctctccctgaagctaagtgatccacaggctgaaccacagtgacatttatttgtaaagtcagttttttaaacatccaggttgaacaaatgtataagtctctagagcagagtttatcagtcttggcaccactggcattttggtctggataatcttttgcgggagggagactgtcctgtgcagtgtaggatgcttagcagtgtgcctggcctctactcaccagatgccagtagcactccccacccctcagttgtgataaccaaaaatgtctccaggcgctgccaaatgtaccatgggaagcaaaatcacccctagttgaaaaccacttctgtggaaagttcaaaaataactagaaaaatatcaaatactagaaaatcaggccatgcaacccaagatagccaccaagttatcaaacatatttattcaggtacaaggtcaaaaaaagccaaaccaaagggaacaaagatcttattagaaggaaaagagcaatgagaattgcattcatccagtcaaagagggctagaaagttggtagccgactacctttattttattttattttattatttgtttgtttgtttatttgtttatttatttatttattttgagacagagtttcgctcttgtttcccaggctggagtgtagtggcatgatctcggctcactgcaacctccgcctcccaggttcaagtgattctcttgcctcagcctcctgagtagctaggattacaggcatgcaccaccacgcccggctaattttgtattttcagtagagacagggtttctccatgtttttcaggctggtctcgaactcccgacctcaggtgatcctcccacctcggcctcccaaagtgctgggattacaggtgtgagccacctcgcccagctggtagctgactactttttaatattgatttagatcattttaaaagtgttcctgagtccagtgaatccatttaaatagagagttatctataatgcataactgaaaagtcacactaaaagaaggaaacatgaatgaagagagatataaacaagatcattgttaatgaacactaagaatatttactttttcactcctgttatattgcttgatggagtctctagcagaaagaattcatactgggtgaattgaggaacccttatctatgaggcccagggttttctgttttattttgctttaaattgttaaatcaagtgtggcatattcctacaatggaatattatttagcagagaaaatgaatgaatacagcttcacacagctacatagagggatctttgaagctaggttttaaatgccaatagctgatcctttaacaaatccccatcacctagccagcttgcaatatggctgcaattaaaagccaaaatcgtctcgtttcaacaataagggtgtgcttgatttccttctgcctgtaatttatgcccatattatttcttttaggaagtaattatcctcccattgtgattgattattattcatagctgacaagccctaaatatccaaatggctttgtataagtttttcatttttgtcttgttttgggttttattttctttacattgactttaatacagggtggtgttttctgaacaataatctaagcactctagagacactaattatagtctcaaactcgcttttgactttttctattacctggggcgggtctcttttaccctgctgaggaaacagtttcttcatctgtaaaatgatagattcccaaactctggtcccaggatggctataaaaaaactgtatttcaagtcttgtttaaaatttagatttctgtgcctcacccctagattctgaatctgtagtctagggtaaggtctaggaaactcagatgattccagtgtacagccatgtttgagaacaagtagagataatgtctaaaatcctttcaaatctaaaatgcagtggttacatgaaatatatatttccctagatgtcatttattagattattttctggaaagtttttatatcctgcaaggaataattaagattaatacattgtagcccctcccacacacttacagctttacataaacttggtttgctataactggtcagcttatggctccaagtagtcatcttgatcctgatatatgttggaagatggtttccctttttaccagaatatcatttcataacttctgtgttttcagtcttggatttagggaagaattaaatagttttaatatcatgatttccatgtaaccataaagtggaattaaattacaaattctctctggttgttaatttctgtttatttgtttttcttcaatttacagaatgctcttttcagttgcattagcagaaatgaaagtaagtatatttgtcaatggttgtacaaacagtccaaagatataattagccatctgaagcaatgtgcacagcaggattccgataggctctttcccatggtgtatttaggtcattcatgtattataacaattcccatgtcttaactgtagatctacaatgcagatactaaagctcagtgtgctagaggatgatcacaacccaataaataggcccattttcagaagttaagtacacccatgctatataatgtagcacttgccgagtgctacgtctcagttcattcaacagacgttgattgagtacttggtcagtgtggggcagacacacatctgtggaggacacgacctgtacacaaagaatgctgggatatggtaggatatgagatagtgtcactggataaagtgctccaggagttcagagaaagaagggatcatattctgcaggggtacttagaggtggcttcatggagttggtagctgatcccgggcatgaaggatgggtaagatgtgaacagtggagaatgaaggaaatggagattggaggaagggcttacaggtgaagggaacagtgagagcagacagacatgggaaaacacatgtaaggaacaaagagttctttagctcagcaggaaagtatattgaaggataataagaaacatttgctgtctgtaatttatcttctatcctttctaactgaggcttagttcaagattttccaggtagtctcaggcatgtaatcttatgtcctcccacactggtgaaaaagccagctgaatggaggaatcagaagataggcatcttgtcctgttcctatgtgtctgttcttatatgtcctcaccattccccaccaccacccccaatgtatcctcactgaggtttacagtgataaatgcagccattaatcattgttctttggccaggcgctgtggctcatgcctgtaaccccagcactttgcgaggcagagacaggtggatcacttgaggtcaggagtttgagaccagcctggccaatatggtgaaaacccatctctactaaaaatacaaaaattagctgggcatggtggcacgtgcctgtaatcccagctactagagaggctgaggcaggagaatcgcttgaacccaggaggcagaggttgcagtaagccaagatcgcgccactgcactccagccaggggacagagtgagactgtgtctcaaaaaaaaaaaaaaaaatttgttctttgtgaagaaaatgaactctttggcaataaacacaataagtttggtagtagttgcaagtttaaaagaggcggtacagtaggtatggaatagtttcctggtctgggaaactgagacttgtcctatatcagttcagtcctagttcagtttctttggttatgactttattattatcattatcattatttctggaagtcaccagaatccctgctcatgggtctttggaattcaccagaaacctgattctggttcctccatatctatccctaataattatcaagaatttcctccctgctttctctctctctctctctctctctctctctctctctccttttttctttttgagacaagatttggctgtgttgctgaggctagagtgtggtggcgagatcttggcttactgcaacctccgcctcctgggctcaaaccatccttctacctcaacctccctagtagttgggaccacaggcacatgccactgcacccagctaatttttgtattttaggtatagatggggtttcaacattttgcccaggctggtctcaaactcctggacttccaaagtactgggattatagatgtgagccacagcacccgacccccctgctttctcttaacctcttcctcccatacctctacctctcccttcagcctcccacagactcccttagattcctgtgaggggttcttgttcttctcctttacagatcccacatctgcacccccagctactcatctagctctcccaaaataccttaaatggcagcccattgattttttaaataaataaatccagagtaatatttatttcaaatgagttttcttttcagtgttgaagcaggacatatcaattgtgagatgaagtctatctcaatttaggcaaactcttacagatagatgttcaaactgtacagaacttttgggattttgtttcaagatatacagttatataaatgtcaaatttattaaatgatccttacatcacttagtttttactggccctgttttataaatgtgagggatttggggttttgttttattttggtttggtttggttttgctttgctttgtgtttataaacctctacaaatctaacacagaaagacactgcttcactggttttcaacatgggcactcttggcattttgagagacagtgtttgttgtctgagactgtcctatgcattgcaagacgtttagcagccctaaccctcatgtactaaatgccagtcgtagtccaactccttgtggggtgtgatactgttcctgtggagaaccactggactatagactgtaagttgatgattaatgactttattacactagtgagcacttgaatgtccccgtgagtatacctacagaagtgccgattttaagtgttcatcgtctgtggcatggttttatttctcaaatttagaaagacatattgttccatcattatgatgatgatttaatgttaacaaaaagctgtttccatgtcagtgccttctctttttttctccatagtgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtaagtaaaagggacatattcttctcatttcaatctttggtaaaatcgtttgtaaaaagaagtgatacgttcttgtagatatctgcagtctgggtcatttgagaaacatcagacttcctttggtatttagatttggcagattgaataatattgtcacagccaaaaggggccaagaaagatgaaactgtagagggtatgaggaaacaggaattctcaattctgagggtgggagagttcactgatatggattttttagagggaagttgggtaatgaccattaggatttcaaattatcataagcttctgatctagcagttccatttctcagaatttatctcataagaaaacttatataaatttgcaaaaataaatatatatgcatataaacaatgttcactacaatgctggtataatagagaaaaatgacaaacaacccaaacatccatcaatacagcattgattaaaattgattaagtaaattacggcatacctatagaataataacacttggcaaccaacaaaaaaaaaggacttcttacgtagaagtccaaggctgagtgtggtcgctcatgcctgtaatcccagcactttgagaagccaagacaggcagatcgttttgcgctcaggagtttgagaccagcctgggcaacatggtgaaaccccatctctacaaaaaatacagaaattagccaggttcacacgcttgtgatcccagcttcttgggaggctgaggctggagaatcacatgaacctgggaggctgaggttgcagtgagccaagatcctaccactgcactccagtctggatgacagagagagagcctgtctaaaaaaacaaaacaaaacaaaaaggccaggcacggtggctcacgcctgtaatcccagcactttgggaggctgaggtgggcagatcacctgaggtcaggagttcaagaacaacctgaccaacatgttgaaaccctgtctctactaaaaatacaaaaatcagccaggtgtggtggcacatgcctgtaatcccagctactcgggaggctgaggcaggagaattgattgaaacttggaggtggaggttgcattgagccgagattgtgccacagcactctagcctgggcaacagaccagacatcgtcaggaaggaagaaggaaggaagggatgaagggaggaagggagggagggagggaggaaggaaggaaggtaggcccgtccgagttggccagcatagtgactcacacctgtaaccttagcactgtgggaggcctagatgggaggattgcctgaggtcaaaagttcaagaccagcctggacaacatagtgagaccctatgtctccaaaaaattaaaaaattaactgggcatggtggcacatagctgtagtcctagctactggagaggtagagacaggaagatggcttgagcccaggaggtcaaggctgcagtgaattattattgtgccactgcactccagcctgggtgacagagcaaaaccctgtctctaaaaaatagtgaagtccaagatgtattaagcaaaaaaaaagtaaatcacagaactaaaaatatagtgtgatatatttttagtttatacctaattgtttcactttatatattttccacagtgtttgaattttttgccaatgagcaattattacttttgtaattaaaaagtcataacaatgagaagagagcctgatatcttttaaaaattagggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaataataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaagatgaaaagaaagaaagacttgttttttgtaactcagtagcagtactgtgtgccttgtttggccaccatctaaatcagaactctaatggcttttgacatcctttggtgtagctgtgtggtcaaaatcagaggatgaagcattgccccaataaccttcatttgttttaaaggcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtcagagttcgctactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccttcgcgtgagtgttacagctcttaaaggtggcatccagagttgtttgttcctcccagtgggttcgtggtctcgctgacttcaggagtgaagccgcagaccttcgcagtgagtgttacagctcatgaaggtagtgccgacccaaagagtgagcagcaacaagatttattgtgaagagtgaaagaacaaagcttccacagcatggaaagggactggagcaggttgccactgctggctcgggtggccagcttttattcccttatttggccccgcccacatctgctgattggtccgttttacagagtgctgattggtctatttttacagagtgctgattgctacctttacaaacctttagctagccagaaaagttctccaagtccccacctgacccagaggcccagccggcttcacctctcaatatggtgtttgtgtttgttgctataaaaattagtcatttctctcatgtcaagaacataatcccttttaggtaattgtttctagcaggaaataattccagtttcatctacaataccttttctaggaatatcaaatacctctcctgtgaggacttcttaggtgtaggatggcctttcatttttgtaaggatggtgctaaagatcccatgattggagacagtggtgaattctggtaatagataccttgtccacctaaagctcctcacctttttgctacactgcaaagtaatagagaatttggtagggcctgtattctgcaaatactgacatataactaagagtagtaatggcttccactacactgccatgttctgtgctaagcagagcatgacaaaaaaagaaaaaaaaaacatgcacacatatgtttattgcagcactattcacagtagcaaagacttagaaccaacccaaatgcccatcagtgacagactgaataaagaaaatgtggcacatctacaccatggaatactatgcagccataaaaaaggatgagttcatgtcctttgcagggacatggatgaagctggaaaccatcattctcagcaaactaacacaagaacagaaaacaaaatactgcatgttctcactcataagtgggagttgaactatgagaacacatggacacagggaggggaacatcacacaccagggcctgtcagggagttgggggctaggggagggatagcattaggagaaatacctaatgtagatgacaggttgatgggttcagcaaaccaccatggcatgtgtatacctatgtaacaaatctgcacattctgcacatgtatcccagaacttaaagtacaataaaaacaaacaaaaaaaacagctaattaagccacttatattctgaaaatgtaggtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtaggttagtatttcattttcctttaccaaaatcagtagaaaatggcattttaattaatgattttaagcctagcaaacgtgtgttatattcttacgtggtataggtttagcatttagaaaatataaaatattatttcatccaacaaatgtgtattgagcattgtgtaccgtatacaaaacattgttctgtatattgagtgctaaaagctctgtgttttggggtgtggaggattagcattggcagggtagtaaatatttaagatgatgcaatagatgaattctatccttatagagatcattaagtaagcttacagtttagaagatgttttgatctgacatctaagggacattctctttattaaattatgaaactttgaactttttattatattggtggataacctgggttagcacttataaccagagttaggtggtagcatattggcattcatcttggtgatacacttagagatgaaaaattaacaatacaaatataggatgtaggaattgcagtctagagacaaaaacaaatggagatacctaagatcatggtagaacacaggtacaatagaaatgtgctttattagagatatttggggtaaaaagggaccccatgttactcggatatcctgaaatgaatataagataccaggcgtaaaacaatctttcctgtggtttctaaattggatggacctttagcaaaaaattttgcctagaatagctcatcagactttggtaattgtcaatcaaactttggcaaattttttaaaagacatgaaggtcgggcgcggtggctcatgcctgtaatcccaacacttcaggaggctgaggcaggggatcacctgagatcaggagtttgagaccagcctggccaatatggtgaaaccctgtctctactaaaaaatatacaaaatttagcggggcgtggtggcacatgcctgtaattccagctacttgagaggctgaggcagaagaatcacttggacctgggaggcagaggttgcagtgagccgagattgcgccactgcactccagcctgagtgacacagtgaagactccgtctcaaaataaattaattaattaattaaagacatgaaaaagagcgagactctgtctccaaataaataaatgaaagacgtgaaaaatctccaaagaaaattaacaaaaaggcttaaagggaaattaaattaggcttgtaattaaggaaattagattgcttgtagaagttaataaatatatttatgggaaggatgctgagtgtttctttgaatgcccacaaaaaagtttacacctacgtagagtcactagaggttggaatggccgtgttgtcccaaaagagcttcagtaaggaaggcttttccttctctctaaccttgatacagggttttatggtttgctgaaggcttgcattttcatcagatttcatcttcataaaaccttaggagataattggagaaatttatgtaatttttcttttacacttaataaactaactatgagatgttaaataacctgtccaaggcaaatacagattgaccacccttaatccaaaaatctgaaatccaaaatgctccaaaatcagaaacgttttgagtgctgacatgacaccacaagtggaaaattccacacctgacctcatgtgatgggtcacagtcaaaatgcagtcaaaactttgtatcatgcacaaaattatttaaaatactgtataagattaccttcaggctatgtgtataaggtatatatgaacataaatgaatgtcgtgtttagacttgggtcctagccccaaaatatctcattaggtatatacaagtattctaaaatccaaaaaaaatccaaaatttgggtcccaagcatttcagatgagggatacccaacctatagaaagttaaggactagccagatgcagtgactcaagcctgtaattccagggtgaggcagatggatcgcctgaggtcaagagttccagaccagcctggtcaacatggcaaaaccccatctctactaaaaatacacacacacacacacacacacacacacacacaaattagccaggtgtggtggcagatgcctataatctcagctgcttgggaggctgaggcactagaatcacttgaacccaggaggcagaggctgcagtcagccgagatcacgccactgcactccagactgggtgacagagtgagactctgtctctaaaaacaaaacaaaaaagaaagaaagttaaggactagaaaaaagaaagcttccagatcgaggtacctgatgtaacttgatcacagcttccttattcccataatgtgtaagcctcactgatagcagggaccttgtctgttttattcaccattgtatttccagtgctttcaacaggccctcacacaaaatagacactcaataaacattggtggggtgaatgaacaaatgtaaaagtaaagatatctttgtcataggggtaaatatgacagtcaaaatataaggtgaatgaaaatttttacttataattttgtatatttcaataatatgaaaattttattgtaaacatgtattttataaataaaatgaatatcatgtgtgagagcactttagaaatggtataaatgttttagctatatacacatacttaagttgctttgtaatcattgagtactaaaaataagaagattgtgtattacaatagtacatagaggctttggaatatcttagggaatagaaatggctttagtatagtttttcagggagaaactaatgtaccctaagtctatcatgcttcttaaaagaagtcagaggaccatgtcctagttttaccgtctgtgactgaacataaatataagggaatatatctttgcagaggcaaaaccatgtactttaagtaaaagtaaaaaagaaatcagaaagatatagggggaaataattgtgccaggaactaaggatgcacaaatactgtaattgaacattaaatttggcactgagatttctagcaaccttgacaaaaagagaaaaggtaggtgataaaagaagcctgttttccatggaaaacaatcaactttttctggctctagtttctaggaaatagtcatttggtttttttactttttttctcacatacgttccaaagtatatagttcatagagttttagttttatgcaaatcaaatatttacttggttggctcatgtcagcttctgcatttgtgctcttgtttcagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggtaagacaaattattatacatggaatggaaatattttatcattaattataaataagtgaaataccactttattctgattttattcctgttgggttaaaagaaagtcttctttatgatttaatctttaaatgcagtattccatctggtaagccacctctgggaaaggaaacactattacaaagtcccttccaatctagagatacctcaagcttctggaattcaaagaatctcttctgccgtcagtcccctctcccttctactgtaccaccagtggaagtaattcattgtagaataaattattgtgaactatttggtcatccaaatgtccacttttaaacagtttactttaaaggaccttgagactggttgaggtttcttctctgtgagtcccctgtttcatacaaaaatatttctttacaaaagcaattcaaatagatgttttcccagggtatcaagtatcattagaaaaataaggaggcaagaactgagccttggagcatatcaacagttaatggttgaagaaaccaaagaaaacagaagagggcaccggaagcacgaaatgagagaactccatacagaagcaagagagagagagttactaaagaagaggtggctgatttataagttacaacccagaaataaagagggcaaaagggaagagaatcattcaattgggccagaaggaagttctagatatttttgtcagatggtgtttacttcaagctaacacacatcttattttttttaaagtactcagagtattacttaagagtgagaaaattgagatatctttaaaactggtgatagagtattagccagtaaagacctgatttagagattgagtacatctgaaatgtttgaaagttagactttggcacatagttctggtctggcttctggtaattgtggagtagcttgtatgagaataacagtcctaccaataccaattatgaactccgcacaaaatataaaagaacaattgttttgaaggtattggagactgatcaaaagcaggagggtctacatcttttttttttattatttttgagacagaatctcactctgtcacccaggctggagtatagtggcatgatctcggctcactgcaacctccgcctcctggattcaagcaattaattctcctgcctcagcctcccaagtagctgggattacaggcgcctgccaccacacccagctaatttttttttttttttttttttgtatttttagtagagacggggcttcaccatcttggccaggctggtttcgaacccctgatctcaagtgatctgcctgcctcagcctcccaaagtgctaggattacaggcgtgagccaccacgagtggccaacgtctcttgaaagatagaaaccacactgagcgaaagccacatttgtgcacttcttcctcataggcactttcagtttcttttcatggggagtagagttcaagcagaaagcagcagtcttggcctaaggagtgagacatcagagtttggtcctgccagagaagctagatattgaaggaaaaaaaaaatcccacaagggagggaaccacaaaaagaaatgtcccaaaatccataaacagactccttttaagtccttggctgactcctaaattgtacttttgcaggatgagactacagggaacccaggggaaggtgaacatagactatagcagttagcatttgctgggcagacgatttagaattcagattatgccaagttagaagggcctagtaaaccccataagggccaaaccttgggagtacatacgacatccaagagctaagagtaaagctgaaaaaccttaacaaaacctgaaactgcctccagaggaaggaggtatttgtcagtaatttaactgcctgctggtgtgaaaacaacattcctccaaagaaggtaacaaaatcctaaatcccacaaagtatcatgcataatgtccattatacaatcaaaaattactagaaatgagaaaaataggaaatatgacccatagttaagagaaaaaacaatcatacccattggtgacccaactattggaattagcagataaagaatctaattatgataaatatattgaaagatctacaggtaaagatagatataggtgagatatggaagctctaaaaaaaaccacatggaaactctaaaactgagaaatgcaatatctaaaataaatttattgtagggaatggaaaatagacacagcagaagaaaaaggtcagtgacctcggagattgctcaatagaaactatctaaaccaaagcacagagaataagtgatacaacatctgtggtagtaacccagaaggaaaggaaagaaaggagcagaaaaatatttgattaaaccttggctgaaatttttccaaatgtgatcaaatacattaacccattttttgggaaaccttagtaaacgctaagtcagataaatacaaagagagacacacctagcacattatagtcaaactgttgaaaaccagaggcaaagagaaatagttaaaacaaccaaagggagaaaaaaagacactttacatatgatggaataacaataaaaatgacaagtgacttcctttcagaaacaatggagaaccaaagaccatcaagtagtatcccaagtagtatccttaaagtactcagagaaaaaaaaatcttatattcaatgaaaatattcttcaaaaataaaggtatttctagatattacaaaaaaaaacaacctcagaattttctgccagcaatctctcactacaagaaattcttcagtctgaaggaaaatgccacatgaaaactcagacctatagagcactgggattggtaaatgttggtaaacatgaaaaatattttttctttattttctttttcttttttttcttttgtattttatttttcaaaagtaattggttaaagcaaaaataataacaatgtattgtggaatttatacatagaagtaaaatatatgatatatgacagtagcaaaaaggataagagagaggtaaataattataccgttataagtttcttacattatttgtgacattgtatagtattaattcaaggaaaactataataaataatggacatatattatgcctagagcaaccactaatttaaaacacaacacaaagaggtatagctaagaagctaataggaaatataaaatggaaaactaaaataatacttgatccatccaaaagaagacagaaagaaaaaggagacaaattgaaaaccacagcaaaatgatagagacttaaacccaactgtatcaataattacataaacgtaaatgaactaaaaacatcgattgaaaggcagaggttgttagaaagacaaagactattattggagataaagagtatcaccttataatgatcaaagttcaatttatcatgaagatacaattaacctagatatatatgcacctaatgtcagatagatgcatatactcaaaatacttaaaaacagaagtaaaccctaaagagagagaaatattcaatcatattcagaaatgttaacacctctccctcactaatagaacaaatggaaaaaaatcagtgaggatatagaggatttgaacaacatatgctgggttaaaaagcaagtctcaaccgctgtcagaagatgaaaatcataaaaagtatattttctgaacacaacagaatcaaattggaaatcaataaaaataaactatattgaaatattcccaaatatttggtaattaaacaaacgcttctaaataatttatgcaacaaagaagaaatcacaaaggaaatgcttgaacctgggaggcagaggttgcagtaagccaagattgcaccaccacacttcagcctgggcaacagagcaagactctctcaaaaaataaatggaatactatgaacaactttatgccagtaaatcctgcaatttagatgaaatggatgcattccttaaaaaccaaaactaacacaagaagaagtacaagttaggattattcttataactattagagaaattgaatttgtaattataaatcttcacacaaggaaaacttctggctttactggtaatgcttaccaaacacataaggaaaaaattatgcaattattacacagaatttttcaggaagcagataacatatcccaactcctcttatgaggctagcattaccttgataccaaaaccgacatggacattaaaaacaaggtaactattgtcctgtgtcactcagagatgccaaaatcctcaataaaagattaggaaattcaattcaagtataggaaactgattttcaacaagagcagcaaggcaattcaatacaaaaataaacatcttttcagccaggcatggtggttcacccctataatcccagcagtttgggaggctgaggcagttggaatgcctgagctcaggagtttgagaccagcctgggcaacatggtgaaacaccatcaatcaaaaatacaaaatattggccaggcacggtggctcacgcctgtaatcctagcactttgggaggctgaggtgggtggatcacctgaggtcaggagttcgagaccagcctggccaacatggtgaaaccccgtctttactaaaaatacaaaaaaaaaaattagccaggcatggtggcgggcacctgtaaacttgggaggctgaggcaggagaatctcttgaacctgggaggcggaggttgcagcgagctgagatcacatcattgcactccagcctgggcaacaagaatgaaactccatctcaaaaaaaaaaaaaaaaaaatttgctgggtgtagtggtgtgcatctgtagtcccagctgctcaggaggctgaggtgggaggatggcttgagcctgggaggtggaggttgcagtgagccaagatcatgccattgcactccaacctgggtgacagagtgagaccctatctcaaaaaaaaaattttaaaaggctgggcatggtggctcacgcctgtaatcctagcactttgggaggccgaggtgggtggattacctgacgtcaagagttcaagaccagcctggccaacatggtgaaacctcgtctctactaaaaatacaaaaactagccggacatggtgtcgggcacctgtaatcccagctactcaggaggctgaggcaggagaatcgcttgaacccgggaggtggaggttgcagtgagctgagattgtgccactgcactccagcctgggcaacacagcaaaaactctgtctcaaaaaaagaaaaaataaaataaaataaaataaatagaaacatcttttcaacaaataatactagaataattgaatatctttatggagggggaaaaaatgaacctcaacctgtgtttcacaccctacacaaaaaactgcttccagatggatcatagaactaaacataaaaactaaaaatttaaagctaataggagaacatcttcacaaactttgtgtgggcaaagattttgtagacaggacacaaaatatacaattttaaaagaaaaaaatgaattagacttcaaccgtaaaatcttttgtttgccaaaagacatcatttaaaacttgaagggtcaagtcatagacttgagagggaatgttcaacatatcatgcacaggtgtgtgcatacacacacacacacacacacatatttgtcaaagagcttgtgtatccagactacataaataactcctacaacatcatgataaaaagtaaaacaactcaattttaaaattatgcaaaaaaggccaggtgtggtggctcacacctgtaatctcaacactttgggaggccgaggcaggtggatcacttgaggtcaagagttcaaggccagcctggccaacatggtgaaaccccgtctctactaaaaatatttttaaaaattagctgggcgtggtggcaggcacctgtagtctcagctacttgggaggctgagacaggagaatggcttgaacctaggaggtgaaagttgcagtgagctgagatcgcgccactgcactccagcctgggcgacagaccaagactccatctcaaaaaaaaaaaaaaaaagaaaaaaattgtgcaagaaactttcaaagaccctttaccgaagaaggacatcacaatggccatttaatcaagtatatgaaaaaatgttcaacatcactaattatcagtgaaatacaaattaaaaccacaatgaactatcccttcacgtgttaaaatggctattatcaaaaagatggaagataacaattgttagcaaggatgtggagaaaagggaagtcttgtacactgttgatggaaatgtgagttagtacagccattatgggaaacagtatggggggtcctcaaaaaattaaagatagaaggtaccatatgatccagcaattccactactaggtacatatctaaaggaaaggaaatcagcgtgttgaagagatatttcactcccacattcactgcagcattatttacaatagccaagatgtagaatcaacctgtattcatcaatgaatgaatgaatggataaagaatatgtggtatatatacactgtggaatcctattcagcctttataaagaaggaaatcctgtcgtttgcaacaatatgaatgaacctggaggacactaaataaaataagccaggcacagaaagacaaatactgcacaatctcacttatatgtggaatctaaaaaaatcaaactcatggaagcagagaatagaatagtggttaccagagggtggctggaaaaggtggtgcaggaggaggagagagaagagggaggagagaggggagaggattgggaaaatgttggtcaaaggacacaaaattttatttagacaaaaggagtaagttcaagagatctgttatacaatgtggtaactatagttaacagtgagttgtatacttgaaagttgccaagagagtagatgttaaatgttcttaccacaaaaaaattataagtatgtgaggtaatgcatattttaattagcttaatttagccattccacatgtgtcatgtttaaatatattacgttgcacacaataaatatataatttttgtccatttaaaaaatttaaaagaaatagccatctagttcattaaaggcttcattattatcagtcatggcaaaatacaaattaaaatagcaattcagtgcctcctcaccctcacaagaatgcctgaaattaaaagactggtaagcatatgaagcaagtggaattcttgtagtatgttactactgggagtagaagatagtttgaggatttggagctttttttcagtttcttcaaaagttaaatctatgacctaacaattttatcctgaagcatttacccaagagacatgaaaacatatgtccaaataaagacctgtctagtacccttattcgtaatagcccaaaaaatgggggagaggaaccaaaacatctatcaggagaatgaaagaatataacattgtggtgcatccaaacaatgggatagcaatggatgaatcttacattgagaaaaaaagcccaacacaaaatacattcttgacacatgagatccaagaataggcaaatgtaatctatggtgataaagatcagaatatcctttcctctgctggaatcagggattgactagagggggcacaagggtactttatagggtgatgaaaatgttctagcccaggcatgatggctcacacctataatcccaacactttgagaggccaaggtgagcagatcgcttgggcccaggagtttgagaccagcctgggcaacatggcaaaaccttgtctctaaagaaaatacaaaaattaaccaggtgtggtggtgggtgcctgtagtcccagctacttgggaggctgaggtgggaggatcacctgagcccacaaggtcgaggctgcagtgagctgtgatcatgccactgcactccagcctgggtgacagagtgagaacctgtctcaacaacaacaacaacaacaacaacaacaacaacaacaacaacaacagtggagctttccagtggctataaaacatgtgatacaacaacagattgaatgcagaagcagatatgaaaatccacctgagttctattaagccagacattacagagatttgcaaaactgtaaaacagtcctatccttctcgctaatgtttactttggaaaatagttatttttcataaaaatacttatattaacatgtagtgggtttattataattttaaataacttgataactactttaaattttgcttaaatttttttcaacatggggtattcctttattgcccaggctggcctcgaactcctgggcttaagcaatcctcctgccacacctcctgagtagctggaactagaggcgtgccacaatttttttgtttgtttgtttttgtttttttttagtagagatgaaatcttgctatgttgcccagactggtctcaaactcctgagctcaagctatcttcctgccttggcctcccaaagtgctaggattgcaggtgtgagccactgcacccagcctagaacaggcgaaattaatctatggtgatataagtataaatagttatggcctctgagttgcagtcagtagggaggcattaactcaacagtggcacaagggaactggctgaaatgttggatgggttccttaattgatttagatgtgcttatggatgtacatatttgtcaaagcacaccaagctgtacccataaaattggtgcattttgcttttgtaaattatgttgccattttaaaaagttggcctcataatatttattttatgaaatgaaatgggatagtctggggataatagtcctgtttggagaattgtgaagttttaaactgccccacaagaatctgttaaaaagaaaacatgcaatcagagtttaatgctagtgtctacactgaatcttcatacaatcgaagctgatatcctttcatgggttgtatgtgctttcttaagaaaaccagatttttctgatgcattagtatgtcaggattttacttgttgcttctctctagaaaataattgcctcttgattctttctggccttttttctctttaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaagtaagtttctttcatcctaacgattctccagctttagttcagaccctccgtgatctctagccagagcctctccatagaattttctctcttaccacttcctttgcctatcacccccgtatgtcaaatgctttcccactttttcctcctctagttgaaatactgctcccctcatcaccacctactggctgtccttgtctcctctgaaataccagacattcctgtagtcttcccagatttctccagctgaaagtaatttatccttactacagattcctatagacctttatttgtacttctcttatggaacttagttcatgaaacatttattaaatacctctgatgcacaattctatttttatatgttaatttatggacttgtcttatattctgttagactttgctcttcttcttctttttttgttttgttttgtgttttttttttgagatggagtctcactctgtcgccaggctggagtgcagtggcatgacctcagctcactgcaacctccacctcccaggttcaagcaattctcctgcctcagcctcccgagtagctgggactacacgcccagctaatgtttgtattcttagtagagatggggttttaccatgttggccaggatggcctcaatctcttgacctggtgatccacccgcctcggcctccctaagtgctgggattacaggcctgagccactgcgcccagccgactttgctcttcttaaggagcttattttgcttaggaaatcaaggatcaagtaaagataggagctgctatagtgggtgaaaccaaaagcatttaacacatagtaatctgcccattgttcttcacatatctttttttccaaaagttttccaaaaccaagttaatatccagcccctaagctgttggtatgtggctcagtgctgctggataccttaataatttcaaccttaaacagagtccagtctattctctgacatggcttcgggataacctgatggggaaatactgaggtataacaattaggtgacaagcaagaggcaacaagaggggaatatgtagactcttagcacagaaaacttgtaggagtcaaatccctattgaagaccaagaacattttaaagtagtggactttctagttgttataggccagatgctaatgttgataactaaaaagagacttagataaggaagggaaggcaaaagaggcaagcaagcaaacaagccagcataaggtcctagaagtgaggatatatgatttttgcagagagtaaatcagactagcttcatttaatttcctttcaaagatactgaaaagccacattgctggtagtaacagtacgaagaagtgtacaatttgagtaagggctttggtctcagacaacagaaagttaggggtgctttcaatttattattcaacctgagctctcctgtgactcttgttctcttttgaaacatgttaagttatgaaagcttactttctggaaagcttcagaaacaagtgatgttgactggacaacatgaggaggttcctcaagctctaaacttacgtgcatttttttttcaagatcagattgtgtggagattcttaaaaaatgtggagaccagaacaaattccctgaagaccacacagctgaaagtatttgtgagcttctgtcacctacagatgatctgaagaattgtatacctttggatacatacctcagtaagtacttttttgtatgtgtgtttttagatttcaaatacttctctcttccaactatttgttttactatttgttttggatgagcatttatctgttgagaacatgggattcaatgataccatctcaatcacagactcttgtttgcttggcctttttggcccaggaaagaattgttgttttaaaatatgtaagcagaagtgattctatcagtctgaggaggtaccaactgtggtcagtcaggaattctaagcagtgactcagggggccagcattctcagataaccagctccatatcattgctgtcttcttaccataataatgactagaaagtggaatttacccccagagactatcagccttttgtcatcagagtgtcagtggatgagagccaggaattggcttggacttactcacccaacagggtataaaaaaatgatagtctaggccaggcgtggtgactcaagcctgtaatcccagcactctgagaagctgaggcaggcggatcacgaggtcaggggatcgagaccatcctggctgacatggtgagaccccgtctctactaaaaatacaaaaaaatcagccaggcgtggtggcgggcgcctgtagtcccagctactccggaggccgaggcaggagaatggcgtgaacctgggaggcagagcttgcagtgagccaagattacaccaatgtactccaggctgggcaacagagcaagactctgtctaaaaaaaaaaaaaaaaattatagtctagcttaatatgtaaaaatggaacttatctcactgcttcagtttttctctgccaaatactcccgccaaaagctagaagagcgtgttgctatctcattgagggatcctggagctggagctcagcttcttggcagtgagacccatacatggtggaaaccaggggatgacaagtagaactcctacacacccagtagttaagggaagtgttcaggctgccaccagggggcatctgtgccatgatctggctacaaaggtagacagtgaagtcagcctttgttttcctgtgttaggtaggattaacaaaaaacagaacaaatagaagtaaagaaagcccagaaacaaatagtctagggcttcatcatcaggaatccaggctccttttatctttccccaccatccttagcatttagcttcagtcatcaagattacttaatgtactttgtcatcacaacatggctattggagttctaaccaccataatctagttccagaaggtaaaaaggaagggacagagcaaacaacttctccctagtcacactgtccatccctagttgtaaggaaaactgagaaaggttattttttaagctctgggcccattgcggccctaagtaaaattggagatcttttagtaatcagggagagaaaagtatgtgctggatttgtagctggtagatttgtagctggtagatttgtagctggtagtattcgccatattttctcaaggccaacaaactgtgtcccttaacctttgtgaccaatatagcaaaaaagagagcattagactggaatttagacctttgtgtctttgagcagatcacttctttgagcctcggcttccctatttatgaaataattaggcaaaatgagatgaactccaagggcccttatacctctgttagtcttagagtatgagtctggcctaaaatcaagtaagcaacacttattgtatttataattctagattctattacagcaggcaaatatttgtgtagaaggaaactatatcaatgggaggaaaattaaatatctctttaaatatcacacatggtttctatcaagtgagactcttccttggccatgatttccgaagttaaatataatcatggtttggagtccatacatattaccataataaattctcatttatgataaaacacgctaaattatccttcttagacatcttatttgaccaccctatccaaaatatacctgtcattttttatcccctgacactacttattacttacaattttctgacttaattatttatttatagatacacatatacatacatagcatgtgtgtgtgtgtgtgtatatatatatatatatatatatatatatatatatttttttttttttttttttttttttttttttttttttgagatggaatcttactctgttgcccaggctggagtgcagtagtgcaatctcggctcattgcagcctctgcttcccaggttcaggccattctcctgcctcagcctcccgagtagctggcacatgccaccacgcccagctaaatttgagggggggcttttttttttgagaaagagttgcactctgtctcccaagctggagtgcagtgatgtgatctcggcccactgcaacatctgcctcccgggttcaagcaattctcctgcctcagcctcctgagtagctaggattacaggcacctgccaccatgcccagctaatttttatattttagtagaaacagggtttcaccatgttggccaggctggtctcaaactcctggcctccggtgatccgcccgcctcagcctcccaaagtgctgggattacaggcgtaagccactgtgcccagctcatacatagtgtatttattgtctgtttctctactagatgtaaactctatgttagagacttgtctattttgttcatcactgtatctccagcacctagaaccttgcctggaatattgtagatcccaataaatttaaaaaaagaatgaatgtatgtttatgtgaaattcatcatttcacaaatgaaagaatctcggtgttttaatagcttggtagaatcaggccttactttacactcatgagctcttcatttattccagccataattaattcagataatttacagttttctcttactcttttaggttggttaaactaatctgttttggttttttcagggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggtaagaggtaggtgggtgtgagaagaggatggataggtgctgctagtgtttctttataggagctatctttctttttttcaatcctgctccttctgtaatataggggttatcttcggagtgagattatgagggacttcatgttctatattatgtttttctataatgttttgagattttctcattaaacatgtattattgatgtaagcaggaaaagacagacacttgtaatcctccattgttatttaaattgtaaactaataataacagtctaaaacttgactctcgtgagttgcagggttctagactatgaaagaaaagaagctcagaccagctttttgtactttctcttctatgttgtaatgtttgaaaaaaaatactctacattgttcatgttttttctttcctttcctttagtatatagagaaatagcatattcaatagaatgtatagctatctccataaagattaatgttatgttgaaatatatataactttaagggtgaaggatttttatcccatagaattatgatagtctttatctttctgtcaatccctttagaatatagttgttgcaacattttgcttctttttatctatttcccaattgagaatgtttctttatcatgttagaatcaagattttaaaaaaggccaggcgcagtggctcacgcctgtaatcgcagcactttgggaggccaaggcgggcggatcacgaggtcaggagatcgaaaccatcctggctaacatggtgaaaccttgtctctactgaaaatacaaaatattagccgggcacggtgggcgcctgtagtcccagctactcgggaggctgaggcaggagaatggcgtgaacccgggaggcggagcttgcagtgagccaagatcgcgccactgcactccagcctgccggacagagccagactccgtctcaaaaaaaaaaaaaaaagattaaaaaaaaacgtttttttttttgagacggggtttcactcttgttacccaggctagagtgtaatggcactatcttggctcactgcaacctctacctcctgggctcaagcaattctcctgcctcagcctcccaaatagctgggattacaggcacccaccaccatgcccagctaatttttgcatttttagtagagacagcagggtttcaccatgttgtccaggctggttttgaactcctgacctcaggtgatctacctacctcagcctctcagagtgctgggattacaggtgtgagccactgcgcccggccttaaaatatttttaaagtaaaataaagcaaaagatgaaataagcatgatgtctcaaaggatcatctataatatatgtgtaatactgtaatatatcggctatagagtcataatcttgtcaaaattggaaatgtcggactgttttaaatttcaagatagtattttctgtccatttacccttacattataagttggtcagtattttctttggcaagaaaataagatatagttacttaaaatggtgacatctgtatttcatattatttaaatatataattcaattcaggggccgggcgcagtggctcacacctgtaatcccagcactttgggaggctgagacaggcagatcacgaggtcaggagatcaagaccatcctgactaacgcggtgaaactccatctctactaataatacaaaaaaaattagccgggcatggtggtgggcacctgtagtcccagatactcaggagactgaggcaggagaatggcgtgaacctgggaggtggagcttgcagtgagccgagatcgtgccactgcactccagcctgggcgacagagcgagactccgtctcaaaaaaaaaaaaaaaaaaaaaggaattcaattcagaatcctcttgtttcattaaactcagaaaacccatcatataataagatagaaaatggaaaatgggttttccataagcccacccaaatattcagtttttccttgaatttaaggtatacttgttttccatcactaaaagtttttctgaacaatattattctaaaaatactggccaggcgcggtagctcacgcctgtaatcccagcactttgggaggctgaggtaagtggatcacgaggtcaggagtttgagaccagcctggccaatatggtgtaaccccatctctactaaaaatacaaaaattagccgggtacaaaaattagctgggtgtggtggcacacgcctgtagtcccagctacttggaaggctgaggcagaagaatcacttgaacccgagaggcagaagttgcactgagccaagatcgtgccactacactccagcctgggcaacagagcaagactccgtctcaaaaaaaaaaaaaaaaaaatactgttagtttccctattctattttttaaaatatctgtgattttaaaatattttttactagcccctacaaataaaaagttacatatcttacagcactgttatactgaatgataggtcactttggggtacagatctgtaatcaccaccatcctccagaatgtggaattttaatttgagaggtatgtttttggccaatgaaccaaagcaattccttaatttggtgaaagttctattacataatctttaatagtgatttagtacctataagacttttatcaagtgtatatctaatgttataaaacaatgtcatagaacagtaccatctctctcagctaatttttgcttgtacaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtgagtcttaagctctgattttgtttttaatatgagattagttatttttactttgtaggaagaatactggatagattctgaccacagagtaaggtctgcatatcagatactccagggcagtatttttcaaactatacagagcactaggacttctaaggaagtctttagaagtcccctcaataaggggctaatggctaataataattaatatttattgaattctaatcatgtgctaaacacaaagctaagtcttgccttacattatctcattaaatcctccaagttacactttgatataggtaataataatacctgtattacccttactgcatagatgaggaagctgatgcttaaagagttcacccagctagtaaatgaccaaagctggattctgctccaggtctagttgactccaaatcccttacgcttcacaggccaaggacacaggtaatcttcccccgaccctttcttcaggcataccccaccccaccctcacttcaccagaagtgaaactcagattttgacatcatggaaagcaagtgggtgtaggaactacactgttaggagtttggaaaaaaagtacattaaaaagtactttgaccaccttccctaaaaatcttagactccactgcttccttaaccatcttttgcttgtagccccaacaactattcatgtcaatatatgatttcaaacaattgtgaaaaaacaccactttttaggatctgttccctccccacaagctcactctgctaccccatttctactcccatcccctaccccttcaaccatagtagttcagcttttatatgctttttggtttactcttctgtgtgagatttgattagaaagaagagtgctcttggctaaaattagctctcaaatttctgccttagagcaagtcaggtatttatctctcaatccatattctgcttgactaaactatgaaggtaggtactttgtatcacagaaaatatcaggacagattcattccttctgtaacatttcactgactaaatgcctattctgtacaaaagagcatactagtgccttatggagctgaaaccgggacgggggatgagatcatgctttatgtgttaagataagagaatttgagccaaaaaaagttgcagaccaagtgctcttctgggagctgggcattcctgccagggcatcagaagagtctttgatccaaagatggcatcaggtctggccctggacagatgagctttcaaagcagaaggggcagccagaaacattcttagaggatagggagcaccctggtaagaccagcacttcaggggcttggaggaatacgataggaggcaaatatgaaaatataaatcccacagattttactctagttggtatattcagaagtcatctttcaagaatttctggctgggcacagtggctcatgcttgttatcccagaactttggtaggccgaggcaggcagatggcatgagcctaggcattcaagaccagcctggacaacatggtgaaaccctgtctctacaaaaaatacaaaaaatatccagatgtggtggtgtacacctatagtcccagttacttgggaagctgaggtgggaggatcacctgagcccgggaagcggaggttgcagtgagctgggatcacgccagtgcactccagcctgggcgatagaatgagacccttctcaaaaaaaaaaaaaggaatttccattttaaaacttgttgaactattaaaattgtaatacgtgctctatttctcaatgcatgatatagatcaacattttctttctgtttctgtcaggtcatggaacatcctttagtattgactgcaatgtctgttcttgttttgctggcaatttggtgtgctctacccgcctttgcctcagtgagcacagttcagaagatgaccgtcgtaccttcacaggtgactgtgatcgcccagagtctgtcctcaggggccatcatttctttgcacacatttttcccttcaaggcagcttctccagtcttaactgcaaatgtacacaataaaatcaatacagaatctaagggcaagatgcttttcctccctggatctcagtttcttcctctatgaattgaaggtattatactaaatggtgtcttagggcccttagcactaatattctggaatttcatgagtcaaaaagaacagagccagtgattggaatgggtttaattaaattgaacttttctacctggtagaataccccatttacccctactgctatgatctaaaatgtccatgcatgttctcagtttgtttctcagcaccttcttcctcagcctaccttagcttacttcttcatctagactcccacaaacaataatatcccagaatattactttcttgactttcctatgctttgctgctcttattattcttacaccaacataaataagtgaaaaggctagtgagatgggatgctttcctctcgtgaagctattattgccaatagcaacagcacagtctgctggtatatcttggtatctgctttttcctagatctaaaatacctttggttgtgggtaaaaagttactaggtagctgcccttgcccccatttcacactgctgcagtggcaacttgattcttctttccccagaattagtattacatgtggagaggggtgggggccgggtggaggagaagtggaggagaggagagtaaggatttaccaaccttgtacctccagcccattggaaataaaaaggggatcagaaataagaagtgaatggcacactggtaaggaagtagaggtaggacgaacactaccccagccttcactgctttattatcatcatcctttattattatcctttgccctgctcaagcaaggactattcattctgcttagagaaaccatagagggatatggggataaagaataagcaaaggatttacaaggaagactttttaaaatttttttgttaatgtctaaatgtttttagaagttgagctttacaactagcaagacccctgtttcctatagtgtgtggcccctggtgtcctgggataaattaagtcaatgactgttgatctagcagactaaggaaattttactgacccaaaactgtgccacatttcttgggacccagtgtcccactccaaatgtgactcagagaaagaagttcataacaatttgtaagtctcaaaattacagtaattttctaagttactgtcttagacatgagagtggaaggaacctacaaccttcactctttctttttgttttttctgagaaggagctttgcttttgttgcccaggctggagtgcaatggcgtgatctcggctcaccacaaactccgcctcctgggatcaagcaattctcctgcctcagcctcccaagtagctaggaacgacaggcatgcgccaccatgccattctaattttgtatttttagtagagatggggtttctccatgttggtcaggctggtctcgaactcccgacctcaggtgatccgcccacctcagcctctcaaagtgctgggattacaggcgtgagccactgtgcccagcccactctttcttatgcttggtattagcctttaacattcaagaaatccccacaccagacttcaaacatctaaattctagattttatatgccaaatcaggagaaacagtctttactttccctacctatagccttgttaataggggtctctacctgggatcaaagtctagggggccctcaactagttggcaataaaaaggacaaaggaaagccatcttgcagatgagctattcagagcattgctgcctttaaaaaccctgtcagaatacaaaaaaaaaaaaaaattagctgggcgtggtggcatgcgcctgtagtcccagctactccggaggctgaggcaggagaatggcgtgaacctgggaggcagagcttgcagtgagccaagattgcgccactgcactccagcctgggcgacacagcgagactccatctcaaaaaaaaaaaaaaaaaaaaaaccctgtcagagatcggagagaaggtttttcctgacttaatttacaattctattttaacgtgagaccttcacatgattgctcatggtttgccttaacaaggaaatataaggggagggggaatatacacatacatatttttgaggctgtttcctctcctcaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtaagtcaaatggcttcttattttattcaactgaagactagtacttacaaagcatctaccatataccagacagtgaaaacagaaaggtaaattaagaaatcgctgctgccctgaagagtttggagtctggagggaaagagagccatgtaaagctgcttgataaggtgctgcgattgggagcccagaagtagggcagttaatgcagcctggggaaggccctgggggagcctctagagattgtgatacctagctgaatctagaaagatgagtaagagattgcaggcaaggtttgcagtagagaaaaagaagtggtagtgaaggcagactaacaagagtcatggctgctggaaatgttatctccgtaacattgttatctccataacatggtgtctgttgggcactaaagcagttctgtaagactgaaacagaaaaggtaacataaggagaggtagcagaagagacaagagaaaagggtgtattcttattagtagctgtcacctgatagtcaggggaaattttcttctagttatatgcaactgttttagaaattggacatgagaaatctctggaaatgcaacttcactactatttgaaattacttgttttgagctcctttctctgctgtttcctcacttgagctcagaagacagttgccccagccttaatgatggatttctgtatggggcagccaccacggcaggcatcttgctgacccttaggttacagccttctggaagcagagtgtttattggattgcctgaatgacctgaacaatacacattccaatgccacagtgctttcctaagcaattgctgcttctccatcctgaaaaccctggtgtaatatggagggagggggagactctctcatgtgttaaaataaatggcaaagaattagtcatccatctgccaaattttatacaatgaaactaatccaagaaagtttctatggaaagaagacaggacgcaatgcataagaaataagctgaaagaataatacaggttgtgttgggaggtagaattgaggattgtcttaatattttttcatttgttttatccattggctagcctttctgaatgaggttgtcttgcttttataataaaacaataaaaataaatgtcaaagtgggaaggccttcttgagtatatacaagattgaaaaattcagctacatgaacctcaaaattttctgcatggtaacagacaaatgacacactggaaggaatatcacagagaaagcgctgatgtccttgtaatataaagagcccctgcaaatccatctgagaaagatcaacctaatatcaaaatggacagagatcaataacctaatagaaaaatggaccaaggacataaacataaaaaaagaaatccaaatggttcttaaacatttgaaaaggtacttttatttgttagggtaagtaattccagctactgtatacaaattccaaaatatcaataatttcacagagtagataattacatagagcccatttgtttcttcagcaggcggctttccatgtggtcattcagagacgtgggatccttccatatagtgacccagtcttctcctacagcctcatagtcctcttctgtgtcttctgcatctggacagcagataaaagaagggagatagtggggattgctcttaagaagctttaataggccacatctaaaagtaacattcatcactacttccaggcacattccattgtctagaactcagtccgttggccataatgaattccagggagactgggagatataatttatatacatacccaggaagaaagtgaagtgaatttgataaacatctagccaatctgccacaatgcttaaccttcttcatgttaagagaaatgtaaattaaattaaaactacaattgtgtaccactttccatctatcagactggcaaagctaaagtttgataacatggtatagggaaatagctgctttcatacaagagggagctggaggaggattggtacattctctatggagggcagtttggccaaatttgcagttttaaatgcacataccctttggattagcacatataaatgcttatccttacataaaatatatctgtagggataaataagaaagtggtagctcacacgtgtattcccagcaccttgggaagccgaggcaggcagatcgcttgagctcaggagttcgagactagcctgggcaacatggtgaaaccctttctctaccaaaaattagccagacatggtggcttccacctgtagtcccagctactcgggaggctgaggcaggagaattgcttgaacccgggagacagaggctgcagtaagccgagatggtgccactgcactccagcctgggggacagaacaagactccatctaaaaacaaaacaaaacaaaacaaaaaacactaaaagaaagaaattggtaatagtggtgcctctagggaagggaactaggtgtctaggacacaagagtagaagggaggcctatttttcactgtataccatgttgtactttttcagtttcaccatgggcttgtattatgtgttcaaaaaataattaattgtggccgggcacggtggctcatacctgtaatcccagcactttgggaggcagaggtgggtgaatcacttgaggccagaagttcaagaccagcctggccaacatggtgaaatcccatctctactaaaaatataaaaattagctgggcgtggtggcacacgcctgtaattccagctactcaggaggctgaggcagcagactctcttgaacccgggaagcagaggttgcagtaagctgagatcacgccactgccctccagcctgggtgacagagcaagactctgtctcaaataataataataataataataataattgttaagaattgtattcatccatcaagtatctactgatgttccaggcatttttctaaacattaggacataacaacaaacaagacagatcaagtctctgccctgctcacgtttacttttatttgcccccagattctcaaccttttttttatgatcctcttatttccatatactcaaattgatcaagctttttctctcaaagttaccaaatttctcctgatattcctgtttctcatccctggcatgttagtaagtaatgaagttctaaatattattttccattatttctcttcaaatattttaaatttccataaaaccataactaagtgcattgtaatttcaaaccatttcatgcatagtgacggtggtagtgattttggtgcaggttagccctaaaaagagtataaatcatttcctttgaaattaaaataacactagctactatatgcttcctcttttattttataaactaaaatttatatatcttagtacttaaaatacccagtgaaagctaaacattttcatgggtcttatcttcttatagaaagttatgtaaaccctttataaaaattaggaaagcagaaaaaagcctaaagaagaaaagaatcatcatccctagcccctctgaaggagctcaggaattgagaatgaagcaaggtcctcatcttactaggaaagaccagcttcatggtggcattctctcagtcatttgcaaccagctggtatcagatcctcggtcttgtaggcacaaaaacctgaattattttaggacaaagagtgaggcctttttttttttttttttttttagacagagttttgctcttgttgcccaggctggggtgcaatggcgcgatatcagctcaccgcaaccttcgcctcctgggttcaagcgattatcctgcctcagcctcctgagtagctgggattacaggcatgcgccaccatgcctggctaattttgtatttttagtagagatggggtttctccatgttggtcaggctggtctcgactcccgacctcaggtgatccacccgcctcggccttccaaagtgctagcattacaggcgtgaggcaccgtgcccagctgaggccttttcttaagatagactcatattagccaagctgaaagttaagcccgtggaagtgtttcatttgttactgaatgcaagggcctccagcctcaggctccagcctatctcttggcctcatatcatggcccttctgctataggtctgtctgtgcctgcttggctcctgccctctggatcacctgccatttccccagcaccacattccttgagcatcacacctgtgttcatggctgctctctcagcctggcaagcccatgctgccccctttgcccccccagcctccagctagaacactgcctcctccccatgctttcttcaggctccccagacgagaatgactcatccccgcaagctttgtgcacatcttttctactttttagcctactgtatatacaggcttgactctcccactctacataagctctttggagacaggactgtcctgattcatctcttgctctctcttcagcctcctatccctcatctagtgctttgctagccccaccacagtccctccctacattggctcatggtgctgcattcgtctttttcaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccaggtacagtgctttggctgacaaaacaaagtacactacggataaaattggtttatgatattttacagatgaatcaacagtaagaccagccgagggtcttctgtgaatcctgtcaaatctatagcacccagtcctccactaaaaaggaagactggctccttctcctaactctggaagctatcttgctagtgtgtgtacctttgcacatctggtgtacaagcaagaacagagagtggcttcttgcagtccactcctaggaaaagaacttaaaagtttcacaaccctggcatggtcaacatcattcttacttctcatagttctctgggccctcactaagaaacaaagcaggaagaatgtgagtcaaaaccaagaaaagttttcccactcttcccacatcagtcccacctcccaaggtactgaaaagtcattgaaattttctttaagacttaatgtctttttacatcagcttatctctcagttttgtaggtttatggaatctgcatttatgttttaaggaaaaaaactgggccgggcgcggtggctcacgcctgtaatcccagcactttgggaggcagaagaggtggatcacaaggtcaggagttcaagatcagcttgaccaacatggtgaaaccccatctctactaaaaatacaaaaattagctgggcatggtggcacatgcctgtaatcccagctactcaggaggctgaggcaggagaatcgcttgaacccgggaggcggaagttgcagtgagccgagatcatgccattgcactccagcctgggtgacagagcaagactccatctaaaaaaaaagaaaaaaccaaggacaattccttttgaggcttctcacatgcaccactgattttatgcttgcccctctccctggggccgtgctttgggcctagcatccgctgcccacaaccagctaacacttaaaatgattgcttcacattctctggtcttcatggttagaaaaattccatcatgatgtctccctgaaacatgcttgttttctctcagagcccctgtgccatttgcattgatcccatctaccctgaattctgtcttcccctacttgttcccttctcctggctgtgatttttctctgatctattcctgacctacctgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcaggaaagaagatttttatctcttatcagttcacatggaataagcacccagatcccagagaggctgagaaaagtaatctttcagctcatctggagacacccatattgctgcccacgccaccaccacccccagcatttagcccacctcaggaacttaagaggtcctcataatttatacctgtgtcttttttccttcctgaaaatagggaggcatgctgtgtactcttggttgggaaaggtacaacatagacatttccaggctaaatgtgatttgtttgccctcagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtaggctggcagtatcggggtggacaggggaggactgagaagatttgcttatccacctccagagagtgagtcattgagaagagagctcatttacgtttttcagaaagtcttgaagagattcttatgctgatcatactcactactttgggttgaccttaaaaaactagggcttgccttcgatatcatctggtgtcctgctattttaaaacaatacagcagccttttctcaagctaaatcttacaccagacaccaatatataaacagataaagcagtattcaattatgaaaattagggttattaaatgcataatgtttacttattacgaagttaacaaataacgaattactaattaatgaataattaaagtagttttgatgaacacaaacttttgaaattgagagaaatagaagatagttgttgtcttagattggccttaacatctaatttaattgttttagttgcatataatcagaaaagttttgtttcatacagactgtttttagcaataacagttttttaaaacagcttaccttacaatctcacactcttagtcaaacagaagtagcagaagagactttattccaagtctgcacagaacaggttaatctggatctaacaggttcattcctccatccgttaattcatcaaatgtttatttagctttcactatgtgccagacgctcctctaagcactggggacacagcagtgagaaaaacaaagcccttttccttctggagaccatgttctgagggaggtgacagaccaaacataagttgccatgcaaatctgcactaaaccagatggcagcaagtacgatgacacgaaatgaaggggaatcggaggggcccagggcagagaggctgctaatggattggttaaatctctgtcgtgtgaaaatacggcataatattatatttgattatgccatattctgttatgggttttagcagtttaaaataatttttaaaattaaatttgaatcggtcgggcgtggtggctcacgcctgtaatcccagcactttgggaggccgaggcaggcggatcacgagatcaggagatcgaaaccatcctgactaacacggtgaaaccctgtctctactaaaaatacaaaaaaattagccgggcatggtggcgggcacctgtagtcccagctactctggaggctgaggcaggagaatggcatgaacccgggaggcggagcttgcagtgagccgagatcgcgccactgcactctagcctgggcaacagagcgagactctgtctcaaaaaaaaaaaaaattaaatttgaatcaaacactcatggaacccctgaaacaccaactcccttattttgcagacagggaaacaaggcctggcagaagcatttgcccagaatcacacagtgagttttgaggcagagcaggatcaggccccaggtctcttgaaaagccagctgtctctatgctatctgcaccacagccttctcactccaaggagtggtgaaggatgaaaagcaggggtagagaaaggattttggtaaatgtagagatgagaggactccaggttggtcaaggagcttatatgaaggtacagtctttgggaaggacactgtaactctcctgcccaaaatgaagggctggacatttcactaaggattttaaattctctttgtttctaattctgaacgcacataaaatggtttctgttatacaggtgcttgttgcccattatgtgctgggatgttaagagttttatttgacaaagaaaaactggatactattgctaaggtaaattgctttatattcagatgctattgaaatcttattgctaagcctctcagtaatcctagagagtagaatgtgttgtcctcattcatagataaagaaactaatcttcagaaaagcaactttcccagggccatatagcccttaatcagtaggacgagggtttgcacccaggctggctgactcccaagcccatgttcctcccccctacaccctggctgtgcacatcacagtcagcgtgagcctttcttagaaaaggcccctgctggcacagtaagcataggtggggctgcaggcagagccaggtagccagagactggtgggtgcccaggtgcttttgaggtcgcctcccctcacaccagtccccgtgcctcctgaggggatcttctggagccctgcccgttccctgcatagttctgccctctctcttttctgcaccatcacagggctccagaaatgttgcacccaacacttgccacaacctagagatttagccccattttgattacaaacacctgtatttttaaaaaccctgtgacctctacctcagaacagtcactttttgcaaaagtggttctggtgaaagtatgtatcttcactacagagtttctcagtcaggcaaaaccccattgtgatggactggagattcagaatttggcctagcaaagctgcggttgggccttccgctgagggctgtgcggtcaaaagagcctcctcagctggcagcccaaagcaagggagcttaggcagtcataggaattcttctttttttcaggtaatacatgttttctctttccaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcaggtgagttcagcacatgttgtgaagccatcttgtcactttcaagtttggtgcacctaggagggagtgggcacaaactaggaccgaggaaggatccgtgggtgagggagtggaggcatttgggaagttcagcgggacaggagggagaaaagcaaggcaatctctaaaggactgagcactttgccagtggctgagacctggtgcacatttgacagtgggatgcagaggcaccagggcaggggagggattaagatactgtgactgggagtgtgcacagctggaaggggtccgagaaatcactgtctctaatccacccattgtacagacgaggcagctgatgcccaagccggggaaggaactggtgcaggtcatgcagtgataaagccagaaaagactccagtctcctgagagctgtgtgcccactgtggaggaagatcccatcagagctggtcatgtgggctctagtgtttctttgtcagtctggagacatgtagaaccccactcacgtagacccaagtttcaacatcaaaggcagtgagggctcaagggaagggaacgaaggcaagcagtctgtgaatcactaggaagttcatctcgtcgttgttttccttttcatgtttcaatggacattaaaattgtattctgtgtgaccctaactaaccatgtaaggataaagtctaaatgtgggtaagaggtgtgggtaacaggtgtggaaaaatgaaaacagttgattgattagggcagtggcattgtggattatttcttgtctttctcttttcttttttcttcttttcttttctttgagatgggatcttgctacattgcccaggctggtctcgaactcctgggctcaagctaccctcccaccttggcctcccagagtgctaggattacaggcatgagccacaacacatggccaattatttcttttctggtttgatttccattaatgctgctatatttatgtaataaactaaaactataataaaatgttactttggataagaacagaaggacaaagagaaagtaaatgccctctgaggccacgctacttttaggatatacgtggaatttgtctggcttgatgttgaaaacgttctgtggttttatattaagggaaccttgtttctcctcacagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatgatcatgcatgcttctaagcaatgttgacattcaaaaaggaaaccactgatcacccttaggtgagctgtgtcctttgctcggggataagaagtcatggaaattagccgggtatggtggcacatgtctgtggtcccatctacttgggaggctgaggctggagaatcgcttgaacctgggaggtggaggttacagtgagctgagatcacaccactgtaccccaacctgtctcatacctgagacagagtgagaccctgtctcaaaaaaaaaaaaaagaagtcatggagtgctattatcccaagccaagggccctgggagaacaggccagctaggacacagttggtcagaccagagggcaggcagtgacagagagtcaaatacaaagaccccagctttcagccttaaggacagagagagcttcaggccttccaagactgcatactaggcagttctccccactgtgctggtcctgatgttccagttccagggtacacctggggcagggagaccatgggaatatggagatggagggctgctgatgggaccagagaagtggtaccaatcagcttaggctaagtccccaaaacttcagtggcttacaacagaggcttctattttgttcccttcacatgtccattgtgggtcagctgccacacctgatactatcttcactccagacccattccagcgtcctcacaaaggggagaaaagagacatagaggaccacaagctggccctgaattctctgcttggaagtgatgctgtcatttctttctacgttttactaaccaaagcaagtcacatggccactccagagttcaaagggtggggacatacagtcctcccacggtgttttgtgtgtgttgggggagggacagtaagtattttgaataacactgtctaccatagacatcttttctcatcaggctaggacaatagccaggactgacaagattttttattagagaagtagatgtttccagcctggtcaacatagcaagaacccatctcaaagaaaatgcaaggcgtttaataggacaggttggagaaggtgatcaaatggtacaggcaacctgccatgggaggtgtgagttgggggagggagcatctaacaagggggaagacgcaagccctcgaaaagagggttggtttgcaccaggcctggaagaaaccaggagactttgccagatggctttgagaaaggcattctaagtaggaggtacagcttgagcaaaggtgcagaaacgacagagtccaggtccgttccaggggtagaacagcagggctgacatgttgtgaggggcgtggtgtggggaagtataaggcagatccgatgtgcccagcttgaatgccaggccacagtggcatcctaagcctctgcccttgcccttccagctacactgaccagcctggatagctctagcctgcaaaggattgtgtgccccaaacttcagtgccacgagaccttcaagaccatccactgatcttgttactaggcagtgcttccctctgtcctgtgagcaccctggactctcctgaggaaataataactgagcaggctgggggccagggttcccttaggcctggtccccacccttagagttcagccagggtctctttcagctccactgtgggaggaaacttaaacccaccaggaacactgatcgtcactgaagaaactgcactttccttcgtttgattcaatgcttctctttcagccttgggctgatgggagtcaggcccacacactcccacagagggtgctctaattctcagagggacaggaggccccgctgcaggggcctttccttccctgcctcccagctgcagaagaggcttgagttgtgcactttgcaagctgagagaaagtgaaggcagaggggtcattcccagggatgagccagtccttccagcagtccagcaatcttggggctggagggcagatttccacggtgcacacagagagaaaccaagagtacagggaccaagctgtggttacacag

SEQ ID NO: 15704 - DNA, 15024 bp, Human
ctcccccacctccctgtgtagttctagggggaaaaaatgtgttgttttcctttttttctgatgcttctaatattaaatgcgtctattttcccactctccattgtcttgaggtcttcccctacccaccctgcctagttctgtcacgtcccttctttccctgtatcacaacaatgttctccctttctcacctttgtttctcttcatacttgtttctctctctgtgtctctctcattctcttcccttccaaatgtagtatttggagactgtaatatcgattgaggcagacaatagaaaactgtcgaacctccactgtaaattcattcttaatcctatgaaaaaatgcatcctgaaacgtgttgcatgcacagtgagacaaaaacctgtgtctttaggtttcctgcgatctagcttggaggcgggttgggggggtgtggagggaagtgctggagaaattatcccattattgactgagcagcaaagaattttcaagaacagtgattctcctagaaaaagtattgctgctgccatttcaatgcaaaatttggcttttgagtaaaaggcttaggtttttatcttccggggagaaaaaaaaaacccaaaagacaaaaaaaaaaaaaaaaaaaaggtcatagcgtccctgggtgggctcgaaccaccaacctttcggttaacagccgaacgcgctaaccgattgcgccacagagaccgagtcgactaccggcgtagtagtgagccgagtcaatgggagcgagcctggacggcgcagacgccgtaagagatgccgccatcgggcgaaataagtggaacccgggggagaaagggaaggatcctgatgggggagggaggcgaaagagcttgggaggagaggacgcgggacgtgcacgcccttcctccattggaacggcgagaggtcgactctggctatcctcaggttctacctcaaacgtggagaggcgcggaacgtccctttttagggtgacctgagattgaggatacgtgaagtcgggccgcaggaagtcccccaaatcagaacaagcttcggcttccaaactccctttcacagctgaacccctgcagccgcaaaatacccgcgacgcctacacgcgacgccttccccttcccacctgcatcattaaatttccatttaatgggcgcctcctatatactaggcactgttgtgggccagtgaatattccgagcctaggcaagtgcctggtacacagtaaacgcaggatttctggagtgaataaataagctagcacgactaatacgacgaactcatacatcacgttgataagcgtcacggtgccccttcagctggggccgcagcttcctaaacccagtttcaccagcccacgtgcgcgcaggctccgcccccagtccctgaggtcccgagtccaggtccgccgagatcccactatgcaccgtgtcgcaagtctcttccgcagccacagtgacttttcacttccgcttttcccgcctccgttttgactttgcaaccaaactacctgtactggtgaccgacagggacgtgtgaccaatagaaagcccagatgtccaggaagagtccgcctatcagccaatgaagagacagcagtgagagcggttgcgcagtgaaggctagacccggtttactggaattgctctggcgatcgaggggtcctagtacaccgcaatcatggtgagatggggagttaaagcaaaggggcatggggaaggattgagaagcggagggggtcaggagaggcttggggacgaaaagggcctagggtcgatggaaggaagcggtttcagttcgaggggagcgggccccggtgaggaccaagagggtgagtgcggctcattgccgccacacagtgctcatcccagctggagaaccaggggttcagacgcctccggaatggagaacgggcgtacaggagcctccgcatcaggagctgggccgggggctgtggcagcgtttgaccccccgcgctgacccctccgctctgtctgtcctagtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagtgtaagtttcaagggtccccgcccacacccaggcctcttcttggaccatccaaccccggcgtcttgaccggccaaggtgtcagtcatctaccacacaccaccagtgagtttgagactttgccgcctccaaaaaacatgtccttccctttctttttttttttttagacagggacttgctctgtcacccaggctggagctcagtggcatgatctcagctcactgcaacctccacctcccaggctcaagcgattctcgtgcctcagcctcctaagtagctgggactacaggcgcgcaccaccatgcctggctaatttttgtatttttagtagagacagggtttcaccatgttggccaggctagtttcgaactcctgacctcaagtgatccacctgcctcagcctcccaaagtgctgggattacaggcatgagccaccacacctggcctgactttgattttgacaacaattttgagcagacaagacaagcccaatagaaacatcttgcaagcagttggggttttgttattacatctcagggttggggaagcattggcaatgtgccaaatctatgggagcagattctggagagacaaagtctgtagggagggaaataatgagcggcagtttgagagctgaacgttacatttagcagtgaggggcgaagagaagccagagaagaataagagaggaaaagaacggtgataggttttcaggagggaatacgtggtcacagggggcaggtcctgcagggtactggtggcctgaggagcagcaggtcctggatttgtttcctagaaggtggagagactagctcacaagcgtgggtggatgcctgtcagaaaatgttctcatttcggctgggcgcggtggctcacacctgtaatcccaacactttgggaggctgaggtgggcggatatcttgagatcaggagttccagaccagcctggccaacatggtgaaacgctgtctctactaaaaatacaaaaattagccaggctgggtggtgggcacctgtaatcccagctactcgggaggctgaggctggagaattgcttgaacctgacagacggacgttgcagtgagctgaaattgtgccactgcactctagcctgggcaacagagcgagactctgtctcaaacaaaataaaaaaagaaagaataaaagaaaatgttctcatttctcttaaaactccctgagtctcaagaacataacacttactgagatctcacccagcctgtccttttttcctgtctggtagagtcagagaatgacatcctggggttcctgtcagtgaagtctcccgtgagccttcccttctgcagtcactgctgttctcacaccatttccttttcttcagagggcttttctcactgcgtttgcttccttctgggcaatgactgctcatttcactaggcctcagtttccttacctggaagatgaagctcaagtcatttctaagtctctttgctctggtgtcctgagactcattgcttttcctccagcaggtgtggcattggtctgctctatgcaggggcctatcctggggctctgagatggaactggcaagctgtgaccttttttccttttttcaccagagctgccaaatggcctttttctaaggcatctttcaagtctgttagcacatagcacagcagttggtgctgcccccttttttttttttttgtcacccaggctggtgacataaacttaactcactgcaacctccgcctccaaggctcaagtgatcctcccacctcaccctcccaagtagctgggactacaggtgtgtgccaccatgcccagctaatttttgtagttattgtaagaggcaaggtttcgctatgttgcccacagctgaactcctgagctcaagcaatccttccgcctcagtctcccaaagtgctgggattacaggtgtgacccactgcgcccagcctaaacatttttaatatggaacgcttcacaaatttgcatgtcatccttctgctaatcttccctgtattattccagttttaatatatgtgctgctggccaggcgtagtggctcacgcctgtaatcccagcactttgggaggccaaggtgggcagatcacgaagtcaggagatcgagaccatcctggctaacaccgtgaaaccccatctctactaaaaatacaaaaagttagccgggagtggtggcgggcgcctgtagtcccagctacttgagaggctgaggcaggagaatagcgtgaacccgggtggcggagcttgcagtgagccgagactgactgcgccactgcactccagcctgggcgacgagtgagactccgtctaaaaaaaaaaaaaaaaaaatatatatatatatatatatgtgtgtgtgtgtgtgtgtgtgtgtgtgtgtgtgcgctgccaaagcaagcaccagttgctacttcctaacacatgtaagactacagttttccctgggcagggactgagatgagatgtctccttatgtttccctgacctcaacagggtagacactcaggaatattcaataatgacttactaactcacttttctcctacctcagtgcccagcgcctcaagttccggctgaacctgtatgagttgaaggaaggtcggcagatcaaaccttataccctcatgagcatggtggccaacctcttgtatgagaaacggtgagtgcaagtgtagctagcactgagggaatgcagacatctttgaatgtagtatggagtaggtactgaggaagaggactctccttgtttttccatctcttatttgcaggataatatccttattttatgggtgtgttttctttgggcctgtctggcaaccagataggaaagaaaatacttatgttggaagaaggcaaggaatgcacatagcagataaatttgcatctaggcaaaagagttagtcccaccagagtgttctggggtctcccagcaggagccactcttgccctagagctattctgtcagcactggcttcttgggaatagcagggagcctaggaatggggtgttcattttcgtcagttctccttgagggctttatggtgagaaacaaggggcctaactgtagaatttagtgcagaaatctaggatggaattgaaaggaaaccctgtgggtgctttctacctctgggcaaacctgggtggccagaatataagttgagctctctttttcttttttttttgagacggagtcttgctctgtcacccaggctggagtgcagtggcgtgatctcggctcactgcaacctccacctcccaggttcaatcgattcttctgcctcagcctgccatgtagctgggaccacaggtccatatcaccacacccggctaatttttgtattttcagtagagacagagtttcaacatgtgggtcaggctggtctcgaactcctgacctcaggtgatccacctaccttggcctcccaaagtcctattataggcatgagccaccatgcctggcctgatctctttttttttcttttcttttaactttttattttgaagtaatttttgtaatttgtaaaaataccctttagctttcaaaaactttttctttttttttttttgagatggtgtcttgctctgtcgccctggtgtgcaatcacggctcactgcaatctccacctcccgggtccaagtgattttcctgcctcagcctcctgagtagctgggattacaggtgtgtgccatcacacctggctaattttttttttttttttttttttttttttagtagagacaaggtttcaccacgctggtcgggctggtcttgaactcctgacctcaactgatctactgcctccgcttctcaaagtgctgggattacaggcatgagccactgcgccctgcaaaaagtcttataaagttgtaacaattaactcatatttggatgtatattaaatggcttgctgggcgtggtggctcatgcctgtaatcccagtactttgggaggccaaggaaggtggatcacttgaggtcaggagttcgagaccagcctggtcaacatggtgaaacctcatctctactaaaaatacaaaaattagctgggtgtggtggtgcacgcctgtaatcccagccactcgggaagctgaagcatgagaattgttgaacttgggaggcagaggttgtagtgagccaagatcatgccactgtactccagccttggtgacagagtgagacttagtctcaaaagaaataaaaaataggtcgggcgtggtggctcatgcctgtaatcccagcactttgggaggccaaggtgggcggatcacgaggtcaggagatcaagaccatcctggtcaacatggtgaaaccccatctctaataaaaatgcaaaaattagctgggcgtggtggcacacaccggtaatcccagctacttgggaagctgaggcaggagaatcgcttgaacctgggtggtggaggttgctgtgagcaacttgcctcagcctcctgagtagctgggattataggcgcctgccactgcacctggctaattttttaatttttagtagagacaaggtttcatcatgttggccaggctggtctcaaactcatgacctcatgatccgcccacctcagcctcccaaagtgctgggattacaagcatgaaccactgcgcccagccaacgaaaaaaaaagttaataatatctgggattatctggataagaaccttaaaaccaaatactataacacagctcagggcctgtgtttgaacttcctattatgctgatgccgagttaccatctgaagtaacttttactgcagtgtttcagacagaggtgcgtagatggtatctctggggtccagattttaaaaagggtctggacattgctcaggtttgcagttcaatgcctcagcctgtcctgccagaaaaatcactgatttcagatgggctcatagaggaagctcccgtcaatagtagctaagaatccagaatttttcaggtcacctaatgtattttttttcttttcaataagagtaagacatttattttattatttttattttttattttattattattatttttttgagagtttcactctttcgcccaggctggagtgcagtggtgcgatcatggctcactgcaacctttgcctcctgggtgcaagcaatcctcctgcctcagcctcccaagtagctgggaccataggtgcatgccaccatgcctggctaatttttaaatttttttgtagagacaggggtctcactttgttgcccaggttggtcttgaatgcctaggctcaagcagtcctccagccttggcctcctccctaagtgctgagattacaaacgtcagccatcatgcctggcctaaaaaagttattttcatggtggctcatgcctgtaatcttgaactgtgcgtgtgtatgtgtgtgtgtttctatttagagctataactgaagatcatgcccttagaaatgactgtgatccaggcctggagcattggctcacgcctgtaatcccagcactttgggaggccgaggtgggtggatcacaaggtcaggagattgagaccatcctggctaacacggtgaaaccccgtctgtactaaaaatacaaaacattagctgggcatggtggcgggcacctgtagtcccagctactcaggaggctgaggcaggagaatggctcgaacccaggaggcagagcttccagtgagccaagatcgcaccactgcactccagcctgggcgacagagcaagactgtctcaaaaaaagaaagaaagaaagaaatgactgtgatccaataagacatatggataacgtctcttttactgactctttctactgaggatattggccatttgttatttggtattttatagatattccttaccttataaactgttataagtttaaaatattgtaagttgaaatgggtattttgtagacataggatgcaaatacacaaaacactatatccaaaaattgctcacagcagaacagtgtaaagtatctgttgtttcctctggtgattgtgtggctgactgggagctgcggctcattgtcactgcccagcatcaggagtgggtttggtaccacatattgctagcctgggaaaagatcaaatttcaaagcatagtttccactgaatgcctgttgcttttgcaccatcataaagttgaaaaattttaagttgaaccatcataagtcagggaccatcatctgtacataaagatccctaagactgatttttcttttttttttttcttttcttttctttttttctgagatggagtctcgctctgtcgctcaggctggagtgcagtggcgcgatctcggctcactgcaagctccgcctcccgggttcatgccattctcctgcctcagcctcctgagtagctgggactatagtcacccgccaccatgcccagctaatttttttttgtatatttagtagagagggggtttcaccgtgttagccaggaaggtctcgatctcctgacctggtgatccacccacctcggcctcccaaagtgctgagattacaggtgtgagccaccgcgcctggcccaagactgatttttcttaaagatcagtgtctagaacaagtttctgatgagctgccatttccttttgacaatgagagtaacccagccactgagtatccctctttgccttgcctgctagggggctcaaaacaaaactttgtgttcagtctgagttatcttgtattatgttttaatggtttagttttatttttcagtgtttttcatataaactgcctccaatcttttctctaaaggagtagaggtataaacatacacatagaggactgagtgatggtaggaccttgggtgaggagagggaggattagaagaaaacaattctgaaagaaagaaggaggacaagagggtcagaggtgagaaggatagaaaggtaagtgttgaagaaaagaaagtggaaaagtcttagaatatttctagctggcaggagaagggagagggagctggcctcagggaaaggtgatcttcctaaacaggtcctccatttccctttgggtctgggtctaggccggggccttgtctgaataggcttaaacatgaaagcgagcgttcttgagttctggtttctctctctgatgctggcccccacaggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggtacgttggtggcatggagaggggctgggctctgagttacccacccttggtcattaggaaaaaagtgtgtttatgtggcaggtaatggggagaatggtgcaggtgggagagaaagccacagctgctgctccttggaagggtatccagaaattccatctgccaggctggctggctggctccagaggagagcatcttctgttaggagaccacagttagatatttgccacagcagtaagaattccttacattgggtttacagggttctcgcatccattcactgagcaaacatttaactcagtgtagggttagaggcagctcaacaggttgtctgggttggcaacctggatccacccaccaccttagttattgttcttggagaagccagtttccctctctgcctccactaccttgactgtaaaatgaggataaaaaagtctgccttagaagtggtgctgaggaagccgggcgcggtggctcacgcctgtaatcccagcactttgggaggctgaggcaagcagatcacctgaggtttggagctcaggaccagcctgaccaacatggagaaaccccgtctctactaaaaaaaaagttaaattagccgggcatggtggtgcatgcctgtaatcccagctactcgggaggctgaggagaatcgcttgagcctgggaggcggaggttgcggtgaacaaagatcgtgccattgcactccagcctgggcaacaagagctaaactccgtctcaaaaaaaaaaaaaaaaaagtggtgctgaggaaaacaaatgagtatatgtgctgccgaagcgagcacaaaaacaagtgagaagagatgagatagtgcttgacggcgagggtcggctgtcgttattaagtgccagctcttccggccactggggaaagcaggtacagtctgctttcaagggcccactgcagtccagtgaagcaagacacatccaaatacctgttgaactgcagtttgttgggaagaggaggaaagaaagggtctgggggcaaaggtacaggaaggggcaggtatgctcagtgactggagagctgagcctggctggagtgtgggttaaacatggggagaaatgatgctggagactgagatgagacctcaaagggccttgaatgccatgccaaggagtttgaactctgtcctctgccataggaacctagggaatcaggtgcctttaggtggacgtgacaggctgttaccgcctgcaggaggcgctgaggtcctgagcaaagacagtggcagtggggaggcaggaaggcagctgtcaaggggacttagtcacttaaaacagaagcgaaggatgtagagacagaggatggctgggttctccagctaggctagccaagacagaatgtagaaggaacaggtttgggggaagtgggtttgtggttggacaggttgggttttgaggtacctgttaagatatccaggatcagagcccatcagacagctgctaaagcacactggagctaaatagggattcttctccctattttacagagaaactgaggctcagtgaagagagacatactatttgcccaatgtcacactgctgattagtaaaagaaattcagggcttgaagtctctttcactttcctttacataattctgcttccttccaaggaaggagctgagaggggcttcccacatcctgggaatcatcccttacttcaggcatgtcttggggccagagctgggaatcttgagcctagaaaaaagagagttaagggaccagaccaaatcagagccagaggctgtggtttgaaggggttccactctgttggcaggatccggatcacctgtttgaaaccatctcccaagccatgctgaatgctgtggaccgggatgcagtgtcaggcatgggagtcattgtccacatcatgtgagtatgggctgggagaagtctagaagctctgcagacaccctgcctctctcccttctccacgagcatacaccccattttcccagccccctggtcaggtgtgagataagaaaggtgcttttggcagtcctgggtgagcaaaagtccatgcctccctatggctggtaactggcagcctacccagcttcctctggcctcttgtcaggtgaggttctgtgaccccgtgctcacaagagacatttcttccttaacaatgtctccgaagtctcagggatccgtgttggggtgagccacaacaaagctactgcagatggattgaaattctaggtggctcgcatcctctctccagcccagatctgtgtgatgttctgagctctagagaccaatttccaagcctcagccaactccctaagtgccatcctccttgtccttttacttgtttggggccatcaccaggaacctgattggatagagtaggaggtatccttccaaccactttcctacattgcaggataagcatttggacccttttgggggatagcctgcttaattaccgtgaaatagtatttggccgggcgcgttggctcacgcctgtaatcccagcactttgggaggctgaggtgggcagatcacttgaggtcaggagtctgagaccagcctaacatggcgaaaccccgtttctactaaagatacataaaattagccagacgtggtgtcacgtgcctgtaatcccagctactagggaggctgaggaaggagaattgcttgaacctgggaggcagaggttgcagttagtcaagatcacgccattgcactccagcctgggcaacacagtgagactctgtctcaaaaaaaacaaaaacaaaaacaaaaaacccaaaaaacagaatttaccaccgaaggtttttttttatgttctttggggtgaaacacaccacaccttctccttcctaagtggcttgttctctaggcttggaggagcttcttccccctttttttttttttttttttttgagatggagtctcattctgtcgcccaggctggagtgcaatggcactatctcagctcactgcaaacctctgcctcctgggttcaagtgattctcctgcctcagcctcctgagtagctgggattacaggcacgtgccaccatgcccagctaatttttgtatttttagtagagacggggtttcaccatgttggtcaggctggtcttgaactcctgacctcgtgatccgcctgcctcaggcctcccaaagtgctgggattgcaagcatgagccaccgcgcccggccaagctccttcccttcttttgagagctgtgaagtctggccctgaatcattttctgggaaagcctccctgaggtggttccacctgtggaaagtcggcccaggtctctgttcctatccctccttcctcaccacaggcggaggagatgagctagcaggaatgaactagagcaggatagttacacctagaggcagcgggcagctatttgttctgctcccttgccgcagggcttgagggcttggtgctgagggccaggagagctagtcacagtcacggtccagatgggtagagatgttttcttgtgattttctccctctgcagcgagaaggacaaaatcaccaccaggacactgaaggcccgaatggactaaccctgttcccagagcccacttttttttctttttttgaaataaaatagcctgtctttcactcctgcttttgtctttgatgctttcctgcagatctctgccctagctgggcagctacagccagccactcaagtgtgtgtggcctggccctcggcttgctttctggctcgtgctctactccatcagtgcgtgccagtggggacaatccacatgtcacttgctgcatgctccctgtgtgctaggccccacacaagtgctttacacgatctagaatttattcatcataatgactcaaggtagttgagattatccttgtttggagaagaaggacagttaaataacttacccaagtctactttaataagtgataaagccaggacataaactcatgttccattgatgccagagcttagaatccttttcactcaaactctacgggaaaacccttacatcttttattgcttcaggtagaaatttggtcaagtacccataagtagtctagattagtgtttcttaacctggccagctcattagtcacctgtggaattcctaaaacacataccttgatcccaccccttgagattccaattggccttttaggggcctgggtacctgtcttttccagaattccccaagtgattccagcttgcaatctgcagtacatagatggcctaataagcaagtagaaagtttgcatagcagagtggttcccaaacgttagcccccatcacaatcacctggagggctcattaaaagtttgattcagtagatctgggttggaacctgagaatttacatttctgactcccaggtgctaatgacactgctggtccaagaccacactttgagaactactgggttttaagctaaatgcccagatgcagtagatgaggtgcacagaggtgacatgttcaaagttatgtcaggtgagtggctcctagccagagttcgttctacacagctggaggcgggggggcgggggggggttgtccattcttccatgtgcatggtagtaacagctaacaggcagattggctctggtgctgtggtgttttgtttgttttttccttaagagtctcattgttgctagggctggagtgctgtggtgcaatcatggctaactgcagcctcaacctcccaagctcaagtgatcctcctgcctcagcctcctgagtagctgggactacagacatgtgccatcacatccagctaattcttgttttgtagagacggggtctcactatgttacccagaccggtactgaacttctgggctcaagtgatcctcctgccttggcctccccaagtactgggcgtgagccaccaaacccagccagtggtgctgtgcttttaaccactgtttattaattgcatctgaaagcgggatgtcattgaccatattctttctccaaactcaagccatacattgatttagccgaagctgcctctaaagctaggaccaaaactttttaattctgggaagaaaaaaaaaaggttcatttcccaaggactcacacataacagatgtacacaaagctttttgagttttatttttttcctcaggttggagattcatcgtaacatgcatgcattttcaaacagtaacagggtctcaaactttttaaagcagacgttagacaagcacaggggattgaaaattcccatttaaaaaatggaaactgcagtgggatatggagaagtcacacacttggtggggtggtggtttgtcctgcttccccaaaaggtggatatgaacttaattcacattttttaatttcagtgatctgacctgatgctgggatgtgccgagcagtactgccccctcccccaagggtgttggctcccaccgcctctcacagtggctctgcgcaagggcaagaggctcctgtggaaacttctgccctgggatactggcacaagctgccaagggacagctgagtctccttttccccatggggcactcttcataagtggcacattctagaggagggagagggccacggtca

SEQ ID NO: 15705 - DNA, 7626 bp, Human
aagaaagaaaagaaagaaaagaaaaagaaaaaaaaactggtaatcaatttattaaaatagttgacttaagcatctgcaatggtgacttccacctcaactcctggctcaatactgatggaagtaatctgcttaacaatctcagaaggactgtgcaagtcaatgagtcacttgtggattctcatctggaaatgatcccatgtcttagaaccttcaccacaaagtttttcttgaagtgattctcaaagtcttggcaggcattcgaactggtcctttcactttgagattattttcctttgctcctctgatcaagtcagcacacaccttctccagggattttacgatgcggctcgttagagtgactcgaattcgtgaattgccacctccgcctccctgggtgtttttccggtatccttaaaagccatggctgctgcgcggcttcctgagcgactggttcctcggcgagggcgaacagcggtgagtcagtagcaggagcgtgcggatcagcgatccgcaacacctacgaccgcgtcttcctcaaagagctatttatctatatacatttttgagacggagtctagctctgtcgcccaggctggagtgcagtagcgcgatctcggctcactgccgcctctgccttctgggttcaagcgattctcctgcctcagcctccggagtagctgggattacaggcgcccgccaccacgcccagctaatttttgtatttttagtagagacggagtttccctgtgttggccaggctagtctcgatctcctgacctcgtgatccacccgcctcggcctcccaaagtgctgggattacaagcgtgagccacaaggcccggccactatttatattttacacttgatcttggccaaaaggccgagaagcgatactatttatatttttataatacatatccccatctaacatactacatactgcaattacttattatatcttttgtttagtgtctaatatcctcctccacctgcaccccagcagaatgtaagctccataaggaaaagaatgttgatctattttgttctctgatgtaatccgctgtacgccctggacagaacctgctgtaaagtaggagctcaataagtatgtgaattaatgtatcgtgggaaggaaagaacccagagaataaggggcggctgaagctgtgaaaggagcaattaggcctggcgcgggggctcacgcctgtaatcccagcactttgagggaccaaggcgggcagatcacttgagatcagaagttcgagaccagcctggccaataacatggcgaaaccccgtctctactaaaaatacaaaaattagcccagcgttgtggcgggcgcctgtggtctcaggtactctgaggctgagacagagaattgcttgaacccggaagacggaggttgcagtgagctgagatctcgccactatactccagcctgggcgacagagtgagactcggtctcaaaaaaagaaaaaaaaagtgtgtgtgtggggggacgggtcaataaatagagcaatactgtatatgtaaaatacagaatggtatgataccaagaacacatagatggaatgatctgcagcacttctcaactgtattacattcaacgaaaccgtttagagcttgttctccctccctcccccactttctttgttccttggggaacccccacacggcacaaaccgtgttttaattcctattctctagtgtgcagataagtgcctggcactattaagtggtcaaaagaggtcgtgagcaagttaacaaatcactgtttccatgtccctaactactcttaagctcgtagagaagatacttcctatctcttgcgcttctacttcaactcccacttcgcagagagggctaaaagcgacgtcgtaaacttattacgtaataaggcagcgcccagaggcggaagaggccggtttttgctccggccacgtgaggagggtgggcggggcgttaaagttcatatcccagtgtcctttgaatcgacttccttttttcttttttccggcgttcaagatgtcgaagcgaggtgaggttttgtttctggaggatcctccaccatctgtcgtgcagtggctggcggattcgtcaggagcggtggccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacaggacgtggtgggtcctctggtgcgaaattccggatttccttgggtcttccggtaggagctgtaatcaattgtgctgacaacacaggtgaggtctttgcacgttgctatactcccccttttaaaagcactcaatgggcctgtggctaatgacctattgagccgtcaagaaaggggagagtgaaaacatcgcttttgggtgaagtggcaacatgtgttgtttgcttcaatcggtggtgtgacaaggcgttcttgcggactaactgcttgggcagtgagtggagggaggggctttggaagtgtttgggaaatgttatactgatggaacggcctgatggccctcaacattttttatttttatttacattcttttgtaggagccaaaaacctgtatatcatctccgtgaaggggatcaagggacggctgaacagacttcccgctgctggtgtgggtgacatggtgatggccacagtcaagaaaggcaaaccagagctcagaaaaaagggtgagtaaacactgagcccaccttaatactgatgagtagtggggggacgctttcctttattggaaaatggatcagttttcaaggcctcaagtttgttttccattgagaggcagtgtgagataagtatcttaagtttttgctcatattgtgttggaggggggaccatcatcttgtcacttccataccttagttgtttttttgttgttgtttttgttttgttttgttttgttttttgagatggagtctctctctgtcgcccagcccatactggagtgcaatggcacgatcttggctcactgcaacctccgcctcctgggctctcaaaaaaaaatatattacaaaacgaaaacaagctgcccgttgcttattttattatttgtttttgagatggagtctcacttgttgcccaggctggagtgcagtggcacatatctgttcactgcaacctccacctcccgggctcaagagattgtcctgcctcagcctcccgagtagctgggatcataggtgtgcaccaccacacccggctaattgctcattacttaatctcaggctccccactcaaaatttttcctgtcaggtgtatgatttaaagggggaggcctcaaaatacttgcagcttgtgtcctgtctggctttagaacttctggtgtttggtgcattttaacttcagcgcttgcacttttttcctgtgcctgcctaatctgtctctaccctgggatgtcttgctcttctaaagagttcctggccatcccttgatttacaaatgtgatgttgatttgtcagccctgtattacagttactcctattcctgtatccaccccacgatgctgtccagtagatttttagcctttgggttagaaattgttttttgttcaccattaatatccatttgagggctgggtagcactgtgattgtgattcagcaattgcatgggctttttcctcttctcagaacacttcctgggtctgattggtggcccagggagctgtcagagaagagcagagcaaatggccttcactttgtagatgagatggcaggagggtggattgttggtctcagtcagtggtgggacagaccagagctccgaacacttcagttttaaaactagttgtgagtttccaattctgttaatgtcttttttggtccttgtttctgctaaatgaatacatcccctccccttggaacttaatatcaataaataacaagcacagaaatatgcaaaaggaccaggtctacttgaagaatttgtgaggattaaatggtttatgagtagaggagggtcagtcagtaagtattggctacctcatgtgtgtcccattactaacttggttagacttatctattttttgtgtagtcttcctgtcataaaaattctgtgtaaggaccccatgctagtatcagtgaagattgtgaatccaggtgtgtctgactctacaatagttcttcacaagcattatatttcactgtgtagtgatacttcattttgaaagttgggaaaagcgtctttttcactttagtacagatgggtataaaagttacttaggacactagaaaacagttcattaaaagtaaaacaaagcctggtgcttgggcccaggaattcaaactgttttccagtgtaaatctgaatagcttggtctctgctcattgccaggactgggaggagttgggggtcccaggtcccatttctacatcccaattcagtgatactgggatcttaataacctacctgtgaggtgaagttggaaaaggcataggcaaggatagttgtcctgagagttttacacttgtgagaaaatactggcagctttgattttaagatgtgaatagatgatcgtggttcatgcctatactccctatactcccagcactttgggaggccaggcttgccaacatggcaaaaccctgtctctatgaaaaaaaaaaaaaaatctgggcatggtagtgtgcacctgtagtccaagatactagagaggctgaggtgggaggatcaccttgaagattgatatttacactgtcactgtctcaaacgctgagtgtacattctgtctagttggaaactgcttttgtggtggcactgcgacttgacaggttaatgactgctgtccttttttcttctctcagtacatccagcagtggtcattcgacaacgaaagtcataccgtagaaaagatggcgtgtttctttattttgaagataatgcaggagtcatagtgaacaataaaggcgagatgaaaggtaggaaatcagtccagcttgttccttaggtctctgaggttgggtggattgtctagaagtacaggccaaggatcttctgtgtttgacgatgtcttaatctgtcccccacatgtttttattttattttattttatttttttaatgcaggttctgccattacaggaccagtagcaaaggagtgtgcagacttgtggccccggattgcatccaatgctggcagcattgcatgattctccagtatatttgtaaaaaataaaaaaaaactaaacccattaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctgcagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacaggtttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcgcctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttata

SEQ ID NO: 15706 - DNA, 55675 bp, Human
acaggacagggcacacagatagaaggtagacagcgagcaattttcccctcttccttcttgactcagctcataggcagggctttggcttgataagctatacatggaaagttcaaggcctaaaggagaggtaaaactggttcctcctgggttttgcacggaaccgcagctctgctgatctgtgatctctctgttcagcctagagatacagctcacagtaataggagccaggagaaaaaaatgcgcgtttccccggggtccgaggaatgacacaaccacattccgggtttaaaatatcgcagctgccctttgacccaggcagcacgcctcttcctttctcctttatttttcctttttttgggcaaaacctagtcgagggggacgcccttgtctcccgtcacacttaccattttcctccggcccaacagtgaccctgtcaggcacgcagccagcagatacttgtccccatctttaggttatgaaactccatggccttttattcttacttcagtggttcttaaaatgtggtccccacaccagcagcaccagaggcacctggaaacttggtagaaatgcaaattctcggggcccccttacagaatcagaaactagcagtgttttaacaagccctgcaggtaattctgatgcacgttcaaatttgagaaacactgtgttcgtttatctcagtttgcactgggttataactttacttttgtacattaatagtcaaggatgaacacagcacgtccatgtcaccattaatacagaaagttgaagttggagaagggctgtgtctatgggtttccctcgcctgacccaccctccacccccaaaaggaacgccaagttgaggcgttcccctgtctccctacccccattggaaacatcctgtccctcaaacccggcacctcgaactgtctgacccatctgaggctggcgcccgtggccgcagaaatccctacacctctggcgcgagtaatgcggtcgcgcagcttttatacccaccccctcctcccgctgagcacaaagtaaaaccgaaagatttctgctaaggttgaaaaatgaggaagatactttttcttttctttttttttttttttttagtcaggacccaatgttaaaatgtgagtcaagaatgaaaaacagatggttaacaaggggaaggaaaaaccaagccattgagggggcacccggatttgaaccagggacctcttgatctgcagtcaaatgctctaccactgagctatacccccgcgcctctacagcgcctggaggcggctccttgggtgctaagcattgttgcagctgctacactgtgagtagtggtgtaacagaaggagaaaggaatgctggagaaaaaggggtcaagctgaacgcagacggtgcccgcatccggggaaccccgggaaggtgcactgcaggggctcgagagggaagcactagcccgggcccggcagcgcgcagggtccaagagggagggacgggttccgccccacaaatgtgggaaagggtgtgggccggaagagagctaagaggggcagggtagggggtccccgttcggtccgcagattcatgccgggtagaaagtccccgaatgcggtgaatcagttccagcgttcaggaggatccaaccccaccctcgacgggcttgaggggttagcccgcctcccgcagcccgggcgccccagatgtgcagcctgctcgcctctgcgccgcctccggctggggaagggccctgggcaccgggcgcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataaggtgagcccgggaccgggagacgcgtctttgcaatcccccgcagtgctccgaatccagggaggagagaagggccgggtctttgccgccttatccccgcgatcccaggagaatggagggagggcgagcgggcggtgtcatggggtgtggggacacatcccagtctgaaaaccaggagatctggggcgaggcgggaagtccacgcgtagcgggcagccgctgctggagaggggtgggctctgtgtcccggggttgggaggacgggagaggagcagggaagtcaggcgccggggtgtgttgggggaaggttaggggtgcagtcccgccccctacggcctggagagtgagaagagacggccgctccctctccgctctgcgccgagcgccaagtaggcggaagcgcggggcgctggtggagggggcgggggggcggggcagaggctggggggccctgcaaaaccgtccgctccggcgggggtggcctggcttcctggcctggcggggcgggggctatcagcctgcgagtgtgtggcatctgatgcggggggttttgggtaaggacccgggctctgccgcaagagccccgtttttgaacgacctgcacccccttggattcagtcgttaaaggactcgcagacctcctccacagcttcccaacccccacctccaattaaaagccaactcccggtgctgggccgtccagcctgagccgggtggggttgggtggcagagtagggtgggtggagggtgcttagctgagatctcctgaaattgtgctcagagccaggagaccgtgtggaagaacaaagagctaacttttcaaagcaggtttctccaatggagggtggggttggctgagttctggggaagccgaggaaagggggaggtattggggggaggggagggtggccttgtggagattcagtgtcccctgggggccctgtctccccaatgctggacttgttcatctggttgccattagacttttggaggggggttggagagtagaactgggtgtttcccgtacagtttagggtaggatcctgttctcttgtaagctccgtaagatcctaaggtaaaacctgcccctctgcatcccctccccagtctggaggggaggcctctgtgattttgtgcccttcctcaccgcgtctttcatccaccacccaaagctggctccaagtccaagtattctgtcctttccatctgaactgggagggctgggaggactggatggaagagaggtgcaagggtgggaacactagatgaaagaggggtatagagccctggggccaagttcattactgacctggagccaggttttgttcaggagaggatagtttattggacaccttatctctcccctcccccttggtgtgtgagcttcctcagtgacctttggcctctgagtcagcgtgaggaggtggggttggaggttctgaaagatatttgaacttgctcttggggagtgtgggcatatggggccgctgctgtgtcactgttcctcctggtcctgggcttgactgggcaggaggagaggagggggtatattgtgggcacgaggaaagttgttgatctccccatgaccatgccagccgctgttgggcaggacttgagcttagagctatcagataatgaagtctccccttgagaatgtacctgtccttgcacactggggtttcgcccgcccctcgtggcagagattttggcctctgcatcttgagttccctgtggtccccttcttctccacagtcatgaattgggaagaggcagtgggcacttgacccgtataaggaaaaagcaaaacatgaaggcaggattgccactccaggagttgggaaactgggtccttgttccaggtctgctcccaccagttttatgaatgtctctaggcctcagtattcaccatctgtcagatgggtatgatgatgtcatttccttaaaggtggggcagtgcactaaagtccctgagtgctaaagagggtgctgtatagactatgccctccctacctctctgggatgctctgttcagctccacaccactccccttggaaagaccttcagtgccgtgtacccgaggggaggggagcagggatgggcagggtgccctccccagttctcttaccctagctggaagaggacgttcaagtgggggttgcccagggaagtgggagttggtgattccttcctctttttagaactctccctataggaagtggccctggagagacctcgccccctgtactgagcaggagacctgaaatatccaggtatcagacctattcctctccacctgctccaggcagtaaggataggaccaggaatggggagccagtgcctggaggatgctgggctgtgaccagggaggaggggaaaccttcagtcccataggcagcttcagtcccatagttgctaaccaacttcccaaggcctcccatttacagcaaaagagtcaaattagactcacccgtttctctacaatcccccatggtactcagcccactacgtggcccaaagcacagggtgtgtccttggtttcagccttttctcctccctgagccttatctcccaaaggcataggtgggtaaaaaccttgtcacctctgaaggccaccctgcccccaacctgcagtacccagcatgctttgcaagctggataaatatgtattgctgatgacagtgtttgaggaaggaggtcgagatttgcttctccagaggacttctgggattagagctgggggagaaacagggtgacctcatttgctcattcaacaaatatttattgagcacctactttgtgcacctgctttgtatctagggagctgtgttgtcaagaacctcgccacgtccctctttcctggcttgcttccccaggtttctgaaaacaggtggaggtagaggattggtctgctgccagttcccctggaatcccctgttagggtgggctctctgcctctgcttgtctcagcgctccctccccactcgagggggttgaagtcctcacagctgtggtgccccgttttgctagctgaagcttagagtaccccaccatcatcttgtgaccatcccttcataatagctactagttatcacgatatgctgggctcagtcttcacagcagcctcacaaagtaggtgtattcgctcttgtaaacgatgcactccataaacggaggctcaggtagcccatgtggctcatctccctctcttagagctgaaattcacatccacagttctttctgctcagctcttctgccagtgtgtttgcagaaagtacttttatttatacatatttatattttatttacatctcatttgtgccaaaagtaggtcccatcccttcctgaccctatctggaggaatgctctgggcctggggtcttgtatgggggcgtggggccactgggaataatcctgtcctcctcggaatttgtggaggtgcagcaaagatctatgcctttaagccagcgggtcaggtggccaaccaagctaggctggtgccccggcgagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccagagccacagagggacaggctgtcccaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagaggtagggtctgtctggtttctgtgaacagggaagccatggactttgcaggcagcaggaaggggcagaggtgcatgcctcgaggtgcagtttccttgagtcctgaggcccaggaatgcttcgctgaaatcatcttgcctggggcctttaaaagaggggggctcttgctctgggacagagcccatggggcagggcagaggcagacggggtcactgtggggtcctctggacatatttccctgacagtgtccttccccagaccccattgagacaaggcaggggttctttcatcttagggtccaggcttggctcacagcggttgtggagggactggccattttctgcctcccctccccacaattttcctaccccaaaaaggacacagtggaaggagctggtgggttttcttgaaccttggggccttcctccagagagggtaggggagtcgcctgaagctgctggaggtgccaagcattaggggtggaacggcctcctctcctgaccttccagcactctgggagacagtggctgcagctccacttgacacttgtgcttcatagtaactggtttccatgtttctgctcagagccccctgcagggggacaggcgaccaccctcctctgccccacccttgggtgtctggatgagagtgtggggcctgtgagggaggtgggaaggagctactgatagaaataggtgccatcccctagaagaggggctctgcttcctccgcgtggcagcctggaggggtctttggaaccactgggtccagtgttggccctgtgccccctgcctgctcagtacaccccaccctccttctccaaggggcttggctccgggtgcaggcctggccatctggagtaggggtctctctccctttgtctccccaacgtcaatcaggaggcagccttggaggtccgtggtcctaggacagtgtgtagcccttcgtgtgtgtgtgtgtgtgtgtgtgtgtgtgtgtgaaagtgggtcatggtctggattctggagaatgtttttcctggcaggcccctgtgggggtagggggaggcaggggcccaggcaggggcctaggcaggggcctgtgcagctaagtaggcagaggccagcagactgggtggtgaccaggctggggcaccctgccaatgcctcccagttactcggggagggagtggggctgtcacttcaggggcctgtgggggcagggaccagcctgtcttagtgtccctggtgggttctgtgtgttggggtatgcaccacttcaggggcctgtgggggcagggaccagtctgtcttagtgtcccggtgggttctgtctattgggttatgcaccagaaggagtctttaagttgcctcataggagtttgggggccctgggtcactgggataggcccaggttggggagggggccaagcttagacccgccacttctttgcttccagacttccggctggccgtcctccccaagagtggttctcctagcattctgtttaatattccaccattaggtttttcctttgggtcttcttgatagggaaccagtaccctattagaaggtgatttccccctgaaattaccctgggggtctctggttgaagtgggccatggtagggaggttgaatcccagattctcagccttctttctgctatcccctcctcccagtgtctcagaagcacctctccctccgggggtttggagacaacattttgaaaagcatcgccttgggggaattccttgacaaatggccaagaaccagctctgtggctgggctccttcaaaagtccccctgggcctgcctcctggcctccttcttttggaatggggaatgtctcccttgactactgggaaatggggcagggacaggccagccaggtcactcaggtggcctggattattctggggtcctggcagtggacccctgtttggtggtgatccagcacatcatcctgggcttctgggggtgaatttagatcctgttgtcatgggtttgcctaagcatcaatacttctcaggggttccacaaagacccctccaggctgccacgtggagcctgttagatcgtttctcttttttttttttttttttttgagacagagtcttgctctgtcacccaggctggagtgcagtggcacaatcttggctcactgcaacctccacctcctgggtttaagtgattcttttgcctcagcctcccaagtagctggaattacaggcatgcgccaccatacccggcctatttatttatttatttatttatttatttatttttgagattaagtctcgctctataccccaggctggagtgcagtggcatgatctcagctcaccgcaatctctgcctcctgggttcaagcgattctcctgcctcagcctcccgagtagctgggattacaggcacgccgtcactgcacccggctaatttttttgtatttttagtagatacggggtttcaccatgttggccaggctggtcttgaactcccaacctccagtaatccgcctgccacagcctcccgaagtgctcggattataggcgtgagccaccgctcccggctagatctgttctctttctgtcatcactctcttccctccgtcggccaccctggatgggccctgtgtcccacattctcttttttttttttgagacggagtcttgctctgtcacccagactggagtgcagtggcctgggttcacgccattctcctgcctcagcctcccaagtagctgggactacaggcacccgccaccacgcctggctaatttttttgtctttttagtagagatggggtttcaccatgttagccaggatggtctcgatctcttgacctcatgatccgcccgcctcggcctcccaaagtgcgggattacaggcgtgagccaccgtgcccggccgtgtcccacattctcacacgcatgaatggattggagctgtggttggcacagtgaagcccctctgcaccccaacacacacaatctccagtgtgagccctgaccccctcggctaaggttcacacctgctgtgcccagcacctgacatctgagtgctcagaggtgccaagtgctgtgctgagggctttgaaggtgatttctcctcagtcctggacaatcccaggagggccaggtgttattacatccattgtacacaccaggaagtgggctcctctgaggtgcagggccccgcccaaggccatacagttagtggggtagagctttgatgtccactataggggtgtccaccttcaaggctttgaagtagagcccttcagtgcctcagtgggagacccgctgccgggtgctctcctgccctcctcctggggtgggagaggatgagggaagggtagaaaggatgtgttgtgttgacagagcctgggacacccagcccactcctctggccaggcatcccacaggaagtgggaggtatcggagctgtagcaccacctggggctcatgtggggctggtgggtgtgctgggccctggtacaggagctaggagcacctgggttctgggcctgggtgtgtgggggctgggccttcctcttctgaggccttggtgccaccagaggagctgctccttcatgttcagcggctgctccctagcaacccagcgcagctttgcataagcaatgaggcctcgccagctctgggcaggaggggttccctggggagggtggagctgacttgggggctgctgccactgctataactgggctcttcccccctgtccttcatgcctgcctgtctcttcctcctgggttcaaatggcccattggtggaggatgaggaaggagagaggggaggggagtgccaaagcctgtgacctgaaatgcccccagctcacctgggatgattccatgttctccccacagccatgggcctaggacagtcccagcagctcctgagtgccccttcctagggcctgagcccctttttcagaagtcctggtatctgatgtatgtcctcctgtctccatccccagttctggcataaagcatgcttccattgcgagacctgcaagatgacactgaacatgaagaactacaagggctacgagaagaagccctactgcaacgcgtgagtcctgttctgggcagggggctgggtgggcaccttggctccctccccgagtgagttcttcctttccttccaataaccgcaaggtgacattggcgaacacttccatcccctacttgaacatcacagtttgtcctcacaacagctgaatgaagcaagcactttttatccccatttaaagtgcttttatcccccatttaaagtgcatttaaagtacagatgaggaaactggggcttagggaagggaagagactctcaaggtgggatggctagggcaagacaggctctaacccaatttcgggcagtaaggcgagcacgtttctttccactgtcccctgctacaaaagagggggctttcctcgtggtctttcaagaatgagtgacctgtctgttgtatttggggttgaggactttgttctgtttaccttcccttatttctctcctcaaaatcgacagtttccttctctcacctgggtacttctaggctttgggggctccttcctccagtggttccttcaagaaaactctctggaagcctcatgccagcccttttggtgttcattttttgagaatgggcaggggtgcataaagggtgttgcctgggccagatagatctcttccctgcctggtgagggaggctgtggagactgtttcttttgagtatagtcatcttgagtatagtgcagctctgttccttctgcactgggacctgcagcagctgacggtagggagggagtatagaggtggggtcccccatcccagagcctggaggaatacctcccctcccatcccatcccatcccatcccatgcaatcccagaaagtacagcaattttccatcttccaattgaccttgtgagtagcaagtacaaactcagtgttggggcctcacagccgcctccacctgcgaggtggaggctttggaaggtcaagtcacttataagtaatgatgtaatgataatttctttttcttttaatttgcttttttttttttttttgagtcagaggactcatcacccaggttggagtgcagtggcgcgatcttggctcactgcaacctccgcctcttggattcaagcgattcttgtacctaagcctcctgagtagctgggattacagatgcatgctaccatgcccagctaatttttgtattttttagtagagaccggggtttcaccgtgttggccaggctggtctcgaactcctgacctcaagtgatgcaccgcctcagcctcccaaagtgctgggattacaggtataagccacctcgcccagccttaattcgattttttttttaattttaacttttttttttttaacttcaaccaactcaagtaatggtaatttcagtgttcacatgaatttaggatctgacttgagtccagttttttttttttttctcttaattctcagtcaggaggctctttgcagctgaagttcacccagggaaaaaaaaatttgggacttgtctaaaaagggggcttaaacctccagccttacccctaaccttaccccaaaccttccttgcttccttaccccctcccgttccctggctaagaccactctttcatctttttaggggctcgctcattcagcagacatttattgcctgcctgctgctataatacatactaacctgcaccaggtgctgggaaaacagattcctgataaaaatctcaagcccaagaagcaacatgaagttgtcccttctggaagaaggagggcactgggcaggttatctgggtaaaggaagggttgcagctctgtcctggcccctccttcagctgccccttctcttctattaatttctactgttcctcttccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagtgactcaagtagcctagaattcagtgagcactgggagctggagaaaaatcagaggcttgtccttgttttctctgcgttttatcagcctcatccaaagttccagcttactgtttttactgtcttcttgggaagctgccacaaggttgggtggagggctcctgcagggactgggggagccagaagaggcagatcaaggtttcttctctgggtgatgcttccaacttgcagaggcagaggttcccctgtctccctcctggcctccagccaaaagaagcaggttggcctctccatgtttcctccagcttttgtagccctagcctctgccatgcctcattgacctttggcccagttgggatgtttcctgggaaggagcctagtgagagagacctgggggctttgtgacccagctgtgtttcactttagctgtagtagcacctcctcgcccaaggcagtcattctccctcccctgcatccactgggccaagaagttacccgtggggattctgggatgaaccaggtgtggcgcccgcttgcaaggagtgctctctggacgtgtctgagccttggtttccccatggttaaaaattcctgcccaggaggcctggcatagtggctcacgcctgtaatcccagcactttgggaggctgaagcaggtggatcacttaaggtcaggagttctatcagcctggccaacatggtgaaactcgtctctactaaaaatacaaacattagccagatgtggtggtgggcacctataatcccagctactcaggaggctgaggcaggagaattgcttgaacctgggaggccagggctgcagtgagccaagattgcctctgcacttcagtctgagcgacagagcgagactccatctcaaaacaaacaaacaaacaaactaaagataaaaaaaaattcctgcccagggatgttggaccctagaccaaagaggatttattgagctcttgctatgtgccagacgctaggccgagtgtttgctgtcattccctcctgctttcttactttttttgtttttattttgctttggttttttggagacaaggtctccaaaaaaacttcgtcctgctcagtcacccaggctggagtgcagtggagtgatcatggctcactgcagcctccacctcctgggtttaagtgatcctcctgcctcagcctccctagtagctgggaccacaggcatgtggcgccatgctaatttttaagttttttgtagagaggagggcttgtcatactcttggcctcaggtgatctacctgctttagcccagcctcctcctgttttcttcctgcctctggtcttatccttgagtgacattcaggttcctgaatcctgggtttaccagggtacagctttctgccatttctgttctggtcttgctttgtggaccacaggcctggcttccttctctgaagcatcacgtgctccatgctgggccaagcccagtgcaggacccgtaggggcacgtggtttcttctggcactttgccagggagttgggcccacccagtgagtgtgtgagtttggtgtgcagggaggcctctatgttctgcctgtctctggctagtctctgaggggagctaggatcttgcagggggctggtcaagaaagaagaaagctatctttccctgtggtttctcaagattcagatttaagctctagaaagtgactgtaaagtaggcagtgaaaaggcctcttctgtttctgtccttgcatcagacttgtttgggggagaggcaggggagagaacataggccagagctcactgccagcccacctggtgtggcggacccccacatgcgtgcagttacacacatgcctggtgtgtaggcagacacccacgccggtgctggggcgggggaggaggacttgggagctggactgaatgggctgtgtttgtgtttccaccttcaggactgcagccatgcagccaatgctgtggcaaggttgagggtgcactcccggcttctgcacaatagccagtggtggaggaagaactgctaatagaattctttttgtttgttttttttgagacggagtctctgtcgctcaggctggagtgcagtggtgcgatctccgctcactacaacctctgcctcccaggttcaagcgattctcctgcctcagcctcccaagtagctgggattacaggcacctgccaccatgcccggctaatttttgtatttttagtagagatggggtttttccatgttggccaggctgatctggaactcttgacctcaggtgatccactcgcctcggcctcccaaagtgctgggattataggcatgagccactgcccggcccgaattctttcttgaagcttctgggtgggtggagtgagcctgctcttggtgagagagatatttaagagagatatttatgccctccattacttgttttgtaaactggattttccaaaagtggggcagatcagtccacacgcccaggcttagcataaacctgcatcgttgtctccctgcagatagtctagagtactgcctgttccctcctctttagggccctactgacaggaggcagggttgccagccagggaaaccagcttgtgaggtgtcaagtgggaggtgggcatgggctggggaaggaaaattgggggacttggttgcacctttcccctcttctctgactgcacatatttggggttcattctccagtttccttgagctgtggggtaaggactgaggagggtaaagatgtccctgattctggggagccaggaactatgtttctgccccttcccttaggcatcagatgggagtagggtgtggtctgtgtcagacaaggctgggtgcttaagtgtctctggattctagcaaactgtctttaatcccagctgcttttaaaaggtggggcagggttgggtgcagtggtttatgcctgtaatcccagcactttgggagactgaggagggtggatcgcttgaggccaggagttcaagaccagcctcatctctacaaaaaatgaaataaattagccgagtgtggtggtgtgggcctgtggtcccagttacttgggaggctgaggcaggaggattacttgagtctgggaggttgaggctgtagtgagccctgattgcaccacagcactccagcctggcaacagagggacactctgtctctaaaaaatgtaaaaatgaaaataaaaataggtggagcaggagtaggcaaaccccgcactggggcccagggctttccctccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttttttttttttttttcttttcattttgtgtgcaatctgatggctggtaagttcttcctcaagtctagccttgatctttttgactgctcttttttttcctctgattgaacaatgcctccttgttgcttcctatcgccaccacttcagccccttaggcctgaggggatggacgggtgagaaactgggttagcagggagccctcccttcccgcctgtgggcagccttcccagtaggggcttttggaatccgcagctctttctagaggcaggatgtgggggctgttttttttttttccttttggtaaaaccaaaagctccttgttgcttttgttgatgtctttttgttcctccttgaacacaaagctgtggtttttgaagagatccaagcctggaacgggcgaggctctgtgtagaaagggcgctgggctttcgggttcgctatcctgttcttctgaccctggagtgtggctgatggcaggactggagagtgaggctggtggctgacaagctgtccctgtcacctgtgagcccggaaaccttgcccctgtagtcccaccaagcaggaaggccacccagaggtcctcacagataacccctctcctgggacacagggcctcttcagtatcatatccttttttttttttttttttaatttttattttttgagacagagtttcgctcttgttgcccaggctggagtgcaatggcgcaatcttggctcactgcaacctctgcctcctgggttcaagcggttctcccgcctcagcctcccaagtagcggggattacaggaggccgctaccatgcctggctaatttttttgtatttttagtagagacggtgtttcaccatgttgtccaggctggtgtcgaactcctgacctcaagtgatccgcccacctcagcctcctaaagtgctaggattacagcgtgagccaccacgtccggctttttttttttttttttttttgagatggggtctctctctgtctcccaggtggaagtgcagaggtgtgatctcggctcactacaacctccgcttcccgggttcaagggattttcctgcctcagcctcctgggtagctgggactacaggcgtgtgtcaccacgcccggctaatttttgtatttttagtagagacagggttttgccacgttggccagactggtcttgaactcctgacctcagatgatccgcccgcttcggcctcccaaagtgctggcatttcgtgcccgacctgtatcatatacctttgaaaagttcagagggataggcagctcctaagcaggtgtggctgagaggccccagaatatctctcataatggccgagcttggaaacgagttgggtttgaaggatgaagtgctttgttttgcacccaacctgccaagcacatctttccccagaactgagtgctggaggtggctggggtccatctggcctccccttcgctgtctgggcagctgtggtgtagaggagaatgccttgggcaaggtctctgtccttgacactggacctcagtttcttcatctgtaaaacggcacaatgagaatgccagcctaaagctgtgtggtgggttttgagagagaatgtgcacaggactcagtgtgccaagatgttgctttgtgtctctgtaaattgtcctgaagcccgaggctgctgccaatagctgcctgtttgccctgccctatccctgtccagtccctgttcctgccccgcttcttcctgtcctacatgcctctccctgcaaactccccagagcagctgatagcagggaggaagggtgggtggggcacctgcagagagcccaccacccacttggaatgattaacaaggggccagtacaggctggcctatgggacaaaggacagctgtgctctggactctgccctgcacccagctgatcaccctgtccctcattcctcgccatggcccagtctgtcatggggttgggttccagcggagtcaccagctgggacgggtggcccctggtctgtcttagcacccatgttggcatgcacacatttccagccatccctgctgggatctaggggtaatggatgggatgggcaggaagggaaaaggtagaattcccaaaaattgtttctggagggaggtcaaatcagttggagctttctttgaagcccggcatgctggtggggggaggggtgcagcactgatgttctcatgcctttgcttctagaaacaaacccgtgacacttgtcctcctcacctaaattatccagaaagatcctatagacacagtctcctgactttgccctcatgggcttctccttagttgaggacccccttgctgtctgtgcctcttcctcaacccccgtagacctctctctctctctcactcattctctctcactcgctctctcactctcactctctctctctctctctctgtctcgctctcgctctctcctcactctctctctcactgttgctgctctcctgcctggagctgaagatgaggttgccatggaaacctgaagcgtagtgagccgggagagggaaaggcagagtcgtctcgccagggctgggggctggggactggggactgtgggctgtggggaggggacagggttgacccagcaagaggaatatagcccaagctgtctgcctgccttcctctgcctggggttgggcttagtgggcaggggaaggagcttggaggctctggagtgcctctttaatctagttaatctgatgcaggattaaaatcctccctcactcctgccaaattaagctgagctcacatctgggctggctcacccccacttcccttctgatgggattagcactccagctgtcgggggctgagactagggggaagggtgcttctgaagaggatgaagtacctgccaaccccacccaaggtgcctgctgcatgttggaggggctcccgagaccgtctggtgggtgtagggtgagcagagggacacagtgtggggtgcagggggtgtgtggacatggcctcaatgcagctgctgcctgggtgtcttggaggcgcccatcggtgcagagggcacatctatatattcatcgtgtgtgaggcacagtgcagtgtgtgtaggaacttcagactgtggaatgggtggggcacgtcaggtgcacctgtctggcggtctttgggcactggagctggcctctgttttatttatttatttaataaaaacaggctctcgctctgtagctcaggctggtctcaaactcctggctcaagaaatctgccctccttggcctcccaaactgctgggattacaggcgtgagccactgcacccagcctggcctgttttaaccctgtgcattctggccaatgagaaaccccagggttttgcagaccgggtctggaggatgtgtttgccctgcttgcctctagccctccccatcaaatgctaaccagcctcatcttctcagaattgagtcttcgagtgctgggccagagctgcccggaggtctcctctcccccaccctgcttttgccacatgtgcctctacttccatgtgcttgcctcaccacagcccctgcccatacagtctgcagaatggctctgatgttgggaggagggtcgtctcgtctctgaagcgctccctcttagggcctcagggcctgccagccctgctagagatcttccctttctggtctctaggaacagactcgtggttgatcatcccttggcctggaattgtacaggaactttgaagggagctcctcagctgtgggtggccctggctgcacggggacgaccccagacttggccacgtattcatcacaggccacgtctgttgccagctgcggacacctgtgtttgcctttcctcatcttcccttcctctgctggaggaactgcgagtctgggctgacctgggtggccaggacccaggtgagggctgggggacgggcaccgctaggatcatctggatccgggacagtgaaactggcccaagggaaaaaggatttgccaaggtcacccagtaagtcagtggcagggccagagccctgcactgggccctgtcaagttatgctcccttgattgaggtctccaaatcctgagccctgcccttcacaagtggtggcctcaggggaagtcgcctgtttacaggtagctctgatgcacggccatgtgggcggcaggagaacatgccgagcagaggggcagctcgttcttagctctcgagtgtgtcagttttgggtggaacgtgcctaggaagaggtcccaggaggccatctatggcttacctgggtgcagcctgtgagtcagggatctgcaggggtcatagctgtggtgggctgtggtcacccagggctaaaaatggcctgacgggctccggcttggagaagccacccaccagtccctgaagtaattggggcccatgcagacccccagacatttctcatagcagcacatacacacaaaccacatggctcagagctgcctgtctctcctgcagctggtttgctaggggaccttgtgatgagagagggatggagaagggctgagttctagtcctgcaccagcttcaattcctggcgtgacttttttttttttttgagatagagtcttgctctcgcccagactagagtacagtggcggatcttggctcactgcaagctccacctcccaggttcaagtgattctcctgcctcagcctcctgagtagctgggattacagctatgcgccacggtgcccggctaatttttgtatttttaatagaaacaggatttcgccatgttagccaggctggtctcgaactcctggcctcaagtgatccacctgctttggcctcccaaagtgttgggattataggcgtgagccaccatgcccagcctgacatttgtttattcaacaaatatttactgagcatcgcctactattctaggaacttgagataaatcaatgaacaaaagagaccccaaaatccctcccttcatagagaagtagtggagagagaagacaatacattgatgtgataaataagttaattatgaagactgctaagggagaagtgcctggtgccagcacaccgtttcctcctctgaaatgagggagttggaccagagtcttctggaggtctctgcaggctctgagggttgccgtggcttcggctgcctccaagccaggccctcttcctgggaccaggctgtgctgggcctggaaattggcggctaagttcagcatgaactgaagaaatcgtctgggcgcaaatctggatccctgtgtgtcttggccatgttgtttaacctctctggcctcagttctcccatctgtcaaaggggtacgctgaataccagtcacacaggtggctgtgagaattcggtgaactagggcacataagcccttagcacagggagaacattcactgtttgtttttttttgttttgttttgttttttctttttgagacgtagtctggctctgtcacataggctggagtgcaatggcaggatcttggctcagtgcaacctctgcctcctgagttcaagcgattctcctgcctcagcctcctgagtagctgggactataggcgcacgccatcacacccggctaatttttgtatttttagtggagaccggggtttcagcatattgaccaggctagtcttgaactcctgacctcgtgatctgcccgcctcggcctcccaaagtgctgggattacaggcatgagccactgcgcccggcctaattcactgttgttactatagattgagcagccctaatccaaaaatccagagtctgaagagctccaagatgcaaagctttgagtgccgacgtgatgccacaagggaaaattccacacctggcctcatgtgataggtcataggtcaaaaagcagtcaataattttgtttcatgcataaaattatttaaaatattgtataaaattaccttcaggccatgcgtatgaggtatataggaaatggtcccatccccaagatgtctcagtatggatattcaaatattctaaaatctgagaaaaaatccaaaatctgaaacacgtctggtcctgagcatttccaataagggatactcaacctgtattttacctgtcaccctcaggtgacctccttttttgtcctcaagctggccttcccacctaccctccagttaggttggaccttgttaaccgtttgaaataccactttaaccgtgtgttttctctctcaccacttcctccaggaagtccccctggatatgtgtgtccctttgtttttctgtctcccccttgctctcctctgcatggtcggtctccacttctggtcttagctgaaagcttagtcctgactcacctgtgcccatcttcccccagccgggcccagttgcctcgacctccatgtgtggtaggcacaaggcatggattatccccaaacaagggtaaccttcaaccctcagagagtggcccagtggccatcctttcgctcaggacagttctccttggctggcccatcactgatgcctgctgcgtcttcccaggtcagccagtcccagctgagtctgagaaacgcttgtctcccctcggccttggtggtggacactgaagtcctcctgtggggccgggccagggcgtgcccaagcataggacgaagttcccaggagggcatgctctgtgagaagcccagaggctcctgcccctcccccagagtcacccccactctgttttttctgtcctgcagacactaccccaagcagtccttcaccatggtggcggacaccccggaaaaccttcgcctcaagcaacagagtgagctccagagtcaggtgaggggctgggcggtgctggggcctggcagggagggatgctggggagggaagttgtaaggtcggcatttggcaagagtaccttcccctgcggttactctgcaaggccaaggtgctgaaatcctagcattgcctttaatcttgaccccacccctgactttatcaaaggagcagggtagagcgttctcccacttcctacctagagggggttggagaggtgtgggtgtctatttgagcccgctctggggctccctaaagcctacctcctccaggaagccactctcccctccctcttccccattcacactcacccacaaaggaggggtttggggaggaccagggaatttgcccctccaggtcatgccagtctgaggctgggcaaccaaccctctatagccgcgtcccaaacctccacccactgaagggcaaggtgtgaagggggccctgccatgggggcacaggatagggggctgttccgcctctgtctcctttggcttgactttccagaacactgctgagtgggaggtatgtgcccctgtaggaggggaggacgggttccaggcctagggagaacttggtctttaggggacacggaggaataagcaaagggtctggagtcctgagaacagaacagctgacccaccctgcctgggggtgcgagggctcctgggacaaacctggccagtgatgaggtggggtggggtggggcggggcttcagccgatgaaggattaggcgcgagaatacatgtaggggaatttaccacgtgggcagcgcgcccaggacccactcaggatcgggagaagactgcagaggttccacccgggccacagaggggatctctcccagttcctccagaggggactcctgctgcctgatcttgatgtgactgcccgggtccatcagggagaaccgaccctgccttttgtcaggctttccatgcaccctctctcagcatcctcccagcagccctgtgaggaaggtgctatcttccccattgttacagatgaggcgactgaggcccagcgactttgagggactagctgaggtcctgcgggtaggagaggcaataataatattcacagctgacgatggagggctcagtgctcccggcgtgtgagctcgtttaatcctcacccagccctgtgcagctgtagcatcacttcacttcagagaagaggaaatagacactggcagctttgaatgtaggtttgtctaacccagggactatccactccccaagaaacagtctctaccttaataataaacatgatagttccttatgctgttgagaagttttgtagtttagggctgggagccatggctcacgcctgtaatccctgtgctctgggaggccaaggtaagaggatcacttgagcccaggagttcgagaccagctggggcaacatagcaatacctggtccctaaaaaaaaaaacgagcagagatggtggtgtgcacctgtggtcgtagctacttgggagtttgaggcgggaggatcacttgagctgaggagttggaggctgcagtgagccatgatcgcaccactacactccagcctgggtgatggggtgagaccctgtctctaaaaaaaggaaaagcaagaaattgtgtagttcagcaagtgcctttagttagttcccctgtttatccttgactgggttctgggggaaggtaaaagacccagcgtctctgtcttacagataggggaaccgagtgagtgaatgcggatccaggatttgggccctggtcttgtcactcccaagtctggggcccttgatgctgcacagccctggtagggcctgaggctcacagaggaagagagcagcagctcacacctgccacccacccacctgcggcacagaagctgaagttactaggaagcagggaacaccacagcctgcctggccatattttacagattctagccaggccctgactcctgccttcaattccctgccctgtggaagggccatgggggccagaggtggaggggctcagaaggacctcggagaagaggtgctgggagcagatagcaggtctttggagacacacacacacacacacacacacacacacacacacacacacccttctcaggggagaaattcaaacccctcagcctttgtcagttccacaaaagcgtggctgcagctctttttgccccggcaccctatccccgaggggtggggtttgaggaggaagcacctccacgttgttccccctgcccaggatgggcagcaagtgggcagggcatgctgttggcaggggctgcttctgccccccacaggggaagccagcaccacgctctgggtttgggggctcctgtccctggcctgtgccccctgcttcccagggtcatagcctgctgggttcccgggggggcctcttgggagatgaaaatggcggtcactcttcattagggcctcactgagggccagagcgtgtccgtgtgtgtatgtgtgtgtgtgtgcgtgtgcacgcatgcacgcgtgtatgtgtgtgtgtgtgtgtgcaagcatgcacgcatgtatgcgtgtatgcctgactttgtttaatccttacagccacctgatgaaagaggggctcttattatccccatcatacagatagggaaactgaggtttacagaggctgccctgcttgtgcagagcccagggacaggggcagacatcaagtcccatgacctggccctggagcccgttgctctgaacagtgctgatggcacaggcaccgagccctgtgctcccaccctgcaggatgcaccagtcagcagcaagtaggatgggcttgttggaatgcagattcctaggccccacccaagggacttctgcttggcagctctgggtgaggcccaagaatctgcattttgactcccccgtgattctgataaggacttttggccccactttaagaagcttagagatgggtccatgggcaggagtgtaccgaccctgtttgtatgctctgaggggtgccacattagggtagggctttgcactaagggcacggctctgttcccctgaggtgggggtcctcgggggttgggggctgagggcaggataggcaggggaggaaagggtactgccctttttgcaggcctgttctgtctcccttcccaccgcccaccagctgtgtggtctgagactggcctcagactgtctttcctctcatagctttgcttcctcaccagtaaaatgaggacagcaaacccagttgcctcaagctgggggctgggcctgatgctttgaggcttggaagggctgagccggccaggctggagcagtgacgggttctggttcctgtggctgccgtgggggcagagctggagagagctgcctgcggctagcaggaagggaagggggagcctcttctgctcacccagcttcaccccacggggtcagctggcttctctccatgccccttctgggcctgccttgcccttccctgtctctgggaagctgcccaggctatttcagctttatttattttcccatctctatattggtctccaaaatggcactttgggtgtctgggacacctggagcctcccctgtggaggaggtaaccacagaactgtccagaaatgaccctctcggtggtcctgcccaggcctggctgaggcagggggctggcagctggacccccagccccccttctcacttgctgctcctatcccacccccaggctgagcagaggcagtggctttggggtgggactgagctggaggtgtctgtatggccctgagcccaggcagaagtgccaagtgccagtagactgttcttccattttttccttcatcaactcaccttgatggggtcgtgggaaattacaggggggtttctatcctcctcggatcttgtaagcagcacgggtggtagagtatcactcttacccgaactagctggcctgagattgaatctcgcatctgctgccaccagctgtgtgaccttgggcaagttgcttaacctctgtgcacagtgccttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgggaaatacacacagcaaccttttgaccatgacttccagccccggccctttccatcagctctcctctccatctgtgtgtgtctaatttttttttttaatttgtatttttttgagacagggtctctctctgtctcccaggctggaatgcagtggcgtgatcttggctcattgcagccttgacttcccagactcaagcgattttctcgcctccacctcctgaatagctgggactacaggcgtgcatcaccatgcccggctaatttttgtatttttagtagagacagggtttcgtcatgttgcccaggcttgtttcaaactcctgacctcaagtgatctgcccacctcagcctcccaaagtgctgggattacaggtgtcagccaccgcgccctgcctaaattttaaaaactagtgtttcttttttgttagaaggggatgggttacaaagtatgttggcccaacacatggtaggcacataatagtggaaattgtatttcgctcaataaattttgtatttttttagagatttttattaattttttttttttttaaatagagatggggtactatgttcccaggctggtctcgaactcctgggctcgagtgatccacctgtcttggcctcctagactgctgggattacagacatgagccattttgttttttaagtccagcctaatttttgtgttttttttttagacggagttttactctgtcgcccagcctggagtacagtgtcaccatctcagctcactgcaacctccggctcccaggttcaaggaattctcctgcctcagcctcccaagtagctgggattacgcccaccacgcccggctaactttttttgtattttttttagtagagatggggtttcagcatgttaggctggtcatgaactcctgacctcaggtgatccacccacctctgcctcccaaagtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaattagagtttcacggatggtggttgtttgggtgtcaggagcctcagatgtcagtcagtcctgggcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccagggcaagaagggagccctgaagaggggctctgggctgggccctccctacacccctggccccccacccttcacttctgccaccccttccatacccaaagacctttcaaagagcctccctgtcttgattatccatagtcagggtctgaaggtgctttaaaatggtcacagactccaaatgggagggattttagagatcagctagccagctcccttcaggggacccagagaggggaactgacttgcttagaaacacacagcaaggtggtgctgatcccaggctccctcccttctcagcccctacccctcacccctaccctctgtgggcctcctatgttagcagtgaaatgaatgatccttccccaacagggagggggaggcagaagcagttcccgatcctgggaacctgctgatgtcattgcagcgtcgccatggcgattattcccctggattaggggcctgacccttgcaaagccaggaagcaggggacggagtgggggactggcactcgttcagcacttcattgctgacagagcactttcacactggccctccacagtgcgctgctgctttagagccactgtctgtatcgtgggttggagtgactggcgttatggtccccattttacagatgtgggaactgagtcttgagatgtgaagtcgttggcccaagatcactcagaagtgggagactgagcctgcgttagtgctagctccgcctggctttgtgcccagacttggtgataagaagccccctccccatattatacctgatttctgtcacaactcttttacagatgaagaaactgaggccaggggcttgagatgcagggcttctgtatctggagctacatttctctgcctctgagtgccctaccttccccgatgcccgcttcccaaagggcctcccactaagagtcaccgtgctggcccagggcttccaggactgaggaagagctggtgctaggcaggttctggactcttggggtgggttggtgcctctatccactgcattcacttctgaactaatggggaacagcacatccaagcccttcttgtctggatcagaacagagaaggagagggaaccacatggatgagtgactgggggcttcaggagacaaacaaggactctgacccccacaggcatgtgcagaggacctgacaggtgtggccgtggctgcatgcgcatgcgcagtcgctccagtccaagcacagctcggtgctgctgccagatgattccctgccagggaactgcctgggtttgtgtcctgggctgacctgtgtccaggacagtgcagcccccgtggaggaaatccaagcagctggtggggtctggaacagatggctgatgaggtggacagtgaagtctctggaagccaaggaatagtttcctgttccatgagttttctcagcctcattctgttcttcaaaaccctcaggggaggacaagctgttcctcatatttcaattcctttcgtgccagggaagtcctttctgatgtctgacttgagtccctctagtactgtggtggggtggaagggttcttccctggagcttggagacctgctgagatgctgtctgacccccgctgctttcctcccctcctatggcggtggcctctgaagccatcccggcaggctcccagaatccgcggggcctgtcaaaggcgcactgatggagccttccctggggctgtctcaccaccctcctttctgggcaccaactctgtcctttggcacagccctcactcagctggttgctgaaaagctcccccaggcgtagtgggcagggccacatcctggctaacatgagggctggggccaccctgggagccctggaaagaacctttttcctataagcttccagacaggatgggcagggagtgaagggtcaggagtcaggcagatgagggtttgcactctggtagtgccggacattgactgctaagctctgtgaccttgggcaggggactttgcctttctgtggctccgtttcctgatccgtaaattggagctgttaattgcgtggctatatgtatggtgggatctaaatgagatggttcatgtaaggccctggactctgtgcctgccattcactgcgcaccaaagacttggtagtggcttattattacgagtctaacaccttttggctgaggcctctgctttgagttggggacttctgatcagggtctttctgctgactccctgtccctgtctcctgactggttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactgcccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactggggggcggggagcacctggcctcccctggtctgcgcctgggtgctgacattgcagtcatttccgcccttccttggcctcctcccccacatcagcctgctcttccttcctgtgtaaaaaccccagccagcttcacccgccagccctgcaccccctggctcacaccccccgcctccctgatggtcagtggcatctggctgtggcaggggtgggcatggagagtgggcaggggatcaactgtccccagcatcgtgtgccctccatggcacctgtggccagagaacaggcctcagtttcctgcttggcagagccacaggcaagcagcctgtgtggctttaggcatgcgggggcagggcactgcggtgagcagcaaccatgggggatgcgcacacagaactgcaggggctgcccagccagcctggcctaggaggtcctgccagggagggtttaggcaggcagctgtcttcgtgtctggaacaggaagggatcagtgagctgcccattgttgctctgggctgaggaactggggatagagattgccgggggagcctggctttccggtggtctcagcacccactccctgggctccacatcccttcctaccctccacctggccacctcagcagggcgctcctttaagagcttggctgggccgtgcatagagtgggctgcagtggtgggtcaggtggatttcagaagcgcaggcagcccacagacagcagaaccagccatgcccaaaatggtggctttcaaactctgacttcagcctacagtaaaatatacattgtacgtcttgacccatctgacaggcatacatttatgtagagggaaaacagaatggaagctttcatgaatgagtacttcctacttagagggcgttcagatcttttttttttttttttgagacagagtctcactctgttgctcaggctggagtgcagtggtgctccgcctccagggttcaagtgattctcctgccttagcctcccaagtggagtagctgggattacaggtgcacaccaccacccccggccaatttttgtatttttggtagagacagggtttcaccatgttggccaggctggtcttgaacacctgacctcaggtgatgtgcccgccttggcctcccaaagtgctaagattacaggtgtgagccaccgcacccggccacattcagatcttttctaaagatgctggttgcaggcccctatacaccctcacataatacagcccctttgaggactgtattcccaacactttgggagactgaggtgggaggattgcttgagcccaggagtttgagactagcctgggcaacatagcaaaactgtttctacaaaaaaaaaaaaaaaaaaaaaaaaatacaaaaactagccaggcatgatagcacacgcctgtggtcctagctattcaggaggctgaagtgggaggatcacctgagcccagaggtttgaggttatagtgagccgtaattgcaccactgcattccagcctgggaaaccgagtgagaccctgtttccaaaaaaaaaaaggaccaggcgcggtggctcatgcctgtaatcccagcactttgagaggctgaggtgggcggatcatgaggtcaagagatcgagaccatcctggccaacatggtgaaaccccatctctactaaaaatacaaaaattagctgggcgtggtggcgtgtgcctgtaatcccagctacttgggaggctgagacagaagaaccgcttgaactcgggaggcagaggttgcagtgagtcgagatcgggccactgcactccagcctggcgacagagcaagactccatctcaaaaaaaaaccaaaaagatgctggttgcagacttactgtgaatgggttttgcaactggactgttgacctgcagtttgaagttggtggcctgaggaaatggcatgcttccctttggctagcaggggatgcctagggcgggcactctaatcctccttcccctccaacttccagaggcctgtcacagttgactctttatatgctagggcctggcctcacgccctggagcttccctttggctcagaccctgcaaagggtaagacccttaggtctgtgtttcagagctctcggcttggaaagtgggggagggggaagatggtcttagattatggggaaaacccggaatggttcacagaactggaatgtcggctcttcagcctctgcggcttttcatgtagaggctctagtcttttatcagtgacacttgctcccaatgtgcaaccccagctccctggctgttcactcattgcttcaccctgtgggttttggaggaggggagacaagcccagtcatccctgcttccctttctggaaggcttccagaacactccacactcagcctaagccacctcctcttcttccctcccccagttagaggtgttaatatcctagtgacaaaactcaccaccctggccaagccatccgcatctcaggagataaccatcttttacccttctcgcggtgctgcagtgagctaatggtcctctgcaggagctgggggaagggatcgaccccgacctgctagctgcttttgcagctttagcagagacctgtagggtgtgaatgcaaagcctggagactcttggttttaatgaaagcaattacagtctgtcggatatgggcctccagacagctgtagcacagtcacctgtagggttgactgaaaatgcagactcacaggccttctcccctggctgccagaatcagcgtctctgggagtggggcccaggaatcagcatgttagacacattccctgggtttctgtggtgctctctgaagtttgagagccaccacctaaaagtctgaaaaagcttcaccaacccctaagtcagagggtgccagatcaggctgtacctcagaaccccaggggagctttatttttatttttatttttttgagacggagccttggtttatcacccaggctggagtgcagtggcgcaatctcggctcactgcaacctccgcctcccgggttcacgccattctgctgcctcagcctcgtgagtagctgggactacaggcgcccgccaccacgcccggctaatagtttttgtatttttagtagagatggggtttcgccgtgttagccaggatgatcttgatctcctgaccttgtgatccacccgcctcggcctcccaaagtgctgggattacaggcgtgagacaccgagcccagcctatttttatttttgagagagggtttcgctccgtcatccgggctggagtgcggtggtgtgttcacggctcagtgcagcctgaatcttctgggatcaagccattctcccacctcagactccgagtagctgggaccacaggtgtgcaccaccatgcccagctaatttttcttttttttgcagagacactatcttgctatgttgcccaggctggtctcaaactcctggattcaagttatcctcccgcctcagcctcctaaagtgctgggattataggggtgagccacctcacctggcctcccaggggagcttttttttttttttttttttttaatcagagacagggtctcactatgttgtcttaaactcctggactcaagtgatccgcccacctcggcctcccaaagttctgggactactacaggcatgagccactgcgcctgggagctttaaaccacacataaaaccattgctaagttgtcccaacctcctgaagtgttttggaaaatagggtgtttagagccacaccttttgttttgtatccaaaatagcattcctgttcctgtatgtagcttgttgctttgcttcccagattagcaccaaatgactccagttactttatttatttatttttaattttagttttattttatttttgagatagagtctcgctctgtcgcccaggctggagtgcagtggcgtgatcttggctcactgcaacctctgcctcccgggttgaagcgattcttctgcctcagccttctgagtagctaggactataggcacatgccaccacgcctggctaatttttgtatttttagtagacacagggttttgccatattggctcggctggtctcgaactcctgacctcaggtgatccacctgccttggcctcccaaggtgctgggattacaggtgtgagccactgtgcccagctgactccagttatttctaaaggtcaggccatcttacaaaagaatgaggatatgcttccttggagggatatgctgcagactagggctttttaccagccagagcattttaaaaacaagtgtctgatctcctctggggtgtctgctttggataagtgcagtctgtcttcagtcttgctaagtggtgagacagtgaggtaggaagagatggtaagggcccagatcctagcttctgtcattctggggccaggcagggctctttgagcctcagtttcctcatttgtaaaaatgggacagtaggccctactttgacaggtggttgcaaggaacatgccaagtgcttggcatgggataaatgatatcactcttattatcatcattattatttttgagacaagattgcccaggctggagtacagtggcacgatcataggtcactgcagcctcgaactcttgggcacaagtggtcctctcccgtcaacctcctgagtagctggtactacaggcatatagcaccatgcccagctaattgttattttttttgtagagagagggtcttgctatgctgcccaggctggagtgtagtcacgtgatcacagctcactgcagccttgaactcctgggtttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggccattgtctagtactgagaatgtgtggaagtgaggaaaggggccagtatattacacatctatggtgagtagttgtgtcatcattaaaggcatctgaagagttgccttttgatgggtccatgctatgggataaaggttacatgttaggaatcctggccttttgtcatgagctctagcagtgttcaagtatggaaaactttagtcactttactggagcctcttcttttatttacttacatattgattttctgtatacaattttgtgtccttaaaactttttttatgtgtgaaatatgacacatagtaacatatacaataaacacctgtttcaccaggcaggtataccatacattgtattactgtatgcctgtcaagagcccagtgttcacagtgttaaaaatataactcccatgtagtaagtacttatcatatctttatttaattatgagggaaccagctagagattaaaactggggaatatgagaggcagaggtaaatgctagtctgtgaaagaaagtgctggggccgggcgaggtggctcatatctgtaaccccagcactttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttatattctgtaatgagcttcagtctttagagtctgggcctaatcaatagtaaatagtcaaacaaagttttgtccccagagtaaaatactctgaaggcaggtttgttggacaatcctctagtttgattttgaaagcatgtatttttcattataattttagtatgtaattatgtattcttaaacactatagttttgcttttcctgattttgaacacagagtaattttgtgtatcttgcttctcttacacaccattgggtttaaagattcatccatatgtttgtgtgtagcggtagtacatcctttttcattgctatatagtattccattgtttgtttataccacattttattgattctgttgctggtggacatttgtactgtttccagttgctatggacatttttgtacatatctcctgaggtctatgtacattggaactgctgcatcttagaatgtgtgctccttgggccgggccgtggtggttcacacctgtaatcccagcactttgggagaccgaagtgggtggatcatgaggtcaagagatcaagaccatcctggctaacacagtgaaaccccgtctcaactaaaaatacaaaaaattagccgggcgtggtggcgcactcggtggcgcaatcccagctgctctggaggctgaggcaggagaatcactgaacctgggaggcagaggatgcagtgagttgagatcgcaccactgcattccagcctgggcgacagagtgagactccatctcaaaaaaaaaaaaaaaaaaagtgtgctccttcaactttacgagataatgcggaactattttccaagtggctgcactgatttaccctcccaccagcagagatgagtttcatttgctccatgtgctcagatatgttcactttagcattttgatcgtgtagagtgtgatagccgatggttttagattgcatttctgtgattactaatgaagttgagtacagacttttgtttgttttaaaaataaaatactggggcatggtgggctcacgcctgtatcctaacagtttgggaggctgtggtgggaggattgcttgaggccaggagtttaagacttgcctgggcaacatagcaagataccatctctacaaaaaaaagaaagaaaattagccgtgcatggtggcatccacctgtagtcccagctactcgagcggctgaggtggtaagattgcttgagcccaggagtttgaggctgcagtgagccatgatcacgccaccgcactccagccttggtgacagagcgagaccctgtctctaaaaaataaataaataaaatattgtgagtctctaatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaagaaaaggaaatgagtaatgcatgtaagggcacccaaaaaaagaccctagctggtgagctgatgattccacccagagcctgctgttccctcgttcactgtgatgtataatcatgtgaggagcaccgtatggagagtcagacttttattttccaccacagttgggagagcaggggggtcagaaaacagaacatcagctagcagagctttgtcatggaccctaacttgtcatcctggagtcccagctagtagggtcctggctgagtcgggagggtccttaggcctggacccctgaacccacatgtacttggacctcatgggcacaggtagagtgtggcctgtgtccacagaggcccaggacagcttccaggctgggggctgtgctgacatgtctgggcttagggcgctcctcactcagggctctctgaaggccagaactttgcagagcttggagcagggatgagccaggcccttggaagctgggaaatgtttccttgccttctgaatgtgctaacatccccctcatgtgcctatttgcttaacaaaccagtaggtgggtcaggaaagtaataacacaatttcctcatttgctggcgaggggaaggagaggaagctgagggtttggaaattttatccaagtgggcccaggctggaaggcgctgagcctcactttttctcagcccatttagccgctctgtgccgcctgtcctgagttgcatgcctggtgtccctctctctcgagttagggtgactttctgattatcattcttgttgagagtgaaaaggggtgcattgaaatttatccctgagcagcagacatgaactgggacttgggcgtgtggtcaccctgctccacacctgttctcaggaaagggcctgtctagctgtgattttgtccttgtgtcaccagccttggctgttactgagcaatgaaagctctgcctcgggaagtcatttaatttctgagcctcatgttcctcttctggaagatgggaatgaaagtgtgcgtgtccggcccattttttagggcaatgattgtcagggtatgaagagcttggtcaagctgtgtgaagagctgtacagctgcagaggttgttaacattgatagagccacccaggaagggtgtcctgggttcaggcagctactcctccagccgtcgggtcagccagccgtaactttagatacacttatccatgtgtaatgactttttaagaagcaagatcagtttccccagccctttatgggaatacccatgtgtccatacttgctttcagcttagagtttgctcaggttcctagagctggtcagggtttgcaggaccgcctgggagcagatggtaccatggccttatttacagatgaggaaactgagacccagaggggaaagtgactcccaaggtcatgtaggtaagcatacggctcccctaaggatgaggcattggtctggtgacagtgcagcccatcataagggactgagcctgtggggtccagacctgctctcctcccagaggaaaaggctccctgtcaccccatcactaatgcagatagcgtcatgtccagggaagctgtcacacattcatctgggcccccaacatcaaggacacctgtccctgcaggccccctgctggcaccttcggggcccagggcaggcccctgtccattccgtgtctgcacttccctccctggtcacaggttctcaggggcaggctcttttccttagcagaaaggaaacaagggaagctgacctttcccacctcagaacaaaagttggaagggcaggtgcctcgtgagcctggaggcctcaggaggggtgtccccttcccttgtgccctccccgccaccaacaccagtggacaggggtcactaagagagtggggctcgggagactcaccttctgcgctgggtctgtgagaacatcacctggagtgcccctcccagcggatgctggggtcggttggattttcagcctggccagggttggctgcctcacctcaggaacaggcttagcctgtgctgccacgtgggtgccggtccttgctctggcctgaagggagggggccgggaaaggagggactgatcctgacccaaacccctaagtaaactgccctctgcgtccagactggactcctcccagactctgtccaggcccttaccactgccctccctgtgcccccagcccgggctgcaggaactactggctgttcagccagcaggagcagcaaccatgcaggtgtttccagctgttaacgtgtaagccctgcctggccacgtgcttgctcttgccttttgtgcacagccagtgccaagggggagaggaggcagcagagacgttgtgcggaggggatgcccaaaggggactgcccaggctgggacagccctgatggggcaggggcgttccaggaaacagcaggttttgcctctcctcctcttcccaccccactactcccaccccattttcccggatcaggaaaaggcaggccagcattctagggaacaggaagtgaagttggcttccagctaggtgcctgccagggcctggaggaaattcctgcaggcctgagcccgtctgggaaggaccagtttctctccttgtcctggtgtcctgctttctgagtttcccctgagggtgggggagagctgtcactctcttcactctatgtcccgcttcctcccccatcctcatggagcactcaaaccctgagccctcacacctttctatggttgtacccgtccccaccagtttcctctctggaaagtgaagaggaggctgggcacggtggctcacggctgtaatcccagcactttgggaggccgaggtgggcagatcacaaggtcaagaagttcaagaccagcctggccaacacggtaaaagcccgtctctactaaaaatacaaaaattagccgggcgtggtggcagttgcctgtaatcccagctactcaggaggctgaggcaggagcatcacttgaacccgggaggcagagggtgcagtaagccgagactgtgtcactgcactccagcctgggcgacagagcgagactccatctcaaaaaaaaaaaagaaagaaaagtgaagaggatagagcccactaggggtcatcaaggtgtgggacaggcagcatgttcctacaggaagaaaactctaactcctggttctggttctttttcatctcattcattcattcattcattcattcattcatttgttttgagatggactcactctgtctcccaggctggagtacagtggctcgatctcagctcactgcaatctccgtctcctgggttcaagtgattctcatgactcggcttcccaagtagctgggattacaggtgcccaccaccatgcctgattaagttttgtattttcagtagagacagggtttcactgtgttggccaggctagtcttgaactcctgacttcaagcaatctgccaacctcgacctcccaaagtgctgggattaaaggtgtgagccaccgcacctggccatctcatactttcacaattcattctttggtgcaagttttacaatatacattctatatttgtcaagtgataacttccatgtaacttataaaatacacataattcaggaagattgtgctaaaatacatttaaccaataggagtatgccgtcagaatattttggcaaacaagggtcactaagttttttctgtaaagggccaggtaggaggtatctcaggctttgtggccatatggcctctgtggcagcagctcagttctgcagttctgccatgaaagcagccacagataagaggtaattgagtgggtgtggctgtgttccaataaaactttatttctggaggctgaaatttgaatttcagagaaatttcatgtgtcatgaaatattattcctcttttggttcttcttccccccctccaccgccccctgccaagcattaaagaatgtggaacccgttcttagcagccggctgtgggctggatttggtccatggaccatagattcccagcttctgctctagaccacccgttctcagacttgaagcctgcttcagacttacctggagagcttttttccaaaatgcatattccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgggatcacaggtgcctgccatcatgcccagctaatttttgtattttcagtagagacagggtttcaccatgttggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagcccagtcccaggtgctatggaagccctgggttcagcctggagccagggccagcgtcccgaggatgaggtgccgagatggaccttgaaggatgagagaagcctggactgcccttgagtggcgagggtgggctgcctccaggttgaccttaatcccttccctccctaccaccatgtgtccagatgaccttgggcaggtcccttagcctctctggatatcgggatatgacattgacttacctcagagacttgtggggaggattcggcgagctgatatgcatgaagtgtatcaactagggctgctggctggtatctccttcccttgtcttcccccaccaccccagccaggggacagggtgctgctgagggagtgggctgggagagtcacttctggccttgtcttagggatctgagaacagggcatgggccccgtgtctgggagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctcccaggttcaagctatccttttgcctcagcctcccgcgtagctgggattataggcgcccgtcaccacacccagctaatttttgtagttttagtagagacagggtttcaccaagttggccaggctggtctcgaactcctgacctcaagtgacccacccaccttggcctcccaaagttctgggattacaggcgtgatccaccgtgctcggcctcaccacccacctttcttgtggtgtagttcttgctgcctcaagaactacatatatcaggcctcaaaacccacctgatatatgcgtgcctgggaatagggaccttgacttttcccctgtcccatatgggcccaggggccggttctgggctggcccaggtggggctagagcagctggatccaggcacatgagatgtgaaagtgtgggccttacgccgcatggagcggctggaggaaggagagagggagcaagggtgccgcagggtcagattgccacagggccagggtgccacagggtcagggtagggccagggtgccatagggtcagagtagggccagggtgccacagggtcagggtagggccagggtgccgctgggccagggtgccgcaggatctggttgccacagggtcagggtgccgcaagcacaaggagtcacccgtgattctccagggtctggctcttgggctgagatccaggagaccttggcaggcctgtctttgggagtctggcacagccccagaaggccatctggacagttttcagacctgagaggaggaaagggcttgtgtctggagaaggtgccatggggtatgggaggtggaggaagcctggggccaatcaggatctggatctagcagggaacaccgaggccggtgttctcgtcccaccatgggactcagcctgaagaagacaaggtgaatgaacgaccatttctctctaactcagttggctaagaggactgagctggcgccgaggctctggacacaaatgggccagttgaccctgaggtttctttctggtagtggaggtggggcttcctctggctgaccctgcttaggtctctgatggaggtagcaggggctctggttcccccaaactggccaagtcctccaccatagcacccaaggggtctgggcagagtgcagcttccctcccctccccagcttggcttggtgggcacctgcctcccctgccctcctgaccttgatggctaatgcagccagccccaggcaggcacagtcacagccctcaaacaacatgaggcccaactcaagactcctgggtggtggtggtcaaggtgggggactctgtagccagtagagcactgtgggggcaagagactgacttgaaggcttggagcctcacatgcccgcctagtggggtggtcctgagggatatgacttctttgggcctctctgctcatttttggaacctgacccgagaaggagcccatccaagacaatgtcccgccctcagggagggtctggcagtttttatccctaaaggctgggattctcagcggagcatcctaggctgtagtacccacgacatcttgcacacaagaggtggaatcgcctgttgatgaagagcaaggctctggaatctgtgatcttgggccactcacttcacttatcaatcccttcgcttccttcttgcctgttacatggggtctgcaatctacccctcaggggcgctgacgagctcacatgagcctgtgacataaaacacctagcacggccctggcgcagtaagagctcaggaaacgggctgctgctgtggttactgtggacccaggcggaaacagagcagccccgcccctgccgcaggcatataaaagtgaccacttggccggtcacggtggctcacgcctgtaatcccagcactttgggaggccgaggcgggtggatcacctgaggtcaggagtttgagaccagcctggtcaacatgatgaaaccctgtctctactaaaaatacaaaaaattagctgggcgtagtggcaggcgcctgtaatcccagccgcccaggaggctgaggcaggagaatcacttgaaccctggaggtggaggttgcggtgagctgagatcgtaccattgcactccagcctgggcgacagagccaaactccgtctcgaaaaaaaaaaaaaaagaaaagggaccactcactttggtctgattcttcagttctcatggtccttttacatcggtcatttcattgcattctccaacagtgtctgagggagactggtgtctcattttgcagaggtgaaaactgaggcttggcaagattaggtagcttgtccaaggacacacagctggtgcttccagagcgagacctggctttctgtacccaaagctcttgggtagtctctcccatcctgggatcttgagggtcacgggaaggaactgggtggtttgcagtgggacccttcacctagtgccttctgaccttgcagataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgtggaaaggactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagctaggttgggggcggggtggaagtgcatggtatggacttctcgggagctctgggaggggctgggtttggcaggacagtttccaagccctgtctcctcccatcttccagtttaccagcagccccagcagcagccggtggcccagtcctatggtggctacaaggagcctgcagccccagtctccatacagcgcagcgccccaggtggtggcggggtgagtaaccctggccggaggggagaggccagaggcagggggtccttcgggaaggcttggacacagctcatggattctcctgacctttgcacccaccctctgttgtgtgtgatgataaggatctcagccttgtgagcagagaggaaattggttggcgtagtgggcagaggctggctgggactggggccctgcgttccagccctggtgtaccatgggcaggttgctcaccctgctttgggtggggtttccttaccccagctacctgggaacacacaaggcaactttctgcatggggccttccagcactgggcgctgctctcctcgcttcatgaggatggcccccacatccttcagctctcaggctgcccctgcctctgaggggcctccccagccatgtcgtgtaaagcgcatcaccctgatgctttgcatcactcgactccgctggctgccttcagagcactttttccaactaaaaagagctcttcgtgttggtcaccttctctgtgtcccctgctgggctggggaccctggcagcgtccgtctggttcacctactctgagccaggcctagagcaagtgaataagcccagcaggaacggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataaggttccaggcagcccagccagtccctccctcctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctgggcagcaagagcaaaactccagctagaaaaaaaaaaagaaaaaaaagacgtgacatttgagcaaagtcctcaataaaggaaggagtgagccgtgcaacgaggacaggaagtgcaaaggctctgaggcaggaatattctaggaaagttcagggagcagcaggaagcccgaattgactagagtgggagagggtgggaggtccgattatgcagggacttgtgggccccaggaaggcctctgtgacctgtgatctgtgcagagcgacataggtttttggaagaccaccctggcagctgtgttgagaagaggcagtggtttgagggtagaagcagggagaccgtcaggaggctgttgcaggatataggcatggatgggagtggctcagcccaagatagaggcagaattggtgatgagagagactgaggttacttcatgggaggtgtaacttcttatcccatagacctgttggtttcaaactgtcctgtggagcctcagagaccagtcaagggcagtgaaggtcaggggaggtagaatgttgtctatagctataggatttatttttcttttttttttcctctttctttttttaaactccatcctggtagtaggtggcgctgtaggtttttgtgtgccttactgaacattacctagatctagggcttaagcggcagattttggctgaggcttggaaggtggaacctgatagactcgtcttctgtcctctgaagatttttctcccaaggaaagatctttgtcctgaacttggacaggactcatcatggcttctaaaagaaactactggtgcttataatcatacaaataatagcatacagggcatgttttttctgttttttttttcttttttgagacagggtcttgctctgctgcccaggctggagtgcagcagtggtgcaatcacagctagctcactgcagccttaacctcctgggttgaagccatcctcccacctcagcctcctgagtagctgagactacaggcatgtaccactaagcctaactaattttttattttttgttgagatgggctcacgctagtactttgggaggccgaggcgagcggatcacttgagaccaggagtttgagaccatcgtagccaacatgatgaaaccctgtctctacaaaaaagtacaaaaattagccgggcatggtggtacacgcctatagtcccagctacttgggaggctgaggcaggagaatcgcttgaacccgggaggcggatgttgcagtgagccaagatcacaccattgcactccagcttgggtgacaaagcaagactccatctcaaaaaaaaaaaaaaaaagagggagttggggggtcttactgtgtttcccaggctgatttcaaacttctgggctcaagcagttctcctgccttggcctcccacagtgctgggattacaggcgtgagccactgcacctggcctgcatgtcgtatttttagacattactctgtcatcatggctggtggaccttactgcagtcctgttcagggaggtggggcagagctgatgtgacccggtccctgctctgcctctggcccttagtagctgccaaaggttgtaaaagatcgattgctctcagaaagcaagacacagaggttaagaatctttgcagcagagcctggtgctccatttctgagttcactgctcccccaggctctgctccagggtcgtggagagttagaaaaaaatgctcagacccaggtgagccggcatgcagggccctaggctgaccacacttcccccacagaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggagggcgaggcccgtggggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagagaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtagaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcggacttggtttcctctctggctctgagctgctgttgtgtgtgtctgtgtgtgggtgtgtgtctctagctgtaaggtgctgctgtgtgtgtgtgtgtctagctgtaaggtgccactgtgtgtgtgtgtgtgtgtgtgtcctgtctgcttgggggcactggcctgtggccctcctgggacctctgctgcccctcggggagagaatgacttgtctggatgccaagggggagtttgctgctgtctgtcaggcccttggcccctacttcctccttgctgagaactccccaccaacctacttctggctttccacccgctcattcctctctgcccaacttggtgatgctcccggaagcttccctgagctccgtctcgtattactgtgtcacttcctcagtgacatatctgtctccccactagccagagcccttggggcaggtgatgagtctaattcatctctaaatcccgggtacctgcccaggagcggtgcggagctgttgaattaatgaatgagcttggctggggagcagttctagcactctgccgctgccaggcagagagcaggagctccacgcatttgaggaacgagatgacagggcattccacagtgggacgggacctggataaagctgtctgtaaggtggcctggcaacccaaagcactattcacagtgccttctgaatgtaatctttaatacacatcccctttcttccttcttcctcacaaccctgtgagagaagtaactacttatagaggggctcactgaaacccagaaaggcaaagcagattggtggcagtcacagctagtggcagagtggggcctgagacccccatgtgatgctcacagtctggtgctgtgccacctggccatggcaggccgcgtgcctgtgtctgtggcagctcttagatgtgtgtctcctgggctccatgttttgctccaggtgcccagggtctgtgactggccagaaggccaggcggcctcccctcttgctcattgggcttgggaagaggacagtggtagagaggggaatctggccctgctcagtgctgccaatcagcctcaggtccagctgcttgaggggcatttctctcttggggctcagaactaaggaattctccagcctcagaatcacagcagggtggagaggaggagggctctcctgagctgagcatttgtaatctggagaatgacatggccagagtcagctgagctggggcaatgtggggagcatccaaggcggccctgggtggtataattagagacagcactgacacctgctcccctccaggggtgcaggcagcccaatactttcccaatagaagggaattagttggcaaagcttgcctcatgtcggcctgccccactccccgggaggcttcattcaccttcagatctatttgatggaacagtgctttgggggacattgctgccaagtctccactccctgctcacagaaagctctgcctcctggaaatgggccaatgggaggagtttctggatttccttctggcagtggcctaagttcctgaggtcttgcattatgagggggttaccaatatatcttaaccccaggcctttaaaaaaaatattatttggggtgggggccaaggagactaggcctcagagacgtcctagggaatgatttaatttaatagaaaataattgaggcttataaaaaggcacaaaaatcctggctaacacagtgaaaccccgtctatactaaaaatacaaaaaataagctgggcgcggtggcgggtgcctgtagtcccagctactcgggaggctgaggcaggagaatggcgtgaacccgggaggcagagcttgcactgagctgagatcgtgccactgcactccagcctgggtgacagagcaagactccgtctaagaataaataaataaataaataaataaataaataaataaataaaaagaataaaataattctcttttccccctcagaagaaaccacttgaattttttaaatttcagggatacccctg

SEQ ID NO: 15707 - DNA, 24523 bp, Human
aaaaaaaaaaaaattgggttgggctcgatggctcatgcctgtaatcccagcactttgggaggccaaggcaggcggatcacttgaggtcaggagttcgagaccagcctggccaacatggtgaaaccctgtctccactaaaaatacaaaaattagccgggcgtagcggcgcgtgcttgtaattccagctactggggaggctgaggcaggagaatcgcttgaacccaggaggcggaggttgcagtgagccgagattgcgccactgcactccagcctgggcaacagagtgagactccgtctcaaaaaaaaaaaaaaaagcagtccttttcttctgatctggaacacccaatgtaaaaatccaagaagaacattctggggtttaagaagtctacatctgaattgaggctccaactcatgattggttcctgctgatcaccctatccgtttcatctcaactttcctggctgagaaagtagaagagagagaaagggaagcaacatttatgctacttcctcacaacaacacgattagcgttgccctcattttacagctaaggtaacagattcagaacacagatatttctgattgcaaagcccatacttttgcggttatgccagcctttcttgtctccaaggggcaggtggaaaccctgctcagggttggaactctcctggaacgtttctaatgggcttcatcttcactcactgctccgccttccccaaggtgttgtgatcagaggaatgacagactgaccattcacttgctattagagttgggtgaggaggaggagtcccatagtctcctgtcctgcggaacacagcaaggtggtggccttattttaaggtcacttgacctggagagggtcttctccatctctcctttctgtggagcaggagaaggggtggagtaggaagggaatgggtcctcctgtcatgagtgaccccttcattgaaacttacagcttctccaaacaccccagcaattcatttaattctccctcatcctcccaataataccaggtgacacagactccacagtaccagcaaccccattttataggagaggaggaaactgatgctcagagaggtgatttgtccggggctatacaaccagaaacagcctgagccaaattggcgccagagtctattgcccagaatctcctattcctcttctctccaccagtcatggtgggtggcatccagatcttggatgtttctccctaaatcaggggtaaaggtggcgcaattctaggtcaaaggtcatgagatctgattttaccagcttctcctctctcagctccatatttcttcctcttttctcatccaagagcagggacctcacccagccccattcctggccttttggaagaacaggggttgggggggcggtgtatcctagtgactgattagggcagaactcctggacccctgggatttattttgctgtctctattggacaccctccccatctcagcctcagcctcccaccggcagccccagagccatgttggagggagaggcttttctgtttggtttgaggcagcctgggccccacactggggagaaaggagttaaagccaggtcccaggatcaccgggaccgggaagttccggtggtccaaacaggagtgggttggggggacccgcaggaagagaggtttgggacaaaaggggggtggtgccagccatgccaatccccatcagcgctcggcatccactggtagaccgcccccccacccctcccccaagttccacgcctagtttctgccttcccgccccagcgggccgcctgcaccccacggccagtcagaggcccacctgcggccacctagagccgagaggggcttgcctccctgctgccgcacgcccattgtgtgcgccgagccggcggaggggctgcgaggggcggggccgggcgggcggagggagggagcgagggaggggcgcggggagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcaggtgaggcgtggtggcccggcccaacgggagggggtcgctcccgcggaccgtgttaaggtcggctcgagaggcgcgggagaggaaggggttatatgccgggcgcggaggagagagggatgcctgcgcgccccccatccttgcaggttgtgattgatgggcgctgggcctggggctgggtggcgatgctgcggagcggggagggggcgggtgggctgcctgtcaccctcgcctccttatctcccccgcgtcaaggttcctgccgcttgggcaccagcttcagtgggctgagcgtgggggtgctggtggagggggatctgggccttgagaaggggaggttgaaagaggctagaaagcgagccaggcaaggggggcgacgcagagcacgctcgggggcgccaggcgggtgtgggtggggcgggggtggcacgaggaggtggccgaggcgatggtcagagggcggtgccaaatgccaacaggccttcaaagccgcagacactggttctcgagggtggggaaagagccaaccccggtcgaggtcccctcccagccacctgggctccatctctatgtcggacctgctcccctccccccacacccacgttgacttaccccacccccacccccgccccaaaaacgcctccaaagtttggaaagttggatggatgccaactcataggagggggggaagctgttttacctgggggaggggtctacttctccatccccacccgcacacttttcctacacccctggttactcccaggaagtggcattcttgggcgcggtgggttctcatggggtgaccagcaggctctgggatggtcgcgccaggggatttctttgggagtgtccttctccaaggatagcattaactcttctgttactgtggccaccagctgtaaccaccatgataatgtgactgatgggtatgtagaggggtcaagtcagacctaaaaataccttcctccaccccaggcccctttgagcctgggaggcagctgactggggccttcctttcagctgtcccctgtccctctgagtgccactccctttgcccagcctggcagtggtgggggagggtggtgtctgggattcactgggtgatcctcctaggtttgtagggagcatcacaacttgagttggggtatatgtctggtttgagagaagggcggggaggggaggatcttggaaaggtccccaggggccctcctctcccattttccatcctctttcttgtaccctgatcccagcagccaaagcccccagtctggtcatggcccctccaggttctttggccaaagaaagtctaggatggagaccaagggcggggacttggaagtctgagccctcactcactctccccattctgaactgggctgaggccaagtgtgtgtgggtacaagctggggagggccagaagcagctcttcttacaagaggactggaaatacctgacgcccttaacctgaacgtgtggcttcctgaatggtcaggcggtatttcctccacccggtctctgagactgagccagcttaccccctagagatctgtggggctgtgtcctaggctcatgtggtgcggggccgagggacatttagattgacgtagcctgatgggtaccatgggcatggggcatgggcagtggcagctgggggccacagggtagaagcttgatccctcttgcccccttggggaggattgtagctactgtgattgtgagagagggagctgagaaaaagtcctgtctgggcaagggatgagagtggggagcaaaatttgcccccatggtgccagggatcaggctggatgtttactctccaaatacagttccatgcccctactccctccccagaaatctggctctgagtctccaagagagctgtcatcccctccctactctgtgaatagcgaagggaagagttgggcacaggggagaagccaggctgggccctgggttggcagttcctcctctctgggggccaccaacacaaacagccctgctctgctcctgcggagggggagtgggggtgactttcccgctctccccacccaacacccagcactgccggctgcctctcccttcctcggaggcctctgcagcctgcccagcatcttaattagctctgctgcctaatgagcctccagcttctccgcgcctccccccttcccagcctctctggcttggtttggtggtttccgtgtgggtcttctggggctctcttgcactggtccccactcctggctgtgctctgggccctctccgtgaggatgggagaccctccctccccttgggtcgtaccacctcaggaggaatgtgcaggggggtggaggtggggctgggagtgctgttcccaagcttggctgtagctctggggctggcaagatgagggttgggaaagggcccttctgattctactcttgttcctttcctggcctcttcagggcaaatacagcaagaggaaagggcgattcaaacggtcagatgggagcacgtcctcggataccacatccaacagctttgtccgccaggtaatggggaggctgggcggagaggagggaggtggctggttggtggagaccagcattggtgagccaggtctgcggtattgtccaggcacccttccctgtgccatttgtcacctgcctggagccaccccatcaccctgacaccccatgacctcttctggatgtgctgtcagcggcacccactcgctcagcccccgcccctgcccggcccctcccccagcaccaggcaccctcccctgctgcctgctggcctgcgtcatctcattcagggacagcctggcctgcctccctccagcttgcttcgggctgtcacccactccccctgccggctgtctgcttccatgtcctcccccagaatctgtgacagggttgggtggaggcaggtcctaggaaaagcagagcaaggatgtttgggtccctgtagtcctggtgaggtcctggccagggaaacacgctcctcacctcgagacatgactgtctaagaagcacagagaaagggtgatggtgacgggggtgggggtggttgaggcatgaggctgttgattttataatagagaagatgatagcccagcacccctgcctgaaagggtgtaactgagaatagctttctggggtcttctgtgctcagtcagtaagcggctgctctcatctgtcaaccctgggccatcttaggctcagggtgagggactgagagaggcatgtggttgctatgactacttagcatctcaccaaagcctggtacccaaaaaaggcgagaggggcttgggattagacaaggaaaaggcgtgtattgaagaggaaatgggcagggcatttgagggcagaagacagcacagaggaggggtcctctggagatgagcccctcccttccaccttgggccaggagcgagggtgatgccaggcagatccaccactaattagagtgaggcccttctttccgtttcttctgtctctacagcacttggcacatgtgagcctcagtctgacttgggaggttcaggaaggggaggcttcattctagccttttctaagtataggaacagacaggaagtcctttcttcaatcaccccctcatccctcctgttgcaggacatggccagggctgggaagaatgacgctgtgcttttattgcccctcttggcagaaaaggaccttggctccttcagtgtttgccaacccagggagtcagaccccagcctccaattcttcctccttttagctccccagctctgatccccggtaggtggtggggagtggtggaggggggcagtccttgccacatctctgagctaaatataccctagcagtctgcacatgtagcaactctgcttgtaacccgagcccccaagggaacgggcagtttgggccaccccctaggccagcagggccaggcactgagggtgccgggatggaggcgcccagccggaccctggtggtggtgagctggggatggagtggggtggcagcgggtagaacagcctctcaggaaagctgacggagggcagcctttactccagcgtgtctccatgcctcctcactgtttcctgtcttctgccatttctgatgtgtgcgtgtgtatgcgcgtacatgtgtctgcatatgtgtgtgtatgtgtgcgcatgcctacatgtgtgtctgtgtgcacctgtgtgtctgcatatgtgtgtgtgtctgcccgcacatgtgcgtctgcatgtgtgtctgtgtgtgtgcatgtaactgtgtgtgtatgtgtacacgtgcgcgtgcctgcatgtgtgttggggtcagtgagtgtgtgcgcgcgtatgcctgcatttgtgttggggttggtgagtgtgtgtgtgcacgcgcatgcccgcgtgtgtgttggggtcggtgagtgcctctctgctagtctgtctccctgtctgtttccctggctctttgactctgcgtgctcccatcaggggggagagggggagctacgctggttttctctccttctctccttcatgcctctttccccacttctgttagtgacccccgctccaccccaacccttcctccgcgggtctcccattttcattatttgtctgggaaagagatgggcagctgcaccagctaatgacctgaggcccctggggagaggtgggactttgtttctgtctttcccaggtcccctccatgccaaacttatggaccttcctggccaagtgacccttttctgccctcaggaaagaacccctacatccctgcagtcctcctcttttgccacataacctcctatgccttgtccaacaccacccctgcatagtcacacaaatccacacctcttgcctcctgccctcacatgtcccccaacctcagggtcacagatgtctgggagctcccccccagtacactcacatgtggctgtacacacacagtcatatgcagccaactatagagcacaccctcctccacacacttgtacttgcacatccacacacacacatgaagaagcacgtgcattcccactaccaggtctgtacgggcaacatgtgtcttacacatatgtgtgcatccctaaaggagtcccttgtgctctgggttggtcattgtggtcaaagccagctgtctggcacccagcagccctcatttcagggaaagccctgtcccatatcctgctcttaacttgcctcttcggtctgtaccagcctggaactcttgggttctcttgtgtcctaggagagcctgaggactggggctgtaagtagtgaagtttgattctggcagtaccagttaagaggagcaggggaggtaggagtctgtctccctctacccttgaacagaagctggcaaaatctgtggtggccccatcctgcggagcaggccgtccacggctgatagtgcagagagctcaggccgaagctggtggctgcagtccctggaatggatgccactggacctcagctgagtctatctcagcgggtgctgggggcaggggagggaaggagcagtgggagtagagactcgtccctggcattcctcccttgccttgtgcccctatcaggttcccacccctccctgggccccaagcagctgtccttgggcctgccttcatctcctgcttgctgctgtcaccctcactagggccacactttccccaggggcctgagaaatctcagctcctggtcccttccacctaataccaccttgtcttagcccttgtggtgtcatgctgggctggctggggctcgaggcatccatgatgggtggcacctccatgccttcccaggcccaggagctgggaggggcagcaatggccctgatctggctctctctattttcagggctcagcggagtcctacaccagccgtccatcagactctgatgtatctctggaggaggaccgggaagccttaaggaaggaagcagagcgccaggcattagcgcagctcgagaaggccaaggtgagaaagatgtggggaggggctgtgctggcatgatttcccccagtcctgggctgtagagagagcccagacagaaccagggccaagtcttgacccagccacttcctagtacccctgaaccttgctcctctgtccttcacctgcacaatgtgggctataatacctgcctgcttatacagtataataagtataataagtataataagtgcgtgttattatactgtttccacacataataagggcttgataagtgctaaaaatttcttttttttgttttttgagttgcagtcttgctctgtcacccaggctggagtgcagtggcatgatctcggctcactgcaagctccgcctcccgggttcacgccattctcctgcctcagcctcccaagtagccgggactataggctctggctgccacgcccggctaattttttgtatttttagtagagacggggtttcaccatgttagccaggatggtctcgatctcctgaccttgtgatccgcccccctcagcctcccaaagtgctgggattacaggcatgagccaccgtgcctgacctggtcctgactcttaatagctgtgtgatcttaggaaagtcacattaaaaggaagataataataccacttaacttcagaggattttttatttttgtgatgaatataaatgagagaatatgtgttaagtgtgtaacatggtacctggaacactaaatggtcattactgtcattattgttttttttaatttaattttaggccaggtgctgtggctcacgcctgtaatcccagcactttgggaggcccggttgggcggatcacttgaggtcaggagttcgagaccagcttgggcaatgtggtgaaaccccgtctctactaaaaatacaaaacgtagctgggtgtggtggtgtacgcctgtaatcccaattactcgggaggctgaggcaccagaatcgcttgaactaaggaggcggaggctggagtgagctgagatcgcaccactgcactccggcctgggtgacagagcgagactctgtctcaaaaaacataataataaataaatttaaatatttattattttttatgagacagggtctctctctgtcactcaggctgagtgtagcggcgtgatcacagctcactggagccttgacctcccatctcagcctcccgagtacctggaactatagaggcataccaccacacctggctgattttttattttttgtagagatgggatcttgctatgttgcccaggctggtcttgaactcctgggtgcaagtgatcctcctgcctcggcctcccaaagtgctaggattacaggcatgggccactgtgcccagccccttttatttatttatttatttttgagatggagtcttgcactgccgcccaggctggggtacagtggtgcgatctcggctcactgcagcctccgccttccaggttcaagcgattctccttgcctcagcctcccaagtagctgggattataggcgcccgccaccatgcctggctaatttttttttgtatttttagtagagatggggtttcaccatgttggccaggctggtctcagaactcctgacctggtgatctgcctgcctcggcctcccaaagtgctaggattacaggcgtaagccactgtgcccagctgccccttttattttttaaaaaccgacagggctggctgggtgcggtggctcacgcctgtaatcccggcactttgggaggctgaggtgggtggatcacctgaggtcgggcatttgagaccagcctgaccaacatggtgaaaccccatctctactaaaaatacaaaactagccaggtgtgatggcgcatgcctgtaatcccagctacttgggaggctgaggcaggagaattgcttgaaccaaggaggcagaggttgcagtgagccaagattgcgccattgcactccaccatgggcaacaagagcgaaactccatctcaaaacaaaacaaaacaaaacagacaggatctccctatattgctcaggctggtctcagactccttccctcaagccagtattgggattacaggtgtgagccactgtgcctggctgctattattattattattattattttattttattttattttattttgagacggagtcttgctccatcacccaagctggagtgcaatggcacgatcttggcttgctgcaacctctgcctcctagattcaagtgattctcctgcctcagcctcctgagtagctgggattacaggtgcgtgccaccacgcccagctaatttttgtatttttagtagagacggggtttcaccatgttagccaggctggtctcgaactcctgacttcatgatccacccaccttagcctttcaaagtgctgggattacaggcatgagccattgcgcccggcctataactattatttaattaatttattttgttttgtttttgagacggagtttcgctcttgttgcccgggctggagtgcagtggcaccatctcagctcactgcaacctccacctcccagattcaagtgtttctcctgcctcagcctcccaagtagccaagattacaggcatgtgccaccacaccatgctaattttgtatttttagtagagacagagtttcaccatgttagtcatggctggtctcgaacttttgacctcaagtgatccacctgccttgccctcccaaagtgctgggattacagcagtgagccaccgtgcccggcctgctattattattattttttctgggtatcattgtgggcttccccacccccaacccttttcattcctgagtgccccgcctctaccctgagagggctgaattccacattttgctttcttgttttttattgtaaaagttaatatacatggagaaaaccacacaagccaattcagtatacattttttttttttggcggagtctcactctgtcatccatgctggagtatagtggcatgatctcggctcactgcaactctgctgccctggttgaagtaattctcctgcctcagccttccaagtaactgggattacaggcatctgccactgcgcccagctaatttttgtatttttagtagcgacagggtttcaccatcttggctaggctggtcttgaactcctgacctcatgaatccacctgcctctgcctcccaaaatgctgggattacaggcgtgagccaccacgcccagacttttttttttttagacagagtcttgctccgtcatccaggctggagtgcagtggtgccatcttggctcactgcaacttctgcctcctgaattcaaatgattctcatgcctcagccccctgagtagctgggattacaggtgtgtgccaccatgcccagctaatttttttgtatttttagtagaggcagagtttcaccatgttggccaggctggtctcaaacgatccacctgccttggcctcccaaagtgtcagtatacattttgttgttgttgttgttgttttgaaatggagtcttgccctgttgcccaggcttgagtgcagtgacacaatcttggctcactgcaacctccaccttccaggttcaagcaactctcctgcctcagcctcctgagtagctgggattataggcacccaccaccacgcctggctaattttgtatttttagtagagacggggtttcaccatgttgttcaggctggtctcggactcctgacctcagatgatccacgtaccttggcctcccaacgtgctggaaatacaggtgtgagccaccacaccctgcccatgtccatacacatttcaaggaactattataaagtaaacatccaagtaaccaccactactgtcaggaagttgtacattacattgtggtttgccctctagttgccatcctcccctgtgtgcctcctctagaccaagccagtggcatttgctgtgcggacaaatgttggctacaatccgtctccaggggatgaggtgcctgtgcagggagtggccatcaccttcgagcccaaagacttcctgcacatcaaggaggtgggtatctggagggagggcagggaagtgggtgccaggagacaggcagccagagtgctagtggacaaaaggcttctgagccaagcagagccaggctgaatctgctgtgtgaccttagacaaatctctccacctctctgagcctcttaattttctactggaaaaatgaggtggtaatgcttaggtcagaaggttgttgggagggtttgttagggggcctgaactggcatggcggtgtgccagggacatgtaggtatccgcatttactccagcggcctttgtagagtagggtgggcacatggggagaaggactctcagaattgcattgggccggtggcagggtggtccatggccagaaagcatgctggtcctggagttgtcctgagaattggcagctccactcagaggctggagccagggctggggatttttgagggtgccacccctgggctgggaggtgagtctgggcgtttcccctagagagtgactgctagcttgcccctgcagtttccctcttgctctttccacccacctgccatattctttgcagaaatacaataatgactggtggatcgggcggctggtgaaggagggctgtgaggttggcttcattcccagccccgtcaaactggacagccttcgcctgctgcaggaacagaagctgcgccagaaccgcctcggctccaggtgtctgggtggggcaggggaaggggatgctgccaaccccaggagaggccatacagcctggactaggcctcaatggttgtccctggccctgagggcacagagctgcctgtggcatcaccagtggggctggagcacctccgggggtgccgcatgtgagaggatgagagccccccacgcccacctctttgctcacaagctcggtttgcctctgcccacacagcaaatcaggcgataactccagttccagtctgggagatgtggtgactggcacccgccgccccacaccccctgccagtggtaagagccatcgccatgcaggggtttgggaagaagctcctgggtggggtggtctccccactccctgaatcctcctttccctgcagtaggaaacaccccaatcctgagtcccccaagcacatgcagtggttccccctccatgaagagtaggctacccctcaagctgggcctgtcatgtctctcctctcccttttctttggtagctccatctctctgcctgattcccctgccctgcccccattcatttctcccagccctgttccattcacctcttcttctttcttttttccccatccccatccctgcgttctgtacttgtgtctccacgttcatctcactccttctccccacctcgcctccctcctccctctctcctgactctccggtccaggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaaggtaattctcgctgtgttcttgcaagaggtgggggagtcagggccagcactttggtggagggaagggggctgtaatggattcagatgtggtaccaacctgttctgtgggcatcagggcttcctgctgaggtggagggaagggtagcatgggcacatccccctccacacacaactccaccctggcccgatctccaggaaggagatcttgcccttggaaggttgcccccacacctggggcagcagggtttggtggtcatgaaccctgacctctcccctcactcccaggggcctgctctggtgttggtgtctaccttggcatgtgaagcaggacatgggatggcattccttctttgcccttttttgactctctgggtgggcacatagtgggggggggctgctggctgcaaagcaagacagttaagggaacccctaaaatgggcatgttggcatgcactgggggcaggagatgggcaacaagataggggctgtcaccctctccagctcttttccaagacccagaagagggtaggatatgtctgaatattcccacatccactggactgactgtcagtcctgctcccagccctgatccagggccacctctggctcccccttggcgtggggtcccgttccccgtctctggctctgtctgtcactaacacgcatgccctgttatctctcctcgtctgcccggctctccctccctctcttgtcctggctcctgccttgccctctgcccctgcctgggtccccttccctctctcctcccccttccctctcttggcaatctctggacccagccaaacagaagcagaagtcggtgagtatcacagctttctgtgtcctcctccccactccctgggatgagctagggggaccttctaacacccattcccacatctgtcccccatttcccccacccttcctggttctccctggccatccctccccacccccaccctgatccctacatctgggctctgggaccagggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggtaggacttcctagaggggagtggatgcagaggggccttagaaagatcttcagaccccagagagatcccctagaagggcccgatcccaaggcatcctcccaggagggctacagactttcagagacaacccccagggggcccaatccacagaaagacccactcagaggagccccgtcccccaaagaaaccctcagaagagccctcccagagatgccacttacagggaccttggaaccagagaccccagtggaggcccctcagactcagacccccgcccgccgtaaaggcctgtccagaagaaagtggaacgtgagggtacaaatacccagcgactcagagtctgagcggctttaaatgcctgccttctcctccctccctccccacaaacccccacccccaggttacagacatgatgcagaaagctttatttgacttcttgaagcatcggtttgatggcaggtaagatcctgggagctgctcctcgcacctgccgttgctctctgctgctggggatgggcaggatgcctcgaatcacaatcctgggactcggactgaggaacagaaggcgggcctggaactggggagtgggcagggcattccagcccaccctgacccctgactcccctcttgccccattccccaggatctccatcactcgtgtgacggcagatatttccctggctaagcgctcagttctcaacaaccccagcaaacacatcatcattgagcgctccaacacacgctccagcctgggtgagcctactcctgctgtcttcactccccctttctgggccggatgtgggaggggtgggaggtgtgggaggtagtgggcagggccatctccagaagtgttccctccacctgctgttcctgggaggccacctgacattcccccatccacatgactccatgcccccagctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtgggtgcaggagcctgaccctggccaggacagcgtggtttgaaagggctgcttgggtttaaatcccagctccactgcttactaattacgtgaattaatctgcctgagtcttagtttccttctctgtaaagctccatcgtattgtcaagtgtttcaacctcatatgaatgtatagcacttagcaaatggtctgatacaacatgttagctattatttactattattagggtcatgcagaccagtcccctgtctccactctgattgacttcccacccttggactgaaagaattctgtgctttttgttccagtgccacccagctacttggcagttgggaggtctttcctttcttcttcttcttcttcttcttcttcttttttttaagtcaggatctcgctctgtcacccaggctggaatgcagtgatgcaatcatagttcactgcagcctctacctcctgggctaaagcaatccacccacctcggcctcccacgtagctgggactacaggtgtccaccaccatgcctggctaatatttttattttttagagatgggattagctgtgttgcccaggctgctttcctctcttgatatcagccctttttgctgcagtgtcctcatttggactttgatagaggggaaatcggtaggaaggccgccttactttttccttgtattgcagcaccattaactttcccttctagatgccagtggggatctgagaaacacggaggaagagttgaggtggaggatttgaagttagaagacagcatgggcttgaaattcaagctctgattggtttacgtattgatttattcttattgttggttgttttttattgaacttggaatcttgggggaattatttagcctctgattctctatttcttcacctataaagtggggttgtaatccctctcgtgttattgttgagaggattgctgtaaggagcccagtatactctctgatttatttatttatttatttatttatttatttatttatttattttagacagagtcttgctctgtcaccaggctggagtgcagtggcgcgatcttagctcactgcaacctccacctcccaggttcaagcgattctcctgcctcagcctcctgagtggctgggactacaggagtgtaccaccacggcccggctaattttttgtattttttagtagagacagggtttcaccatgttggccaggatggtctcgatctcctgacctcgtgatctgcccacctcggcctcccaaagtgctgggattacaggagtgagctaccgcacccagcctactctctgatttatgagggcagccaatagtggtaaccattatcatcccatgagctgggctccctggaccagttacttaaccttttttttttttgagacagccttgccctgtcacccaggctggagtgcagtggtgcgatctcactcactacagcctccgcctcccaggttcaagtgattcttgtgcctcagtctcccgagtagctggggttaggattacgggcacacaccacacctggctttttttttttttctttttgagaaggagtctcactctgtcacccaggctggagtgtagtggtgcgatcttgctcactgcaacctccgcctcctgggttccagtgattcctctgcctcatcctcctgagtagctgggactacaggtgcatgccaccacacctggctaatttttatatttttagtagagacgggattttaccatgttggtcaggttggtcttgaactcctgacctcgtgatccaccggcctcggcctcccaaagtgctaggattacaggtgtgagccactgtgcccggccacacctggctaatttttgtatttttagtagaaacaggttttcaccatgttggccaggctggtctcaaactcctgacctcaagtgatttctcctgcctcagcctccctaagtgctgggattacaggcgtgagccaccgcgcccagcctacttaacctttctgagtcctctgtttctaatgagataaaggggatgatgggatttaagtacttcctgaggggagttgaaaggaccaaatgagataatggatgcaaaaacactgaactagaaagtaaccaatgcttccatttcccccactgaggttaagaggagggactctggaaccaggcagcctggaccttctactccagggctgtcacttactggctctgtgttcctttggcaagcggccaaacatctctatgccttggtttcctcatctgcagcataggcatactgggtttgtgaagattaaataaatgggttaaccatgaaaaatgcttggtattgggccaggcacggtggctcacacctgtaatctcagcaccttgggagcccgaggccggcggattgcctgagctaaagagttcaagaccagcctgggcaacatgatgaaaccctgcctctactaaaattcaaaaaattagctgcgcatggtggtgggcacctgtaattccagctactcaggaggctgaggcacaagaattgcttgaacccaggaggcggaggttgcagtgagccgagattgcatcactgcactccagcctgggtgacagagcaagactctgtctcaaaaataaataaataaataaataaaaataaacgcttggtatcccagaactatatctgttccattttgtaagaagattttcattttcaaataatttcagatttacagaagtgtggcaagaatagtatcaaaaaaatcttattttttgaatattcttcaccaggattcactaactttttaacattttattgaggtagaattcccataccattaagttcagccatttaaagtctataagccaggcttggtggctcacacctgtaatcccagcactttgggaggctgaggcaggtggatcacttgagctcaggagttggagaccagactgggcaacatggcaagaccctgtctctattaaaaaataaaaaataaattaagtgtacagtctaatttttttcagattcacaaattttgaaacatttacttttatctttctttctctctttttttttttgaggggggacgaagtctcgctctgtcacccaggctggagtgcagtggtacaatattggctcactgcaatctctgcctcccaggttcaagtgattctcctgcctcagcctcccaagtagctggtattacaggcgcccaccaccacacctggctaatttttatatttttagtagagacagagtttcaccatgttggccaggctggtctcgaactcccgacctcaaaagatccacctgtctcagcctcccaaagtgctgggattataggcgtgagccaccatgcctggcctatattgtgtttcttaagaacaacatcattatcttacacaaccatgatgcaattgtaaaattcaagaattatttctaaaatatagtccatatttggttttttttttttttgagctagggtctcactctggctgcccaggctggagtgcagtgatgcgatcttggctgactgcagcctctgcctccctagttcaagcagttctgcctcagcctcctgagtatctgggattacaggcgcctgccaccatacccagttaatttttgtattttcagtagagacggggttttgccatgttggcctggctggtctcgaactcctgacctcaggtgatccaccaccacccctgcctcccaaagtgtagggattacaggcgtgagccactgtgccggtatagaatgcccttcatagcaacatttcccccaatccaggaaccaacccaggatcacttgttgcctgttgttttttagacagagtcttgttctgtcgcccaggctggagtgcagtggcatgatgtcagctcacctcaacctctgcctcccaagttcaagtgattttcatgcctcagcctcgtgagtagctgggactacaggcatgtgctaccacgccaagctaatttttgtattattattattttttaataaagacagggtttcaccatgatggccaggctggtcttgaactcctggcctcaggtgatccacccgcctcagcctcccaaagtactgggattacaggtgtgagccactgcgcccggcctagttttctttctttctttctttcttttttttttttttgagacagagtctcactctgtcgctcaggttggagtgcagtggcgatctcagctcactgcaagctccgcctcccaggttcacgccgttctcctgcctcagcctcccaagtagctgggtctacaggcacctgccaccatgcccggctaatttttttagtagagacggggtttcactatgttggccaggatggtcttgatctcctgacctcgtgatccacccaccttggcctcccaaagtgctgggattataggcatgagccactgcacccggccctctttttttttttttttttttttttgagacggagtcttgctctgttgtccaagctggagtgcagtggcaccatctcggcttactgcaagctctgcctccattcttctgccccagcctcctgagtagctgagactacaggcgcctaccaccacatccggctaatgttttgtatttttagtagagatggggtttcaccatgttagccaggatggtctcgatctcctgacttcaagatctgcccgccttggcctcccaaagtgctgggattacaggtgtgacccaccgcacccagccagtatagttttctttaatctggaaggcttcctcagcctttcttgaattttccagagactgacatttaggcagagtacaggacagctattctgtagactgtctgtccctcagtgtgcgtttgtgtgattgttcctcatgattagtttccggttttgcattattataattatggttcttgttgttgagatgagaatgataatagcagctatctaacaggattgttgtcaggactcaattgatcatgtgaaaagcacagaacaatgctggtatgtagcaagtgccccataaaggaagactgttgttgttgccgttgttaatatagagggtgtggctgggctcagtgactcacgcctataatcccagcactttgagaggctgaggcaagtggatcacttgaggccaggagtttcagaccagcctgggcaacataataagaccctgtttctacaaaaaaattaaaaaaaattagtggggtatgatggcacgtgcctgtagccctagttactgaggaggctaggctgggggctcgcttgagcccagggtagaggtgaactatgttcacaccactgcacttcagcctgggtgacagagcgagaaccagtctctaaaattaaaaaaaaaaaaaacaaaaaaaaaggagagtgggcgggcctacaaacaatgttagagaagttgagaaggagaatcactgcccttcatatagcccctaaggaaggctggcataacaccaggagagagcctgagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgtgagtgcctagatcccagggaagggaatggagggagaacatttgggttgtcctggtttcctctggcctacatgagagacagggtgaccaggaacacctgggtcaggcctgtgggtgcagactggtcttctgggaagagcgcaggtcccgtcagtcaaagactgggttcaagccccagaagcacccttctgcgtggagagtcaagccctgtctcccagccttggttgccttatctctagaatgagggagttggactgagtgccaaaacttcttgcagttctgccaatctgtagatctgagagctctccttcccttctacatccagaggcctctttttaaccttgtccttcaatcccttgactctacccactgcacccaggccacaccctcaacccccttggccatgccccactcatcccagccctgccccctaaccccgccttcacaggaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcagcttctggtgtctgtggtttttgatgggtctggggcttctggtgctgtcttcctgggcctggtgccataggagcgcatctgctgcccgctggatatgaggcctgatgggagcgcttttaagacaagggactaggaaggacatgcgaggaagactgataaactgattcgctggactccacaccctttttagacccaacagagcaggggccttcagagccagggaaacctacgttaaacctggactctccctccctggagccctgactccacaaggcccctcaagagggaccaagaatgtggcatcttctatgacttgatgctgaaccttccaccattctcccagttaaagtccaggaaaggacctcccatgggagacccatcctgccttgccctcctcccatgggagccacagcccacctcttgatggcacaccattaagtataaggtcttaagagccagaagaaacccatgaaatcattctagactgtagctttcaaatttgttttcagcaacagagcccatttgttcaatgaatcttacgtggaagctgaggatgttagataatgcatccttgctctgccctgagggagccaggggaatggcctcccctccacctccatggggacccctgaagcacttctgtgcccttcccacccaatgccaccccagatctctaggtaacagtttggaaactgctactcaggtctaacccccatcacattacaaccaagaaatgaggccacagagaggggaactgtttgcttagggtcacacagcttgacatggcaggggagggactggaacccctcttgtgccccacctccacgtgacatttgatgataaggacactgggccacctcttcatcttcagtaggagggggagacccagcagccttccccagcttgctgctttgagtgcttgttgggggcaagggaggaatcccatcagccttggagatggtgtcatccgactagggaatggtgggagaagcatggggttctggaagcctgagattggggtttggtgtgggtcgaagaagccagggtcagcaggtttgagctgaaatcccgttaatatatttggaaaaccaaaggcaatgactaaccgaatcaaccgctaatgagtggcaatactgagctgttaatgacagttagccccaagatagcattaatgacctgcactgaggaagcggtgactcatggctcacggctgttggccatagttgccctgagagttcatatgtcctcacatctgttgaaggtcgggtgccccctgtcccgagagaggagcaaatgccctgaggtctgtcctctggctgggctccagagccgtttgtccccggggcccctcccctagagccagcaccctcttcatccaggccggacctcttaatgctgtcactaacttgccttgctttgttgtgtttttctcacccctgcctgatctgcatggtgtgtgctgtccgtctgctaaccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagc

SEQ ID NO: 15708 - DNA, 8412 bp, Human
tccctgctcttggatgagaaaagaggaagaaatatggagctgagagaggagaagctggtaaaatcagatctcatgacctttgacctagaattgcgccacctttacccctgatttagggagaaacatccaagatctggatgccacccaccatgactggtggagagaagaggaataggagattctgggcaatagactctggcgccaatttggctcaggctgtttctggttgtatagccccggacaaatcacctctctgagcatcagtttcctcctctcctataaaatggggttgctggtactgtggagtctgtgtcacctggtattattgggaggatgagggagaattaaatgaattgctggggtgtttggagaagctgtaagtttcaatgaaggggtcactcatgacaggaggacccattcccttcctactccaccccttctcctgctccacagaaaggagagatggagaagaccctctccaggtcaagtgaccttaaaataaggccaccaccttgctgtgttccgcaggacaggagactatgggactcctcctcctcacccaactctaatagcaagtgaatggtcagtctgtcattcctctgatcacaacaccttggggaaggcggagcagtgagtgaagatgaagcccattagaaacgttccaggagagttccaaccctgagcagggtttccacctgccccttggagacaagaaaggctggcataaccgcaaaagtatgggctttgcaatcagaaatatctgtgttctgaatctgttaccttagctgtaaaatgagggcaacgctaatcgtgttgttgtgaggaagtagcataaatgttgcttccctttctctctcttctactttctcagccaggaaagttgagatgaaacggatagggtgatcagcaggaaccaatcatgagttggagcctcaattcagatgtagacttcttaaaccccagaatgttcttcttggatttttacattgggtgttccagatcagaagaaaaggactgcttttttttttttttttgagacggagtctcactctgttgcccaggctggagtgcagtggcgcaatctcggctcactgcaacctccgcctcctgggttcaagcgattctcctgcctcagcctccccagtagctggaattacaagcacgcgccgctacgcccggctaatttttgtatttttagtggagacagggtttcaccatgttggccaggctggtctcgaactcctgacctcaagtgatccgcctgccttggcctcccaaagtgctgggattacaggcatgagccatcgagcccaacccaattttttttttttttaattttactttctgcaatcattcatccattcagccagtgcggtatttctgaggtgtgttcgatcgcggatccatgcctgccgcagtacagttgtgagccaaatgagactgagactagttcccgccctccaagagcttgcaagacccgcagtggcgtaaaaacactaacatcttttagtgatcgattctgcactccaggggttttcaatctactacaagagtgaataagagttcgcctttgtctgatatctgttgtcattctctctcgcttctttaactgattttttctcagctaataaaacatccacccacaaccccccgaacgcccgcaaacaccaggccactctagcaaaacctctctcactccgcctgcgcaatccagctgacttccggttacagataaccacgtgattgggaacccttgctgcgcatgtctagtaggaagtcggactataccactttccctacggaaggggtacttttttatgtttttaagtttaaaaccgatttctgatatttgacttttatcatttcaggcctatatggaggctatgagtgagtttagtgtggcagaagatgaaagaaccggacaggaatacggacgaaattggagcagggtttgggctctccccttcgcagataatgggaggagccgggcccgagcgagctctttcctttcgctgctgcggccgcagccatgaggtgagggcgagctggtctccatcaggcgctgacgcgtgtcgacaagggactgtcggtcttgggaccgcagctggggttgggggagatgaaatggaggccgccctaaagcggccggtcccggggtttggggtaggccggagcactttcgtcccgggcctccggagtgagggggggcggggagcgtcgcagcaactgagaccaggaaaagtctgccccggctggtgccgcaccgcacacgtgtccggtcgacccacgcgagcagagcaaacggagcgaacaagaccaagccgtgggccctttcttgcttggcacacccggagcggagccgatctctgctttcacgtgatgtagggcaagcctagtgtaggccccaggcctccgactgccgagagaggtgatctctaactcttgactccattcactcctttggcctctcataaaggaaatctctgcgaatagccgaacgaggcttgttactgtgataaaacagggaaataagcccagaaaacagagtaacttgcctgcattcctagactagaaatcaggtctactcacctcgaatattctttaaacgctgagtaccagaaatggcataacccccctattcaatccaataagtccttggcttgactttccagaggagaaatgcgaacatgaggctccgagaggtgaaggcatagcgtgggttttgaagtcttaaacccaagggggccagctgcatagcccagagccttaaagatgatttagggaagagtcttatttcgcggctgtggtgtgggtcacaaagggcaggtcttgatggggacgttcattcttgcccaggattggctttcagagtctaatcatgttttctgtgtgtctagtatgctcaggcttcagaagaggctcgcctctagtgtcctccgctgtggcaagaagaaggtctggttagaccccaatgagaccaatgaaatcgccaatgccaactcccgtgagtacctgggatctgtctcttcaccctacttccttcttttctcctgcgtcagattaatgataacacaattgtgttgacttttttttttttttttagacagtcttgctctgttgtccaggctggagtgtagtggtgccatctgatcattgcaacccctgctcccaggctcaagtgattctcccacctcagcctcctgagtagctgggattagaggtgtgcaccaccacacccagctaatttactctttatattttattttattttttttgggacagagtctcactttgtcacccagactggagtgcagtggtaggatctcagctcaccgcaacctctgcctcccaggttcaagcgattctccttcctcagcctcccaagtagctgggactaaggcacgtgccaccacacccagctaatttttgtatctttagtagagatggggtttcatcatgttggtcaggctggtctcaaactcctgacctcaggtcatccatccacctcagcctcccagagtgctgggattatcgacgtgagccaccacacctagcctgggttgacttgttacaaacctaggaaagttcattcagagtgtctataaaatggaggagtcattgtatcaggcttgttcttttgagtgtgctttcatatatttaaaatgtagaaatggccaggcatggtggcaggcatctttaatcccagctacttggtaagctgaggcaggaggatcatgagcccagaaattcaagaccggcctgggcaacatagggagactgtctcaaagacaaagggtatttctcacaacctctgtttgtgaaggaaaaagaaaagatagaggttttttgggtttttgaaggcaagaaataagttccagtgtttccatcctttttgagaccgtggggccaagaatgtgagcagtgtctctggcctggcctatttggactctgtgatgtgcttgggccccagttgactgaccaggtgcattatgctttcccaggtcagcagatccggaagctcatcaaagatgggctgatcatccgcaagcctgtgacggtccattcccgggctcgatgccggaaaaacaccttggcccgccggaagggcaggcacatgggcataggtaagtgtggtcatcttctccttaagaaatgataggtgctggcatctatgctgaaatatattcaggatctaagcactctgtctcatcttgagcctgtttcttactccttgatatttgatgtgttttctgcctgtgtgcaaatcagaaagttggtgctggtattggaattgagagtatccctggtaggaggtcacatttactaagtccctacctacactatgccaaggattctgtactttctagtttcagaatgatcgaaggaagctccttacaacgtgctgtgttgccttggtgcactgcctgttacacccacattctgcatgaagtgaatggggaattattgctgtatttgtgcttcctttaaaattgagtaaacgaaagaacttacgtagttgggatcatcatctggaaaatggaagtaatgctacttaaaatgaggttgtgaggattaaatgagttaaggaccctgacttgaaactatattcacttggtgtacttatacacagtgggcctgggtagtggcccgttcctaactcatcttctccacaggtaagcggaagggtacagccaatgcccgaatgccagagaaggtcacatggatgaggagaatgaggattttgcgccggctgctcagaagataccgtgaatctaagaagatcgatcgccacatgtaagcacaccctcttgggcccagtacccatttgctgctttgatggctagttcatttcccagagattttttttttttttttttttttttgagatggagtcttgctctgtcacccaggctggagtgcagtggcgcgatctcagctcactacaacctctacctcccaggttcaagttattctcctgcctcagcctcttgagtagctgggactacaggcatgtgccaccatacctggctaattttttgcatttttagtagagacggggtttcactgtgttagccaggatggtctcgatctcctggccttgtgatccgcccgccttggcctcccaaagtgctggggttataggcatgagccaccacgcgtggcccacagagatctgtcttactggccttgggtagggagctttttttttttggagacagagtctcgctctgtcacccaggatggaatgcagtggcacgatcttggttcactgcaatctgctttcgaggttcaagcacttcacctgcctcaccgtctcaagtacctgggattacaggcatgtactaccacgcctggctaatttttgtatttttagtagagatgtggtttcaccgttggccaggctggtctcgaactcctggcctcaagtgatccgcccgcctcagcctctcaaagtgctcagattacaggcctgagccaccacgcccagccatgggtagggagcctttctaagaaagtttttctattctggtctttctttttttccctgtatgtcatcaggatagcccaacagtttatttgccaggcaagttctatctaggaactgcacacaaaaaagtcatggtttaggaagtaattcatgcagcaataggagaaaagaaaggaagctacaagcttagtgaccttgggtggaggaacagctcacaaggcagcctctgatccatcaccaaccagcatctcttcactccgtgtaccctgcaggtatcacagcctgtacctgaaggtgaaggggaatgtgttcaaaaacaagcggattctcatggaacacatccacaagctgaaggcagacaaggcccgcaagaagctcctggcgtaagtttcttttcagagtcttaggggaacattcttagacctttgagagttgttcttagatacttaaaatgtgccaatgcctaagtcttgacttgcacgtagtctgtcttaggaatacagctgttcccttagaggcacccactcctctgtcctgtacacacccactcttcctgtctcgtagggactagaggttagttgaagcaggagcctttggtgggcccagcaactcattccagaagctgactaggctcaaagggagaggtctggggatgtgcttctgtctccctagcatctcatctcttcccaaactgacccgtcttttctcttccctgaccagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgccttcctctctgcttcttgcaaggtttacggttactgagtgaggtttttttttttttttgagacgagtcttgccctgtcgcccaggcttgagtccgatggcgcagccttggctcaccgcaaactccacctccaggttcaagcagttctcctgcctcagcctcctgagtagctgggattacaggtgcgtgccaccacgcccggctgatttttgtatttttagtagagactgggtttcactgttggccaggttgatctcgaactcctgaccacaagtgatccacctgcctcggcctcccaaaatgctgggattgcaggcgtgagccactacacttggcctgctcactgagtcttttaccttgttttagtgggatgtagggagaaaaggaatggcttttatgcaagcctccaaaatactgtgcctcagaactgcccttcgaagcacgagtgacacctaagaagtggtctcagaatgttggttgggaccagtagttgtgacatcagttaaggaatcagtctttacaaaagccataggaaatacttagggtgtttatacttctcagctgacaagtgggggttacaaatgggacctgagcttggactactggctactacctaagctgtcactaaacagctttattgagatacagttgaaagtttgagacagaatcaccctgtcacccaggctggagtgcagtcggcaacccctgcctcctgggttcaagcaactctccctgcctcagcctcctgagtagttaggatgacaggcacccaccaccatgcctggctaatttttgtatttcttttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccctaatttttgtatttcttagtagagacggggtttcgccatgttggtcaggctggtcttgagcgcctgacctcaggtgatccacccgcctctgtgcctggccccccagctcttttctgaggaactcttctgttggagtgatgagctggcgtgcctttcagggcatgtaatgggctgatggaaaagggcaagacctgagtgggaatggcaggttggctatggtgtcagggccagcagactcctagctctgcctctggcgtcctcatgccattctgggcaggatgggcaggtgggtagcagaaggcagggaagcccacacttagaaatgtcccaaggaagccgggcacagtggctcacgcctgtaatcccagcactttggtaggccgaggtggacagatcatctgaggtcgggagttcgagaccagcctgaccaacgtgaagaaaacccatctttactaaaaatacaaaataagctagacatggtggcacatgcctgtaatgccagccacttgggaggctgaggcaggagaatcgcttgaaccgggagacagagattgcagtgagccgagagccattgcactccagcctgggcaataagagtgaaactccatctcaagaaaaagaaaatgtccagaggaccccccatcgtatgcctcacagcctgggatgagaggacactggcttctggatccccctggccactggagcggccagcgtgtttcacccattagctcttgccctttgaagtggggaagctgaggcctagaaagggaagggtcttggccaagctcccagcttggtgtgtgggacacctgcttcccaggcctggcccagaggaggaggggtagtggagactgcccacccacaacccctccatgcagtagaga

SEQ ID NO: 15709 - DNA, 12157 bp, Human; identical to SEQ ID NO: 13490

SEQ ID NO: 15710 - DNA, 12157 bp, Human; identical to SEQ ID NO: 13490

SEQ ID NO: 15711 - DNA, 18083 bp, Human
agttgtgtgcacattgaatttgtacaactacatatgtgcacaacttcagacttaaaaaaaatttatttgtttatttatgttgagacagggtcttgctctattgcccaggctggagtgcaatggcaggatctcagctcactgcagcttctgcctcccaggctcatgcgattctcccgcctcagcctctggagtagctgggactacaggagcccactaccatgcctggctaatttttgtattttttgcagagatgggtttttgccatgttggccaggctggtctcaaactcctgagctcaggtgatcctcccgcggcttcacaaagtgctgggattacaggcatgagccaccgcgctcagccaaaaaagttacttttaaaatgtgaaaaaagaaactgaaagtagagttctagtctgtcaccagttacttccagttaccatcccaggtggaaagcaacagctgtgaaataaaaagcaaaaataattactttgaaggagtccagaagcactgtagcttcccagtgtttactattatttacttgttttcatgtgataattagatgacaaaacccttaaatcaaaacgactttgtcagtacgcaaaatattggggagttagtaattgggaagggatagaaatgttggtggtggctaccagcaggagcagataaagagggaaattaaggtgaaaattggaggagccctgagaactcaataataggtggttgggaaaggtgctgaaggaaataaatacatgagacttaaacaacaaaaaataacacttgccacaacctccacccctgaaatcctattagtctcaaaagttaaaaagctctaatgcaacaggtctgtaaagaatgaacacagggccagggtggtgtctcatgcctgtaatccgaggactttgggagactgaggcaggaggatcacttgagcccaggagttcaagaccagcctgggcaacatagtgagacccccgccccgccccgccaccccgtttctacaaattttcttttttaagctgagggtggtgcacacctgtagtcccagctacttggggggctaaggtgggaagactgcttgagcccagaaggttgagtctgccgtgagctatgatcacaccactacactctgcaatagagaccctgtctcaaaaaaaaaaaaaaaggcaaaaaaagaaaaaaagactaacaaagaaagaatgaacatagatttgttccccatatcttgtggtattaaacctagggtctactcttcaagcttacatcataggtttagcattaaaacagctaagcagcaaagcagatgctgtaagcgatagaaattcattaagataggaaagagtgggaaatatgtaaagatccaaaaagaatatatatttaattacgatttttttgaatacttaataaaatatgctattcctaagtgccatgccatagggatttcacaaaactatgaactgtgattagcaggaattcctcatgaagtttgtactctatgtgagaggtctggatatgtttatgaatcgagaacagtaaagtacagggtatgtaacggagccaaacgcgaatccagttggaatcctaaggatccatgaagtgctccctcctccaacactttcccagcctcctattcacagctccagcctccccacgtccgatatctacccccaggggaccgttactattgacagcgagcgcgcggagctgcatgggcacacaaggcggaggggacaccaaggtccgttattccccagcacgttcactgccccagcgacagcgcaagcctgaggcacgcagacgcgggaggaacccgaggcacagcacacagcaggtgaggggcgtggtactccggtaccctcagtcggccgaccatagagcttgtagacctccaggactcctagagagcttccggaagtgcctttggggcaagatgcgtgctggccggtgttgtgcctccgcagatttagaagttagtggccggaggggcctggtccgagtacagctttcatcgcctttactccccgaccttccttcgagtctgtttatccgttgcagcctcccttccccacgacggggcgcctctgcaactcacagtgagtacggtcgggctctgggccggaggaaagtgggtgctttgtggctggtccaggccgcagctgaggactggcctgaggggtccggagaggggcctgtgcggtgttcggcgccgcggaccgattctgacgccttagttgctgttgcaggcagagtacgtccccacgaattgcccttgaactttttgcgagggaaccttttatgaagctttcttcatagataatcgtgttgtggtatgtttttgtagtcgatcttgtttatcttaaaatggggaacgccccccccatgttattttttatccaactatttccagagtctgaattgttttcacttagcgctcttttgcgtttaggtcacaacaaaattctcagtttttaaaaaagacatattttgcttttggaagccccgtttatccatggaaaccaatttttgctgttactcttctttctttagtgtattcagaaactggtggtgtgttgactagataattgtacgaaagttttttttttttttaatttcagggtaattcagaattcaacattatcagaatgcctatttcatttgttaaagcaaactgaagttagccaacgaggaactctgggagggccccatttccaaaactctggttagtcatgagtaatttttgtcaggctactttgactgccaccaccacctttaaaaacatatttctgttgtttgttagttccgttgagtatatttacgtagcaatcattgttttagcaaatacatacatgttttgaatttctgttgtttaaatgtaaaatgtgatagatgttaattaaaactttcagctaatgcaatttgagataacaaagcatagtattggcttcacctactttttcttggattttaaatcctggaaaatgtcttttttgttttgttttcagttcccaaacatttctcaaattagacatagtctgaaggaagaatacattccttccacaactattgaaaaaataatactgttaaaattgagttgtgccttcagcatctcacaggattacagtatttaaaatccagaggaagctttaaagattgccttttaaactcatgtaaacttgactaggtgttctttaaggagactatgtaaaaatcagtctgtatccacaaagtgctcaccaacttaatacagacatgtacgcacaaaactgagaggaaggtacatactggagtaattttgcactcagttatttataggttgtaattctcaaaaaccagctgatcagagagggaagagacttaaaaaaatggaaaattagccactaaatagaataatcaagatgggcaatgggcaagacctgttggctgatttggtataaaaaatgaacaaacctgataattagctggttttcatcagtgttgttattgagactttttaataccacatcaacaatataaagttcttgaatgctgcgcacttcacattaaaatattttatagcctcctgtactggtaagtagtgggattgcacctgtgaatagactctgcactcaagcctgagcaacatagtgagaccctgtccctaaataataataataatattttatagccattatggatgaggattgctcagtaatagatggccagttgttcagtagttaaaaatgaaccttggctttaaggaaatttataagaaaacatggtaagactaccactatataacatcacattctaaacagaatttatgtcccatgtattgacctttaagtttttaacattaaaccataagtagctattttaagaaaatttaagagtttgttttgatttgaaaaattaaattattttaaaattagctaagaccattttaaaataaattatcttaaaattatagataatttattcaaacaaaaacaaattgtcaaaaccaaattgattaccctttctcaacaaaatctcagcatcttcctcaaattcactcttcccccaaatctcactattctagcaaattcctccactttcctgtaaagtcataatcaatgaactatacccccaatgttaattgatatatttaaccatatcttttgctccttggttcttctgatctgtagtttactctccaccctgttgttcccggccttgtctaacttgaaaaataattttcaaattccctttcttttctgtacacactctctatgtaggatttgtttgtatgtttgtttgtttttaaccttcctggcattcttggatggcctttgagtctgtgaactctgccgaaattgagtatacaattttgtatctgtggacattttgctggaaagaagttctgtgttttctttaggttgaagagtctataaaccaacccccctcgccccgtgccacaactccaaaaactgaaaagataagcactgccttgatgatccgtatggggaactgtatgtacagtaatctgatttttttcctaagtacctatctcttctttgtggactataggtctctggttttatcttgatgttagcatctcatgacaactggtttagggtatgctacctttacttacactcttcttcattctctacagtatctttgaaatacaaagataatggtcacctctgtcaacaaacatttgcaataaggccatggccacattctcacaatgtgataagtcctatatttggaccatgttaaaaatgctttggtaggaatgacaaatggcagggggatgacagagaagaactcatgaaaaaggtaatagataaattagagttaagagttgaatgattttaggccgggcacagtggcttacgcctgtaatcccagcactttgggaggccgaggcgggcagatcacgaggtcaggagatcgagaccatcctggctaacacagtgaaaccccatctctactaaaaatacaaaaaattagccgggtgtggtggagggcgcctgtagtcccagctactcgggaggccgaggcaggagaatggcgtgaacccgggaggcggaggttgcagtgagccgagttcgcgccactgcactccagcctgggcgacagagcaagactccatctcaaacaaaaaaaaaaagagttgaatggttttagctggaccaagatttatcaaccttggcattgacactttgggccaaataattctttgtggtgggggctgtgttgagcattgtaggatccctggcctctatgtacaagataatagtagcaccccttacccccaagttgtgacaacaaaaatatttacagacattatgaaaggtccctgggatgggggtaaggacaatattgccatcagttttgaaccactgagctagagtaaagaactctgtagtagaatggaagtatgagaaagccacagcccagaaaggctttatgtaagtgagtttaaagtagatatagccagccaggtttacattcataaagggccttgcataccatgctaaaaaatttggtccctattgaaatattttcaggaggtgagtcatgttagtcatattacatatttttaaaaaatctctggcagtacagggctactgtaaaaaaaaaaagtatcataaacctggtagtttaatagaatagacacttactgtctcatagttaggaaggctagatgtccaaaatcagagtgtcgccagacccatgctcttctagcttcttgtttttactgacaaactttggcattccttggcttgcagctgcacaactccatctctgcttctgtagtcacttagctctcattcatctgtgtgtgtgtgtcttcacatgaccttctcctttctcagagtctgtctctgtgtcttttttccttttaaaagtgtgccagtcatattggtttaatggcctacccattccagtataacttcatcttaacttgattacatctgcaaagccccatttccaaataaggtcacatccacaggtactagaggttagaatgtccgcatatctttttgagggacacatttcaacacacagtaggcaatattgtggaacatgaatgggaaaaaagcataaccaaagttaccattgcagttctaggcaagagatgatgtctataccaaggatggaaaccatagacatatatttcacaaagaaataggatcatgaaattgaacttttttcggacatcaggtcttgtttctaaatctcactcttacaagaaatataaacatgttctgtgtttgcaattgtaaatatggctaatgttcttcgattctatcaataagataaaagatatggacctttgcccatggggaaaatacaattaagttttgaagtcagaattcctttggaactaataaatatacagttatgggaaaagtaacattaaagcaatacacatttaagtaacagaggtatagaatgagaggaaaataatttccaattggagtcaccaggaaaggatttttaaaggcaacagtattttatcttgtcctttaagaaagtagtgtcggtactgatgaaagaagtcaaagaagacttcaacggagagacacattgtgttcacggaatggaaaactcactgttgttgagatatcagttgtccctaaaatgagctatggattcaatacaaatccaattcaataattttttgtagaaattaatacactgattctaaaatgtgtatcaaaagacaacagaactaggaaagtgaaaataattttgaaaacgaacaacaaagttgcaagacccacctacttgatttcaagattttaaaagttacacaatcaagactattctgtattggtgaaagaatagatgtataggtcaataaacagaacagagattccagaaatagacccttacatatacatacatatagtgaactgatatttgacaaatatacaaagacagttaagtagataaaggagaatccttaaaatgaacctccatccatacctcaaattctatataaaaattaactcaaaatggatcataggcctaaatgtaaaacctaaaactataaaacttttagtaaaaaacaggagaaaatatttgtaaccttggattaagcaaagatttcttagatatgacatcaaaagcacagtcaattaaaaaaatgaactttttttcttcaaaaggccctatgaaaaggatgaaaaagagggaatacttgcaaattacatatctcataaaggacttgtgtccagaggatgtaagaaactcaaaacttaattttaaaataactaaatttaaaaatgggcagaagttttgaacaaatacttcactaaagaagatatatagatgttaaataagcacataaaaagatgctcaacattattagtcagtagagaaatgcatactaaagccatatgagatattaaaaccataatgagttgccactacacatacacctattagaatatctaaaattaaaaacaaaaacaatatcaagtgctagtcagattggaaaacagttttgcagtttcttataaagttatacatatatgtattttatgacacagcaattttacctctgaatatttgcccaaataaaatgaaaactatattcacaccaaaactcatgcagatgttcatagtggctttattcatagtgattaaaaaacaaaaacaactcagatattgttcaactgggaaatggataaacatttaaacattcccactccagaatctcacataaataaaatcatatagtatgtagccttttgagtgtgggagtagacttttgggttgtagttgtcaatagggcatccaggttccttggagtgctccatagagagtttctgagttggaggtcacgtccatagtagaggaagttaaccttgagataggaggaaagatgaggggcacaggtaggataaggaatgttaggtggagaagagcaaagtgttaggaaagtttttgacaataccttgaattagattatgtagaaattagtctcatctgttaagagtaagggaaaggttgagagctgaagcgtgtagaaccagattagtacagctggtgtatcaaagactaaaaggggttaaatgagcagccctgaaggccagctgagattaaacacaaaatttcaactagacccagtctacatggtttcctgactttgcttagccatgttccacatccccaaacagggtgatgaaagcagaaggaaggggtttttctatggatgggtttggcatggctggcatgacagaaagttaaggaagtaagaagttatttctggaacagtggggaggatcatttaattggccgagccatgaagtccgtgtcatactaaggaacttgttaagataccatagttagttacaatgacttttgacttgccttaacactatcatattttcttcatgaagaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtatgcgtgctatgactgtgggagtcctggaagcttggtagagggacataggcatcacagtgggagagcagatgcttagcatcagtttctgttggataaggatgacaatagttttagtgtagtatgacttgtagagttctttttacttttgtaaaggatataaatccattttgtttttgtcgtcataacatccctacgactgtattgttcttgtttgccagatgggaacttgatgcataggaagcttaagttaatttttcaggggtatccaaataattaaaggtaaatttgagaccagaaatcaggctttctagttccttattaaaagatttttctactgcatagcactgctttaagtttgttgttttcctccttcctctgccttaggagtacaaaatattggtgttctgtgtaacagggaaggcatcagcagaaatcttttcctttagtactaagcaaaaatgatgcctttctttctgtgctcattacgtattcgtgttccttactgtccctaagaagtgaggaagattctgctgcttccttccccaagcatatatccctgtagatgtgttcgtggtcctctttcattgttcattacatttcgcaaagggattccttattatccaactgtctgttgtttccaggtctcagctcgcgtacatggacatagggtactctgggaggaggtagtacattcagcatctgcaccagagcctccaaatactcagctccaatctgaggcaacccaacataaatctccagtgccccaagagtcacaagagagaggtgagtagccagatttcattgatgataagggggggaagtacaaataaaagtccatttgggatacctatctagttcctgaagaaccaggaactaaaatcctgtttacagaccagtcccaaagtctgtgtttaaatgtttaggcttcaaatatagattattctttctagtggtaaactcatgaacaaattaaataatttgacttttttttttttaattttttttccttttattattatactttaagttttagggtacatgtgcacattgtgcaggttagttacatatgtatacatgtgccatatttctgttaccacagtacatttacaacatacatttttgaggttatgctggtattgtcatgccactttatttggaaatatttcagtatgtatttcctcagacaagagcatttcttaggtaacttaaataaataaattcctaaatttatcacaattaagaaatgtagtattgctacaatactaacctaggccatagttcatattttgacagttgccccaattatgttctttctggttcagagtctagtctggcgtcacactttgtggttagttgtcatggctgtttagtctcctttactttggaatagttcctcaacctttctttttttttgaagagtacaggtgtgttattttgtagaatggctgcagtttggatttgcgtgatgtttgatcatgtttacattgaggtcatatatatttggcaggaacacctcaccctgccaaggatacatgacctaaatcttaacaagagatgttgtactccttcttaggggtacaacaggaatttgtcctattattggtggtgttatctttgatgacttggttaaggttattcttgcagggttaatcattgtatagttactatttttccctttgtaactaataagtaatttgtggaagatactcttgagtgtatttaaatatcttagtcctcattaaactttgttgctaaaacactagttttagtgttcattggtacttcttgactgacttagtgattactagaatggttatgaaatagtgattttctaactctgtcattccttctacatttctttattgtaaaggagagtgctcccttctcccaattttattattttttatttatcagtatggactcaaattcgtatttattccataaatattctgttactgtctttattttgtttttgttttgtctttgagacagagtctcactctgtcatccaggctggagtacagtggcacgatctcagctcactgcagcttctgcctcccgggttccagcgattcttaatcctcagcttccccagtagctgggattacaggtgcacgccaccatgcctggctaatttttgtatttttgtagagacgaggtttcactgtgttggccaggctggtctcgaactcctagcctcaagcgatctgcccacttcagcctcccaaagtgctgggattacagccatgagccactgtgctcggccactgtctttattttgctaaatcatctcagatttggccatagaaggccccttcagtctggctcttgtatcctcttgacattttcccattgtttttttgagaatttttttactttattgcagaatgaggtgttccagtctcatcttcccctgcatttcatattttttcattaatgtgatttagagtagtttataaatatgaatttttaatatttctaaagaagcattaaaacacttaatacttcttgtctaaagtcctaaagcttgttacctgagatacagtaatctatattttaataataagccgtttaatatctatagaaagcaaatactgggagccatagtagacatttcagaaaggtaattaattaatagagactggttgattctgatacttggtttgccaagagattaggacctaaggaaatactgtatacagccacaaagacagaagtagttttgatggtagagaagaaattgaaaagcgattcctgttaggaaaccagtatactttctatttttgagtgtaacttcagtctgacttcagggacatcggggtgcgtatgttttgtggggcagccatagatatggccccagaatccaagatatcagcacttcatgtgcaaaatctttggcatacatgtatatctgctgaaataaaaataatttggaatgggtgagtgccagctcccacaaccacaggacaggactggtctcattcatagctcctttctcctctcagccatgtctacttcccagagtcctactcgttcccagaaaggaagttctggagaccaggaaatgacagctacacttctcacagcagggttccaggtgagttgtgctccttctcactgaaacgccatagctgtgcttgtcagtgtttgtggcatctgccctatatcttgactgtctagtttgtagcagtacctacccaaaaagttgtcccaaaaattcttttgcctagggacagattgatcctgaatttcccccagtaaatctcatgcattttcctcttcttcctagctattcagatccctttacatagtacattcccaagttgtaattctctcccaatactggtggatctctcaagctctataggtttgagctgtggaacagtcccagtccccaaatggggatcttgttttgtttcagactttggagaagattgaagacatggctgtgtcccttattcgagaggagtggcttcttgatccatcacagaaggatctgtgtagagataacaggccagaaaatttcagaaacatgttctccctgggtaaggagaggtgtggttattattgtcattttagattttttgtttgtttgttgtttatgtgtatagtagctacagcctttctgaaagacatagttaagtttaactcaggatccagcagagggatatgatgttgagatttcttgaaatcttacgtgaaacttttgttctcctgtccagaacttccttacattttgtaccagggtactggcgtttttgccagttggaaattgacatctcacaggtgctctctgagttcatatatttcttctccaagttgtcatgggattcctacatatatttttctcacataaattaattgtatctcctcccttttgatgactgggcattttcccatttctgtcctgctcattagttcttttagtagttccatattcctctccccaactttcacctcacttcagttcatcctttcctgactttagttccccttccaattaactctctttttttaatggtacctctttcccagttgactagctcatattaagcaaggtcactattaagaagctattttggagacagaagttttgtgtttacttatagctgttcatgtgtactttccttttcccctatcttcagttcctttctcctagcataaagaataggttgtgacattggcttgatgtttgtttattacatttttatttcaggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcat

SEQ ID NO: 15712 - DNA, 12587 bp, Human
atttaaatagaggcaggagtcactcaggctagaatgcagtggtgcaatcacagctcactattgcagccaccacctcctgggctcaggcgatcctcccacctcagcctcccgagtagctgggagtacaagtgcattccacaacccccgactaattttttttttttttaatttttgtagagacgaggtcccaactatgttgcccaggctggtctcgaactcctgagttcaattaatcctcctgcctttgcctcccaaagcggggaattagaaaagtgagccaacacgcccggcccactagtgttaaaaaataaaaacaaaagcaataatctgacagatagagccagggagggctatgaagagacacttctcaggcttgtatgcctcataagaaaactatcacatatgactgcaaaacccatcttacaccaaaaatacctctgcaaggacatccgcccagcaactgtttgtctaacctcagactggtgtcatcctcgttaccgatctttgtagtcaagaataatgatttcaaaacaattaaataatcctccccattcttcctttaaaaacctttgtcttcctttacctccctgaatagaaacatagtttactctggcacgtctattcttattgcaatttcctattcccgaataaacttttttttttttttttgagatggatccttgctctgtcgcccaggctggagtgcagtggcgtgatctcagctcactgcaaccttcacctcctgggttcaagcgattcttctgtcttagcctcccaagtagctgggactacaggcgcccaccaccacacccagctaatttttatatttttagtacagacggggtttcaccatgttggccaggctggccttgaactccttgttaaatacagtgagttctaaatttctcttcaaagaatcagtatgtcagtatgttcaattctttgttctccattttaaactttaacttcctcattttcctcgtctccttgcctctagtttcagtaaacaaccttttccaccagttctaatcagtagttcacatctgttcccctggtgacctgctccgtcctgagtcacccctggtcacctgctctgacctgagtcacctttagtcacctgttccgtaaccgtccttcccactgaaactgctcaccctaccactccggctcatacccctgctctctttaaaatagccaatcggaattaacttagactgtgcggtccaaccctagccagtaggggaacgacacagcactagggactacctgcgtcagggataagaaccccttcccctcccttgttcaggtgtgctctcgccattgctccatccgtgagacgcacccttctatagaagtaaattgctttgctgagaaaatgtgtgctcgagtgtgtatctttttcttcttcttctttttctgagactgagtctcactctgtcacccaagctggagtgcagtggcgcggtctcggctcactgcaagctccgcctcccgggttcaagcgattctcctgcctcagcctcccgagcacctggaactacaggcgcgtgccaccacgcccggcaatttttttttttttttttttttttgtatttttagtagacacagggtgtcaccgcgtaaaccaggatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcgtggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaaggtactatgggagcctttaccagcatgccccttgaagtctctgttctgctttgtggtctctaccggatttcccctgactgtctccctctccaccaacaaaactctcacccgtcttcccctcccgcaacatgcccaccaagacatgttcatccatcaggagccctgctctttaacctccaactttctcatcataattaattactcgttcctctctgttctcctagcgtttcttcacacatctgcttacccatttttgtaagtcctcctaacacaatattataaggcactagatgctcaatcaatatttattagtttaaagctaccagctttagggggactcggttttaaatagatgagaagtgataaaacacctggagatagtactgtcagctgagataacatgtcatagaaccagctgctcagcataattgaaatttcattcggattatatgggcctactttacacccatcttactatggtaaatgagatcatgctcattaagcattaggacactacttggttagcgcatctaggaaacataaccagaaatatcaaagaaatggcccagtaaaatataagggattgagactctctggttaatataccatggaactaaccccccttttttttctttatcattgataaattttgttcttacttatactcaaattgtttgttttccaaggttcagtctgaacctagtgatatttatttcatactcttggagaattaatactgttacatatcttcaactacccttttcatgaatcttgtctgccaagacaagctcggtcatggagaccctaacccagtggcgctagaggaattaaagacacacacagaaatatagagtgtggagtgggaaatgaggggtctcacagccttcagagctgagagccttgaacagagatttacccacttatttattgacagcaagccagtgataagatttactgaaagtattccttacgggaaataaagggatgggccgaaataaagggatgggctctggctagttatctgcagcatgaacatgtccttaaggcacagatcgctcatgctattgttttctgccctgggtgggccaggtgttccttgccctcattccagtaaactgacaaccttccagcgtgggcgtcaaggccatcatgagcatgtcacagtgctgcagagattttgttcatggccagttttggggccagtttatggccagatttgggggcctgttcccaacacttgtcaaaatctgtcttcccattccaaattcttttccattattgaaatatcattgtttctgttggaaatatttttccaagtagatgtcttattatcatcttaaatacagatcatccaaaacagaagtcatctgaaactttcctaatttttcctttcaatcataaatatgaagccttaagaacaattaataatgcatgatccttaacctcatggaacatcaatcagttgataaaaaaacagccaaacaactaaaaataatacaaggacttatatattcatatgtgtatgtgttaggaattgtaagaactcagactagagttgagcaatttcttaacagaggcagtagaattcttagtcactccagccatcacaccctgcaagttgatctcaccatcagtctgctgctcattcctacttcctctactctgttcctttcctttctgaatctttctcatcctttattgtccaatttaagccccatgttaaatacagtgagttctaaatttctcttcaaagaatcagtatgtcagtatgttcagttctttgttctccactttaaagtttaacctcatctccttgcccctagtttcagtaaacaaccttttccaccagttccaatcagtagttcacatctattcccctggtcacctgctctgtcctgagtcacccctggtcatctgctctgacctgcatcacctttaatcgcctgttctgtaaccgtccttcccactgaaactgctcaccccgccactgtggttcatacccctgctttctttaaaacagccagttggaattagcttagactgtgcagtccaaccctagccaataggggaacgacatagcagtagggactacctgcgtcagagataagaaccccttcctctcccttgatcaggtatgctctcaccattgctccatctgcgagacacacctttctatagaagcaaaattgccttgatgagaaaattcatgttcgagtgctatttcttttgctgcaccgaaaatttatttctaatacccaccacctctaggaaataccttctaccattcacagtctcttcccacctcaggaccgttagaacattcagtatctccaccataaactcattttatacttcaacattcaacatttaacaaacatgtacaatgtatatgtcatgtgaaacgttttctcatttaaatcttttgtatccatgttttataatttcttcccaactagttcttcccactgaatttatttctttctctcccgcatccttgtcaaatcttttctattcttcaaactcaaagactttttgtttaatccattaagctgtatattagaatacagattttccaggcatatactatactgaccaagttaccatctctaggagcaggcccctagtctgcatctccagaggtagggcccaagaacctgtttctaccaaagatcccatatgatgattaggcagcaagcccagtgtcatattcagactttcttgtaaaccattgctgtacaacttctagcccaatgctttgcttgtgataagattcttaataaaatgtgtgttattgcatcagtcagtagtcaacttagtgaaatgtttagtaaaagaacctcaggccgggcacggtggctcacacctgtaatcccagcaatttgggaggctgagatgggcagtgggcagatcacaaggtcaggagtttgagaccagcttggccaacatggtgaaaccacatctctactaaaaatacaaaaaattagccaggtgtggcggtgtgcatctgaaatcctagctactcaggaggctgaggaaggagaatcacttgaacctgggaggcggaggttgcagtgagccgagatcgcgccattgcactccagcctgggtgatagagtaagactccctctcaaaaaacaaaaaaaagaacctcatacttgcatgaatacagtggcctctatcttttcatattgccacccaccctagaaatgaagaacatattcatctccacagtgtttagcaggtcattctgctcagaagaattgactcctcttcagtgactccccagtgcctaaaagataaactccaaattcatgaacttcacagttgatgttttctacaataacatctccaagctttgcctctataattttcttatacaaacctactaaacgttttgctttccctcttctgtattcctactcttacccaattgttcagactgtttctctgttcgtaatttcctatttctttccctcccacatcctagtcaaatcttttctattcttcagaatttcatgtttgcattaagcttcccttgaccattgcaaccatctgtatttttctcatctcctattttatgaagcacttctatcatttttcttttttatccttattttctctgtgacttttaaaatttaataacatgtacattgttaatatttagcattacatttaagtttattgtttctaatttatcttatttttaaatttaaaaattaagctatcttgaagtagaaatcattaacagttgtattctagaaaccaagtatgtcagtgcttttgcatatagtaaatgcccagtaaatttttgtgtaatggagaatgacgatttttattatgtggtctttcatcttcttagacagtaatagtaacttttgatccctcaggaggactcttgaaactaaagaagaccctttccaaagcagttctgataatatattctatccacagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggtgcacaggggatgggagatctaagacctccataatggataaagttccacggtgggaggagaggcccgagattgcatatctagcttgcaggagctgttggttcagtgtgcatttatgtctcctttcctgtctgtttgattccacactacattttacaattaaatcagactcgattcttccttccccagttttgcatttctatgggagtttctctttgttgttagaagacgtttaacacagggattcttttataagcccaaatgtactttatttttctcaggttcaagcccatgaacatggacaagaaatattccagaaaaaagtgtcacctcctggaccagcacttaatgtcaagttacagccagtggagaccaaggcccattttgattcatcagaaccccagctcctatgggactgtggtgaggggcagaatgccatatagtgcacatcactaaagaaacaggggaatgaatctccctccacaaactagtcttggtaactgtagatggtcctttcctttattacccaatgaaaagagagaacttgtggccaggtgcggtggctcactcctgtaatcccagcactttgggaggccaaggcaggtggatcacgaggtcaggagatcaagaccatcctggctaacatggtgaaaccccatctctactaaaaatacaaaaaattagccgtagcacctgtagtcccagctactcggaaggctgaggcaggagaatggcgtgaacctgggaggcggagcttgcagtgagctgagactgcgccactgcactccagcctgggcgacagagcaagactccatctcataaaggaaaaaaaaaagagagagagaacttgttttcctgtgagtctttggccaatggtaggggaaaagataattttgttccttatccagaatatttccaaaacacagaacatttttatgatatgaccaaattaaaggaaataaaagtgaatgagttgagaaaatatcatgaaaagagaaaagaaggaaaagaaaaagaaatacatggacagaagcaaaatatgttcatagagaagtacatataatgatcaagagaaacagatacatgatgatatactgagaaatagtatataattcacaagtaacatagaccgtgatccatatttttcctgttatgctcttggtcttataaagctcttttacacttttatagaaagttagctatagttctagagactacttccacagaatactcatctctgttctaaaactcatctatttaaaagattcatagatgcagtatcacttaaggtgtgaattgtccctatagtaaacccaagaataacttaccgttaattttttggtttgtttgttttgttttgttttgtttttcctgacacagagtcttgctctgtcacctaggctggagtgcagtggcgtgatctcagctcactgcaacctccacctcctgggttcaagcaattatcctgcctcagcctcccgagtagctgagattacatgtgcctgccaccatgcccggctaatttttgtatttttagtagagacggggtttcaccatgttggccaggctggtctcaaactcctgacttcgtgatccgcccgccttggcctcccagagtgctgggattacagacatgagccacggagcctggccacaattaatttttaataaatttctacatattctgccttcagttttgttctggaaacatctccatctgtcgtatataaaattgtaaatttccctcaccccatgaacagcactccctaaccctctttcctgccctagcgtattgtagacaaaggacagcttataataaagaagggcggttcaattccagcacagtatagagtgggatttgtgaagactggatcataaatggatcttggaaaccaggcttgggaatttagacttgaacaaaaaaagagagagagagattcaaggtttttgagtagggtatgaaaggatggcagtgtttaatgaccattagtctagtaaggatctttaggataactaggaagaagaaaagtgcagagtcaaaacagcaaggaggcagttaaagtctagataggaaatggtaaggttcgagactatggcgatggtagcagaaatataaaggaagggatttatacaagggacacttagtggacagtgatgacagaatttagaagactgattaaccatggaatatgaggaagaaatagacaataggtggatggaagttttctcacacatacttcacagtcacttatagctttacttttctctcttgtgttctcatctgctttctttgaggtagtgcctccattttccctctagaaatgtatcatagacccaaggttcccaagatctgctgcagtcaacattgtagagttccttctccgtactctatctccccctatctcttgagttcttgctgatgacaatcctcccaatcttttctaatatatatgcttcacgtctgattcctctctctgccaaccactgcaggcattacttgctcttaccaatgtttctttcattcctatcatcctctttcattctatcattcctctcatgtgaaaggtcatatattaaagtgggcatatcaatatgtaactatcttgagcatgctataaaattttcttttcgtgcagcaaacaggtaatatttccctttcttttttattttagataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactgaaagaccagtttctggtgttcaatctgtgtgtatgtgctttctgtgagactggggatgtaccccttctttcattgactactaaagtcaaaccaaaagagctacatttaggggggctaatagggtagtctatggcagtgcaatgtagagaaatagagactgtctggggaaataatcatgattacagtgtgggaagaaaaggaagatttaggtaaagagactgataatcagtcctagtttattttcctagttagtttagcacaagaagaggtcagctaaacccaggagtgaaataggttgcacagtgcactgcagaacagtgttttcagagcatccctttaaaaactgaagaccacaaaactaagatgctcatgttaagttagagagtaatgtcaaatgaggacatatgtaatggtggcattcctatatgaggccaaaatctgtgtccagaggtcataccaggaagtaaaaaaccagaagaacaccccagggaagaggccagaatccagacatttaagtaagacagtaagagaatagaattgaattaaggaaaaattgggttaggagtgagaaaaggtgttcaaattgaactaaacctcagaagttggaggatagacacaggataaccaggcttttactggtttttggcacctttctggggtaagttgatagggactataaggagttctcctaacagaaactgacagtaacagaaactgacaggattctccggcccgtggcaattgtggaagattactgaggaagttagtactggaaataatggtcctgaaatgttatttcgttgttgctggctgctctctacaaaaaagactgagaagagagtatagagcgatagtatatgaaagagggtagggaggaatgatttaagtcttaaacattccacagtatgtaaggcttttacattataaaatgtaaacaggaccttgatgttagatgtatgataatctaatgtgaaatgtacaaaatctcccactaagaggctttataagaaatagcttagcatttattttcaatgactttaaaaatgtcctgacgggatctaagtaacacaatatttggattgttttttaaggtaatgttgagcccacagttttttacaggtagtgtgctagtatgtcctatctcattttgtaactattatttttcacattttatagatgagaaaattgagctgtagtgaagttaactatcttgctaaagatcacatagtaagtggtagaaccaggattttaacgcacattttattccagggccctagttcttaatgcttaaacttgattatgtcactgaaaatattcctatgggatataacatcagaaaagatagcgcttgtacaccacaactctaaagttggtggcgggggaaacggggagacctagcacccttctagaagattaatccaccaacatttcaaaatcttgtaaggagctgcgacccgctaggacgggagcctactgcgccctcaaaccccgcggcggctccctccccggagggggcgcgtgaggccaccacccagagcctcttcctagaggagccggaagcatcgggagccgcggtacccgcccatcttccggccaggatgtgtggtcctggtgagcgattgtcctgtggcgtccgggaccgagtttgtggcccagggttatgtgtgcacttcacacctctgacttttttcagggttcctattgatggttaggagcaggatttcggggatgaaggcggcagcagcaagaggaggctgcgactgcggaccccagattcgtccccctccaccacacacaacgccaagacgggccccaggagggcgtgaagagaagacttcctttcctctcctctcgcctcctggcgctggccgtatgaaggtgtctcccagaagcattagcagaggagccctgtgggagaaatgaggtgtatagtcacacttaaatctgtttatgctgtcattgaacctctaaacacaattggatcattttctaatgatcagaagt

SEQ ID NO: 15713 - DNA, 12129 bp, Human
atccttaacctttttggttgattttgcagtcagtatttcttgtctttgagttggtgtggcattttcaatattcagtacggattcccagttatatgttaaaaataatcccttctgtcccaggatactcatcaaagtactgctatagtggaatcttcccggaaacagacaaatgaaagccagtctctctcagggctaaccattgtgaagtccaacgtgctgcccacttgactctgggctggagcctgcctgagccctatagttgacccacttagcaagcacatataaaccagtgagagaccctaaccaactgccagtgagacatttaagaagtttcatacaaatattaaattgcatttacttgtcacagatggtcatacaaaatggaaaagaataacatatttaaacagtctattcaagtccaagagaaattgagcatttactctcatttcatagtttgttaggaaagtttgtaatgagggatttgcaagtgaacatggtatggtggaaaaagtgatgaggatttttgagcaaattttctgcatgttagtgctcttattgattatatacttattggatatttgaaagaaaaagaagtaaagcataaagcttgggtttatttaatgccctcagaaggctaggttgaggaaaataataaagaaattttccgagctactaccgttttggagttaaaacagatcatggagcctccattaacacacaagatactttcttactgctttaataaaataaatgataagattctgttaaaacaaacagaatatagtttaatctacgtgacaccatcattctggttggcatagtaaaactgatgaatgactaacagtacctacaattacgctcttttgtaccaataaaatttatttaaggctgggcatggtggctcatgcctgtaccagcactttgccaggcggaggtgggaggatcacttgaggtcaggagttagagaccagcctggccaacaaagcgagaccctggtctctacccccctcccccaaaaaaaatgctgggcatggtggtatgtgactgtagtcccagctactcaggaggctgaggcaggattgcttgagccaggagttgcagtctgcagtgagctatgatggtgccactgcactccagcctgggtgacaaatttatttaattggttttggtttgattttgtattattattactaaaactccagaaaacttttacagcaaaaaaaaaaaaaaacaaaaaacaaaaacaagaaagaaagaaaaggaaaggaggatgggagaaaggcaggaagggagggaggaaggtaggaaaagaggaagggagggaggaaagaaggcaagcacgcaggcagatgcctaaataaagaatacataggggcctggacaaataaattgctttatggactgttatgcacccatacaataagttagacttacatgatgagtaaagctttttaggatacatgaagtgaaaacgttaaaataagcgggggagaaaaggctaaatataaaataatgccattgtgtgtgtgagagaggatcacaatgatatacaaattccaggctaacggtgacagtggctgcctcggggagtgggactaaggaggggtaggtggggtttgacattttactttattaattttggtattgtctgagggtttttaaaccataaataatgtattaattttaaaaatgcttttaaaaatcatcattttcaatagttaacggtctatgcttcatcaacgttttccgtttaaaacctgtgtgcggcccacacacgtatgacattctgattatgtgattcactgctgaaaaagaactggacgccaggaaattgggggttgagtccgaagcaaggtgaacgccggacatcgagacatggaatcctagaccggcccggaagtgcctctgctccgtccgccttcgaggagaggtcggcatctttgttccctgcccggccattgttcgtgccgcgcttctagcaacgccgggccggtaaccccctctccctccttgcgcgttccgggtctcgtgagttggctgtggggaccgggaatggaggcgggtcagggagggtggggctggaaaaggggtgtggaaagtgaacctcagccgctgggaagtgggagccggaggagggggcggcggtcagtgccgggcggcttcgggcgtcccctagaccagagtggtcatccccagctgtggggacattgtacaagaaagggttgtaggaggactgcgaggctgaagggtcacctcggtgaataacgacaacaggcttaggactcagggaaagaaacacccgggagaggaagttaaggacaattaagactttggcagccttcacgatggagaacctgtataccctcttacctctagattctgaaagcaaattaaggggcgttgaatggactggttttcaagcgcagaatgtagcagttcccgattcccttttccttagttcattgattctcaaaccttataatacatacaaatcactgaggagcccgttaaagggcatattctgggtctccctgtacttctctccacctcccaattcagattccccagatgtctgccatagggcctttcaagctggaattcagctgctgcgctgtgcttcctggcattttggagacacacattttgggaacacccccatgggtttcaggtgcttcctgcgtctgtggagaaaacttttcccttgggcttctttggcttcttaggattgtcctcaaaaagaagttgaccttgggcaatctacttaactttccctggcttccatttcttatctagtgaaataattattataataaaacctcagtgggtaattgtgaggatgaaatatagtcttgtatctgaaagcatattgtagacttgtgcagtgttgactgttattcttcagtagcagcagggcggtgtggaaagctccaggacttggaatccacctaagcctttctttctgtaaatttagtgaaaataatactaaccttaaatggttgttttgaagattaagaaaactgaagtaaatagtaaagtaaatgttggttcgttcatttagtcgacagtaacaatatttccatttattctttctctaagttgatgtttatacagtgagttcaaactttttattcagactttctgagtgatcggtgcagtccctaattcatgggctgttttcctccatgaactctgtgaagcattattgctatttcttcttcacataaagaaatcaagattgaaagaagatttaaaaacttggcacaaggtcacacaactagtaaatattaggatcagaataaaacctaggtctgggtcagctgtggtggctgacgtaatcccagcactttgggaagccaaggtgggaggatcacttaaacccaggagtttgaggttgcagtgagctgtgattatgccactgcactccagcctgggaaacagagtgaaattccccatttaaaaaaaaaagaaagaaagaaaacccatatctgggtaacttaaaagcttatgctcttagcacattatgaatatatatatttccattatttccatcctttggtcaccaaatcacttttcagagaagagctttagggcctatgataattgcttgtattatcagtttctgtcatcagctattatcatttttctatataaataatttatttttactgcttaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgaggtaggaagggagatttgctagagaaaaatgtgtattttggcatgccaagaatccttgtcacttctgctttgtgtctccttgacattggtgataaaatactctcttcctgtttccttctttcttggaagtgtttatttcagacagttaatttcttcaaaagtcaaatcttgtctttttgtccccagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttaccagatagcagtaatggtcagttcttctgagagcctagtgtgctcatctttgacccttctccctgcgtgcagacttctccctgagtaccaccctggaagctttctggacttctgatgcatggtacatgaggaaggctttcagggatcgctgtggagcacagcttcagagaatggacttcaaggtttgacagacaggttcagatcctggcatcgcctcatggaagctgcttgtattgggcagattacttaaccacttgacctcagatccctcatctacaaaatggggttgataatagctttggtttagtctacttgcgctgccttaagagaataccacagactggttgtctttaacagaaatttattttctcacattttcaaaggctagtagtccaagatcaagataccatcaggtttggtttctggtgaggcctcttcctggcttatagatggccatcttcttgctgtatcctcacatggcctttcttctgtatgcatacagagagagagcaagctctctcatcttataaggacagataccattcctacccgatagggcccttccttataacctcatttaacttttaataccttcctcaaggccctatctccaaatataatcatattgaggggttaggacctcagcatatgtgagggaatacaatttagtccgtaaccagtatgtacctcagaaagtcattgtgagtatcaaatacaatttatgaaaagcacttggcatgcattatgcttaatacatggtcactattgtcacaaatcaccagtgccacccttgctgatttgggttcatacttggagtagaaagatatcagatatgcttagtaagtggcagaactgtatgggagaatccagtgaaatcagactttgccatttccttctctgtaatcttctgagtggtggcagtgaccacccttgtggatatagtactgagcacttgggactgagtcagctgctttcccattctagccctccctgcaggaattggctctagcttgtctgatttcccacacataaaatcatgccctcttactgactttttgttaatgttctgacaatcaatctgtagcaaggttctactgttttcagtttcatattacccctatatgcatcaaagctgcaacttcccttgcctctttgtccctaggttctgtttatttcatttaccctagcaattatggatttctattacatggaactcatctcttgatttaaattaaagtgtatgtgttgagtaaattctgtgcagaccttcttatagcttctgtgactttatcagattaaaattgcttctgatatcattttccctctttatgagcatctttccagtcaatttgtttctttcttcttcctctctctatgaacttggaccttttattttctagccacttcctttcttctaccttccaaactgcatctagaaccctgctgagtatccccttttccaagaagcacatctatattttccacctatccacttatctatccatctatcattcaacaagtgtttattaagcatctactatggctgtaggagaatatccagagggcatctggagactggagtgttctccttgtaggatatcagcgcaggtatgtgttacaaatttagataaagccaatattataaaacaacatagtgtttgaaattacaaggaccaaattcaagttccagcttttcaaattcttagccaagcaatatttaataggtaagcttgagtttctttttaagttatgctgattatttaaaaatccaaataatacaaaagtttatatagtaaaaaatggaagttttccaaatcctactccctagaggtagctactcttgtcactttgctgcatattttgcagacgtttctctatatagtctgtctacccatatatatgtatcttcccatatttttctttttttttttttttgagacagagtctcgctctgtcgcccaggctggaatgcagtggcacgatctcggctcactgcaagctccgcctcccgggttcatgccattcttctgtctgagcctcccaagtagctgggactacaggcacccgccaccatgcccggctaatgttttgtatttttaatagagacagggtttcactgtgttagccaggatggtctcgatctcctgacctcgtgattcgcccgcctcggcctcccgaagtgctgggattacaggcgtgagtcacagcgcctggcccatatttttctatagttctttaaagagatgggataataacatcgagttttgtggtgagtcagtttgataatatatctgaaagtgcttcataagtcatgaaagttgtataaatggtaatcattaaaaggtgggaaatgtctgaatttttatattctacccagctcccttatggatttcagatttaatacgaagtttgaggagaagggcagtactgatcccacttggggcccatctgttctctacagacacatttttattttccaaacctgttgtgatcccccagctaaaaggaggaggagaaacatggcctaacaacagaggagtcctaagaggtacctattcttgtatgtgagagacaggacagttagatatgggagaaagaggcaaatattttggtcaaaagaggaggcctgggtctgttgtcctcggcctttttctgggttgcaaagtgaaatcagactatgtgccaggcatgtttctcaggaataaaacagaaggttcctcctctcgtagagattagattgtagcaagagggagataataataaatataaaagtaaagaaatgatacagtgtgttaaaaggtgatgaggctatggaataaggcaaaaatagaacaggataagggagattaagagtgctacggatgaggcaaacagattgtgatattaaatagaagaattaagatagacctcattgagaaggtgagttgaacaaagacttaaaggaagcgagagagtgggccttgctttcatttgaggtgagaagtttccaggaagagagaagcactagagcaaaggtcttatgatgggaatgcaccttggataattgtggatttgaaattcataaagtatagtagtcctcactattcaagggggatacattccaagacccccagtagatgcctgaaaccaagggtaatactgaaccctgtatatactatttttttcctatacatacctaagataaagtttaatttataaattaggcatagtaagagattaacaacaataactaataataaaatggaacaattacaattataataatatgccagcctcactacttttgcactttggggccattattaagtaaaataaggggtatgtaaacacaagcactgagacactgcaacagtcaatctcataaccaagatggctactatgtgtgcaacaggcaggcagcatgtacagtgtggatatgctggacaaaaggaagactcatgtcctgggtgagacagagccagatggcatgagatttcatcatactactcagaatggtgccaaatttaaaacttaagaattgtttgtgctgggcgtggtggctcacgcctgtaatcccagcactttgggaggccaaggcggatggatcatgaggccaggagtttgagaccagcctggccagcatgacgaaatctcatctctactaaaaatacaaacaaacaaaaaattagccaggcatggtgatgtgtgcctgtagtcccagctactcgggaggctgaggcaggagaatcgcttgaatccgggaagcggagattacagtgagccaaggggcaacagagtgagactccgtctcaaaaaaaaaaaaaaaaaattgtttgcctctggaatcttccatgtagtatatttgaactgtgattgactgtgggtagctgaaactttgtaaaggcaaaaccacagataagtggggactactggactgcctgaagcacctaagtagtagaagtttaatacttgttctgaaaatgaatgaatgaatacatgaagtaactttccttggaaagggtcactttgaggttatctcagaaaggagagagaggtgtaagggaatactccagagaagccaccctaatctttaaccatccctccctatgaagtataaaaaaggtactgccagctgggtgcagtggctcacacctgtaatcgcagcattttgggaggccgaggtgggtggatcacctgaggtcaggagttcaagaccaggatggccaacatggcgaaaccgcgtctgtactaaaaatacaaaattagttgggcgtgggggtgcgtgcctgtagtttcaactacttgggagactgaggcaggagaatcgcttgaacctgggaaatggaggctgcagtgagctgagatcacaccattgcactccagcctgggctacagagtgacactctggctcaaaaaacaaaacaaaaaacaacgactcaggccaagtctacatggggatggactgacctgcattatgccaaagagggcaaacgttcctccctacgtaggggaaagtgttaccacactagcccttctgtttctagcccacttccttttctatgatatatttttatagacatagtcaccttcccataggctcagggaacaagtgacatttacctagcctttttctttgtttcagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaagatttggtatctgtgtttaactacaaaggataacagagttctactgatggtttataacaattgggtctttggtgttccctgtgaccagggtctacactataaacaccttttctaccttactgcttctctctgacacctacgtgactctcccttggaaagtgaccagcattggctgtgtgtttcagtgtctgcagtgtgtgtccgcttacttaaccatagttggtcctcacaacagccacacagggaaatgagcgttatcattatcgcattttacagatgaggactccaaggcttagaaaatccaagcatcagagccaaggctgaaaccctgaacttttatttttagtaatgctttaattttggaataatatttgacttacagaaatgttgcagagatggagttctcatattcccttcacctagattctcctaatgttaacttgtaacatcacacctttttagttaaaccttggcttttaactccaaatctcaatttctttatgatgtcaagctttgtactgataccagatttctacattttagtcacctggaactcccttagagtttttctatcacatcttcagtgttagaaagtcatctgtatcctgagtaccaggccacatcagagaactggattaatccaggtaagatgctagctactgtctgaaatgtcctcagtctttctcttctgtttgcttggcttaggtctagagaaaaaaatttcttccctgtgtagatctttaagaaaatcaattgtacgccaggtgtggtggtacaagcctgtaatcccagagcttttggaggccaaggccacagtattgcttgaggccaggagttcgagaccagtctgtgcaacatagtgagaccctgttgctacaaagaaaaaattttaaaattagctgcgtgtggtggtgtgtgcctgtagtccccagataggaggttgaggtgagaggatcacttaaacccaggagtttgagatgcagtgatcatgccactgcactccagcctggccacagagagagaccccgtctcaaaacaaaacaaaacaaacccagaaacgttgtctcaaaaaaaaaaaaatcaattatgctgcctccatcaaaaaatttaaaaaggaagaaaatttttttaaaaactggagaagacttacgtcgccttaagtgttctgccccagaggaagctctttctcagtgaagtttactcatggagaggaggaatctccctttcttaggactaaagacttgaggcttgaggtttcccaaggctctttgcctgccctcccttactcccttttatgattactaaggctgcaaccccatctcttccctttatgtatttgatttaaatgttcagaggtttcctgagagatggaaaagaagtgctgcaatttgctcaggatgagtccatacacagttgagttttgcactgttttcagtaactcctaaatgtgttgcagagcagtcaactcttgaattggggattatgtaatttaactcttttatgtaagattcaaacagaagtggaatagcatagtgaaccccatgaacttgttgacgaaaagagtcaaactccataaaatatttgaagagacttactctgagccaaatacaattgaccatggcctatgacacagccctcaagggggtcctgagaacatgtgaccaaggtggtcagggtacagcttggttttatatattttagggaggcatgaaacatcaaccaaatacatttaagaaatagattggtttggttcagaaaggcgggacaaatcaaagcgtgggcttccaagctgtaggtagatttaaacattttctgcttgacaattggttgagtttatctgaagacctgggattaatggaaaggaatgtttaggctaaggtaaaggattgtggagatcaagttttattgtgcagaggaatctctcaggtagcagacttcagagagagagcagattgtaaaatgtttcttttttcttgtttc

SEQ ID NO: 15714 - DNA, 38343 bp, Human
  misc_feature (1)...(38343): n = A,T,C or G
catgttccattccttcagaccactaactccttttatctagggtcttcatgtgttgtctgcaggagagaaggaccgaaactgttttgttttgttttgttttgtttgagtcagattcttgctctgtcgcccatgctggagtgcagtggtgccatctcggctcactgcaacctccacttcccgggttcaagaggttttcccatctcagcctcccgagtagttgggactacaggtacccatcaccaagcccagctaatttttgtagtatttttagtagagatggcttttcaccatgttggccaggctggtgtccaacccctgacctcaagtgatccacttgcttcagtctcccaaagtgctggattacaagcgtgagagactgcaccaggccccaagactgtttttactaccactgtatttctagtgcctggtacaacacattgtaagtgtcagtaaacatatgttggataaaattttaaaatgcatgtttattttctcagtccctactatgcagcaaatcctatgctgggccctaaaggggaaccaaggttagtaagagaaatgcttgaccttaaggaactccatgccagttagaagcaatggatccgtaaaccaaaagtatctgagaccagtctcaatcgagaaagtttatattgccaaggtgaaggatgcgatgataacacggcctcaggagctcctcaggacatgtgcccaaggtgcgggtacagtttggttttatacattttagggagacatgagtcatcgatcaatacatgtaagatgtacgttggttaggatcggaaagacgggctaactcggggcagtggggggcttctaccttataggtagacttaaagattttttgattggtaattggttgaaagagttattatctaaagacctggaagtaaatagaaagaaatatctgggttatgattataaggggttgtggagaccaaggttttatcatgcagatgaggcttccaggtagcctgctattcagacagaatagattgtaaatatttcttatcagtcttgagtctaccagtcttaaggtctctgtgttgatgtttgtgaggcatgtctgactaccacttcccatcatggcctgaactagtttttcaggataaattggaatgtccttggcttcagatagggtccaccagtcagttggggggcttagacttttatttttggtttacagatatcacatggactatagagacacatttctgtaacagagtagaaatgcaacatgagaagaacaaagtgctttaggcgacaagcggaggagggagacatcaatcccagatgggaaaaatcaattcactttctttttgtgtgtggtgttacttatttatttattttttgcagggaagggatcgattcattcaacgtacaccttgaatgaataactatagttctccctacgtcctatgcactgtcctaagtgttttacgtggttaaggacactaagattttacagatggggaaaacaatgcacacgacagtcaagtgacccgctcaacgtcacacagctactaagtggtagaaaaggcagttgaacccaggctgcttggctccagagtctaatatcacggggaaaacctcacgggagacgtggcaacgaagttgtgcttcattgaagtatctgtccaggtggaaaaccgcagggcctctctagcaaaatccagaaccagaaaatacttgcttaattatgagtttccttccttcttttgcccactatccccatttaacctgcggagggatttcacaagtgcagtgaataaagatgcaggggactatggaacactaatttccggctacggcgaattcaggctgtttccatggaaacagtaacgggtgggcagctaggtatagtctcgcggtgcttgaaccagcggaagtgacgtcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtaacgccctaggccgccgggctgggcatgggcgggtaccgggaactggcctggatccccaggcgccagcacggacggctggaacagcccttttagtcctgagactcttctccggggccgggcttggggttgcggcgtttagatcagggcaggatcgagcgcggccgagtgtaggcagccccctcgcgctccgctgtcctcgccggccggcctcccctccctcgggccgccgggagccccctccccccggcctgggccccttccaccgggcgctttgcttgacagtttgggggcgtgacttccgccaggagccatctcgggcgactattggttccttctgtctctcttgccttcggtgattggcgcaccgccatgtcatctttgccgccgatccgcagcttgctgactaggccgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcgtaggactccatttcttcttctttgtttttttttagccgaggctggagtgcagtggcgcgatctcggctcactgcaacctcagcctcccggcttcaagcgattctcctgtctcagcctcccgagtagctgagattacaggcgcccgccagctcacacggctttttttttttttgagacggagtctcactgtctcccaggctggagtgcagtggcgcggtctcggctcacctcaaccttcgccttcgaggttcaagcgattctcctgtctcagcctcccgagtagctgggattacaggcgcctgcccggctaatttttgtatttttagtagagacagggtttcaccatgttggcctggctggtctcgaaccttgatctcaggtgatccactggcctcggcctcccaaagtgctgggattacaggcatgagccaccgcggccagcccacgcggctaattttttcgtatttttaatagagatggggtttttaccatgttggccaagctggtttcgaactcctcacctgaagtgatccgcccacctcggcctcccaaagtgctaggattacaggcgtgagccactgcgcccggccaggactccatttctaggggtagaattgtgatgattttactcgcactttccaggttgtttggttcattcattgcgtatgaatgtaccgaattctggacctgaaattcgaatgattagatgctggctgtgaaggcccttttaactatcccgtgcttcagtttcttcgtctgcaaaataagtccctagtttatgtagagttgtgaagattcaatgagagaaaccatgtaaaagcagttggaacagtgcctgtcataaggggtgcaataaatatagctgcaaattattgttaccgtcattaattgcaaagttctaggagctgcttgaccttggacaaataacctttaatctctgagtcttttgcatctccattgtaaaaatggaggggtgcttttacctcactggtgtaagacaaatggtctgatatggagctgcacttaataagaattcttcctctttttcctttttattaatagaaatgaggttcacagggaaggcacaggcttgccttttctatgaataaaggaaccactggtttgttaatttattcgacaaatacttagtgttctccttcctggggtgtagtgtagttagaagcttcaggttgaaatcctgtcgcggtcacttcttgggtgaaccacttaatttccctgggccaattttcttaattacaaaacagaactagggctgttgtggtcttcaggttataggatgctataggaacagtctgctagacagagataaatatggtaactttcattgctgtcggctactgtgcctcacactcactggataggaaatctttgagtttcaggccaggcgcagtggctcactcctgtaattccagcactttgggaggccgaggcgggcggatcatctgaggtcaggagttcaagaccaccctggccaacatggtgaaaccctgtctctactaaaaatgcaaaattagccaggcatggtggcgggcgcctgtaatctcagctactcgggaggctgaggcaggagaatggcatgaacctgggaggtggagcttgcagtgagccaagatcgcgccactgccctccagtctgggtgacagagcaagactccgtctcaaaaaaaaaaaaaagaaaaaaaagaattttattggccacatctctggttacactgatttcaaatgcactctgtgacacttaaactttttttttttactctgcccttggccctgcactaattaattatctggtgatttcatagtgacccagcttttatttcagtctcaactgggcactgattgttaactagtagagaactaatggattgcaatgcttatttctgggtgttacaaattattgttaatatatttagagtaatggtttacaaaggcaaattattcaactagaagttacttcatacctaccagtgagatctgtaatacaatgatgatgagttggtatttcccagttaaatctgtgtgatctcaagaggtgacacctaataagatcacagctgttttattcttgttttgtaatgcatgtataataatgatacatttcctttgctttcagtaaaatgtatcaaattgaaaagtgttaaattatcaaaagtacctagctatagtcacttgtattttaagcattatactatgttgtattcttttagtaaggaaaagattatgcagttgctctgtagaaatagagaagttggaaacttgaggttaatgcccatggacttaaatatatcctcactgttaccagaaagacagagtgtgaccatggtatctgtcatgacagtaattgtcaaaattgatgggtctacttaaaggtaccaattcaggcctaattttttttttcccccgaaacggagtcttgctctgttgcccaggctggagtacagtggcgcaatctcagctcactgcagcctccatctcccgggttcaaggattgtcccaggttaaaggattctcccacctcagcctcccgagtagctgggattacaggtgtgtgccaccacacccagctaatttttgtatttttagtggagacagggtttcaccatgttggccagcctggtcttgaactcctgacctcgagatatctgcccaccttatcctcccaaagtgctgggattacaggtgtgagccagcctggtcttgaactcctgacctcgagagatctgcccaccttatcctcccaaagtgctgggattacaggtgtgagccacagcacccggctgaggcctaattattaatagattctgtaccttagttgttaaaatgtagcattgcaggctgagtgtggtggctcatgcctctaatcccagcactttgggaggccaaggtgggaggattgcttgagcccaggagttagagaccagactgggcaacatagtgagacccctgtctctgcaaaaaacttaaaaaataagatgggcatggtgacgtacacctgtagttccagctactcgggaggctaaggtgggaggattgcttgagcccaggagatggaggctgcgttgagctgtgatcacaccactgcactgcagcctgagcgacagaatgagaccctgtctcaaaaaacaaaacaaaacaaacatagtattgcagtataggggaaaaatagatcaattaggagattaattcaacaagtagctgcttgatgaactgctaagcaggtgatgtattctagagctggagaaagggacaatccctccacctgagtttactgaaatacctaaccactacagtcccatgcgaggcagagagggcagatacccagcttagccatggggaagggagctgagatgagggtctagagacgccacaagttgattgctgaatgctggatgaggctcagtcaggtagcagaggatgtgggggagaaggacagagaacagcatgtgtagaagcataaagaggagagaagatagaatgttgattttctgagcttgctgtgatcgaagagtaggtgtgtgaggggaagtagcaggagataaggctggaaaggtagcagggaccagttattgaagggccttagttcaggctgaggcgtttgcacttcttaaagtcattggaataacttgattgaatgcacagtttatagaacagacagtactaatatggagtgcgggttggaggagagaaagatcacagtaggcagaccatttagaagatttatgatgtaggctgggcgcggtggatcatgaggtcaggagttcaagaccagcctggccaagaaggtgaaacccccgtctctactaaaaatacaaaaaaattagccaggtgcagtggcaggcgcctgtaatcccagctatttgggaggctgaggcaggagaattgcttgaacttggagggcggaggttgtagtgaaccgagattgcgccactgcactccagcctgggcgacacagtgaaactccatcttaaaaaaaaaaaaaagatgtagtccagacaaaaaatgatgaggatctgaattagggcagagaggggagagagaaagaaatggagctgagagactttggaagtaaaactaaatcatttggatgcagagagctgttaatagtaacatgtgcatttctggcttgggagactagaaaacagaatagagaaaaaggtgaaacattcagggtcagagagaagtgggaggtccagtgtaatctctaattcgttttgagaccacggacaggttgtttcactcctctggtccttctggatcctcatccgaagtgaaggagattaagaatcaattttgggaacttcaggctctgaagtacaaagttgtggttagagttccatcagtttggttagtgctgtagctgaaatgcaatagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactgtgcacttcctggctttatttttatttatttatttatattttttgagatggagtttcgctctgtcacccaggctggagtgcagtggcacattcttggcacactgcaagctccgcctcccgggttcactccattctcttgcctcagcctcttgagtagctgggactacaggcactcgccacccgccccagctaatttttgtatttttagtagagacagggtttcaccatgttagccaggatgatctcgatctcctgacctcttggtccgcccaccttggcctcccaaaatgctgggattacaggcgtgagccaccacgcccagccctggctttatttttatttatttatttattttttggtgtagaaagtaaaccattgtaaataacattgagctcttttgcaaaactaaagttatggcagttacagtttattgattccagctaataattgcttgttatattttgttcaactttatcatttttaaaaactcttttatgtatccgggcataaagaggttgcagtgagccaaggtcgcgccactgtactctagcctgggtgacagagcgagactgtctcaaaaaaataaaatcagttgttgcagctgggcacagtggctcccgcctctaatcccaacattttgggaggcagaggcaggtggatcacttggggccaggagctccagacctgcctggccaactggtgaaaccctgtctctactaataaaaaaactagccgggtgtgttggcgcatgcctgtagtcccagctactcaggtggctgaggcatgagaattgcttgagcctggaaggcagaggttgcagtgagccaagattgcaccactgcactccagcctgggcgacagagggagactctctcaaaaaaaaaaaaaaaatcagttgttgcttttcctgctttgagaacatactaagggggccaagagtgagagctatgggctggctggaggtgggcagcagcttaagttaaagatgctgccaccagctgtgtggtctatctgagaataacactgacagaacaactgataggcaggacaagaggagtagagtggtgagaagagggaggactcaggtgatccttcccaagtaactcagactgccatgagaaacactccaaggaggcactggtgataggttttaggggagaaatcatgtaaacttagcactattaaggcattggttgtaagtaaatttcaaattctttaaaaaaaaaaaaaagcacaattgaaatgtaatttcaagaaaaattaggccagacacagtggcttacatctgtaatcccggcactttgggaggccaaggcgggtggatcacaagttcaggagttcaagaccagcctggccaacatagtgagaccctgtctctactaaaaatacaaaaattagccgggtgtggtggcatgcacctgtagtcccagctactcgggaggctgaggcaggagaatggcttgaacctgggaggcggaggttgcagtgagctgagacaacgccactgcactccagtctgggtgacagagtgtgagactctgtctcaaaaaaaaaaaaaagaaaagctaatcataatttctactacatcttttggtttatctgcttccatctatactgtattatttgacttaacaatgtcaccatacatctgtatttacactttgtaattatcaagacatgtcagaaacaatttcatctggggttcacaataggtcagtgaggcattgcgactgccagtttataaataaaaatatgaagctcagggccccacaactcaaaattggaagaatatgtagattcaaaaccagggtcctcagccagaagctcagggttctttccataccttatctaacatatacaacggtaaacaccttataccttcaaaatgcattcatgtccattactcacctgatatatatgtttatgtgagtttatgtgtgtataaaacatgcatgctctctgttctttcttgagatagggtcttgatgtcactcaggctgaagtgcagtggtgcaagcatagctcactgtagcctcgacctcccaggctcaagcagtcctcccactttagcctcctgggtagctgggaccacaggcatgtgccaccacactcagctaactttttttcttttggggggacaaggtcttgttctgtcacccagtcaggagtgcagtggcatgagcacagctcactgcagcttcaatctcatggactcaagtgatcttccaacctcagcctcctgagtagccaggaccacaggtgtacaccaccacgcccgcctaatttttgtgtttttttgtaaagacagggtttcatcacgtttcccaggctggtcttgaactcctgagctcaagcaatctgcccatctcagcctcccaaagtcctgggattacaggcataagccaccatacctggccacttttttcttctgtagagatggggtcttgctatgtttcccaggctggtctcaaacagagcctcccaaagtgctaggattacaggtgtgagccactgtgcccagcatctgctctttcatataaataagaaaatacagacagtagaaatccttaccagcactgtccaatagaactatctgcagtggtggaaatgttacaaacctgtgctaagacaaggacatgtgaccacatgtggctactgagtacttgaaacatggcaagtgcacctgaatctttaattttaatttaaatagctgcatatggctagtggccaccatactgcagagcataactctagatccttccattctgacaaagcttcttctctaaactctgctccggacacatacctttgtctcaggaatcccagcgtaagtgaagccagactctcactttaagtcaatttcttctcagtttatttatatcatttcaaatgtcatgacaaccacaatatcccaatttataatactataacatcaagagaaaaagaattctactgtcaagtacacggttacaaggaaccccaattaaaataaggtctatttaatttggtcttaaatagcttaaatttgtttgaagggaattctaagcaatgttgctttggatctttgatactttttctttttttgagaaaaggtctcactttgtcatgtaggctggagtgcaatggcttaattgtagcttactgaagccttgaacttctgggctcaagcaatcctcccacctcagcatcttgagaagctaggactataggcatgtaccactacacccagctaatatttttattctttgcagagatagggccatattatgttgcctaggctggtctcaaactcctggcctcaaatgatcctccgaccttggcctcccaaagtgttgggattatgagcaactgtgcccagccaatattttcattcaatgtattctgccatgccctgtggcagtactcctccgaacttctttttaatttagaaaatgtggacattcctgtggattacatggataaaagtattcagataaatgcaaactatagtccccacaattgagatggccattttttaaaacaaattttcaggatttgtataaacataaaggagtttttttttttgagacgagtctcactccgtcacccgggctggagtgcagtggcacgatctcagctcactgcaaactctgcctcctgggttcaagcaattctcctgtctcagcctcccaaataggtgggattacaggcacctgccaccacgcccggctaatttttctattttttgtagagatggggtttcacccgattggtcaggctggtcttgaaatcctgacctcaggtgatccacccgccttggcctcccaaagtgctgggattataggcgtgagccaccgtgcctggccaatttttgtatttttagcagacatgggttttcaccatattggctaggctggtctcgaactcctgaccttgtgatctgcccatctgcccaccttggccttccgtagtgctgggattacaggcttgagccaccatgcccagcctatttggcttcatttagtggaatttttcatcttgaaagttgttccttattaaacatatatatatatataaaacatatatgtttaatatatacatgtttattatttaatatatattattaaacatatgtgtgtgtatgtgtgtatatatatatatatatagatatatatagattttttttttgagacagtctcgctcttgttgcccaggctggagtgcagtggcaccatctcagctcactgcaacctccacctcccgggttcaagcagttcctcagcctcccgagtagctggggttacaggcatgcatgcaccaccacgcccggctaatttttttgtatttttagtagagacgaggtttttccatgttgatcaggctggtctcgaactcccgaccttaggtgatcctcccgccttggcctcccaaggtgctgggattacaggcatgagccactgcgccaggcctaaacatatttttcttaacccttatttgtgtccgttctgtatagtgattgtgcaaaataaccaggtcaggaaaatctcatggattctagttcttatttatttgttttttgagactggatcttgctctgtcacccaggctggagtgcagtggcatgatcatagctcactgcagcctcaaccttctaggcacaagtgatcctccagcctcagcctcccaagtatctgcaactacaggcatgtacccccacgcctggctaatttattttttgtagtagagacagggtctcaccatgttgctcagactggtctcaaactcctggccttaagcagtcctcctgcctcagcctcccaaagtgcttggattacgggcatgagccactgtcctggcctagttcttaattctaaaaaatactgttgctcatttaattttacagagtattggaggcaggatggatttcttgcatacattgtttctgtattttatcccatgaactatcagggtaatttgattcttttctccttattctaggtttgtgaagttttctatgcccagtgttcctgacttcgaaacgctattctcacaggttcagctcttcatcagcacttgtaatggggagcacattcgatatgcaacagacacttgtaagctaaataacattttattctccattgaaaatattttgcccttgtggttatatttatattttgaatattttgttattgtatctagttgctgggctttgccatcagctaacaaatgcacttgtggaaagaaaacaggtaagaaatactattcaagtattcctagttttgttataatatgtaactagcttacacaatgaattactttatcaagattccagttagtactgagcatccaccacctagatatctgtggtcacttgagagcactcacagccattgctgtaagctcaggcagtccccgcatcccctgaatgaggtggaggcacggggtggtttggcacctcagggaggctgctgctggaactaccaagtagttggaattaccaagccagtaccctttatgttgtaatatgctgggttttgtctgttacattttttcttttaacttttaattaggacattattttagccttacaaaaagcttcaaaaataatataaaaaattctcatacattttacctagattttccaaatgttaacattttaccgcacttattcttttttttttctcttcctcttttattctgagccattgtagagtaagttgcacatatgctattgctgttctttatccctaaatacttcagtgggtaaagcctaaaaattaggacattctcttacatagtatagtgtaatggtcagcatccagaaatgaactcttactgtttttttttttggagacagagtctcgctctgatgcctaggctggagtgcagtggcgccatctctggtcactgcaacctccacctcccaggttcaagcaattcttctgcctcagcctcctgagtagctggggactacaggtgcatgctgccacgcccagctaattttttgtattttagtagagacggggtttcaccatgttgccaggctggtctcgaactcctgagctcaggcaatcctcccgccttggcctcccaaagtgccaggattacaggcgtgagccaccacgcccggcccagaaatgaacgttaatataatgcatcaacaaattgacagaccccatttagattttcccccagtgaaaaggactgtcttttgctataaaaggacattagctgtttggacagtgtactatatattatatagcaaaagaaaaccgtggaccatggattgcattagactgctttgtttctttagtgtcccttaatctgaacagttatttcattctttatcttttataatacataatttataatgtggatttttaaaaaatttatttagttatttatttttttgaaatggagtctcattctgttgcctaggctggagtgcagtggtgtgatctcagctcactgcaacctccaccttccagcttcaggggattctcgtgcctcagcctcctgagtagctgggactacaggcgcatgtcacctttcccagctgatttttgttttgttttgttttttgagacagagtctcgctctgtcacccaggctggagtgcaatggcgcaatctcggctcactgcaacttccgcctcctgggttcaagcagttcttctgcctcagcctcccaagtagctgggattacaggtgcctgacaccatgcccggctaatttttgtatttttagtagagacagggtttcaccatgtttgccaggctggtgtcaaactcctgaccacaggcgatccgcctgcctcggcctcccagtgatttttgtatttttaatagaggtgaggttttgccatgttggccaggctagcctctagaactcctgacctctggtgatccgcctgcttcagcctcccaaagagctgagattacaggtgtgagccacttcacccagccaggtgtttctttttaatttgaaagtaaatttaagattagtggtttgaaagaggctgaaaatagaaccagttgttattttgtagtactaagtaaccatgtttgaaagagatggttaagaaaaatcatgagtttttgaaaaagctgtaagttattgagctatttttagtctcttcacatatatatatatatttttttgttgttgttgttgttgttgtttttttgagatggggtcttgctctgttgcccaggctggagtgcagtggtgcgatctcagctcactgcaacctccgcctcccgggttcaagcgattctcctgcctcagcctcctgagtagctgggaccacaggcacatcccaccatgcccggctaatttttgtatttttagtagacatggggttttgccatgttggccaggataatcttgatctcctgacctcatgatccacccatcttggcctcccaaaatgctgggattacaggtgtgagccaccgtgcccagcaattttggaagagactatattttagtctgccaaaaactgattatgccttacttgacacttggtcttgttatttataatcagggcaggaaacagtccttttgaaatctatggtgttagttttggtagtaatttactaccaggtaaggggtagactgccctatgggaaaatgccaacacccttagccacaagtaattttcctaagcataggctgttgtctcttgtataataagtgatttggaaagttttcatttgtttagatgttaatataataaactgttgagaaagtaatactgtttttgattattgatcttcattgtaaaaataaaagctttttatgatttaaaaaatggtgctgagttatctaaaaattccaagaaacagcttaagaaaagttttctgacttaaatgggacagaaatttcctgaaagagtatggaaacctcatattgctatttaaaggaacctatcaattagtgttattttttatttataagtgacaacataagatccaatgtgctgccatctttgagaacttatctgaaagagatgtcatttctgacagcccctgcgaggaattggcatccttaagcaagccatagacaagatgcagatgaatacaaaccagctgacctcaatacatgctgatctctgccaggtaagcaaccaaagtgtgtgattcacaccaagtcagaggtgtaggttgtttatgggcttgctcaacattgggtttgataaacacaggcaagttggcgatattgtgatgtgttatagaagttggaatatgtaggtacatctattacattcaggcgggtgctggatgcaaactgtaggatggggctcaactagtaagcttgtcgaacagatagggtaattaatagttgtaacttttttttttttttttttttgagacagtctcactttgtcgcccatgctggagtgcagtggcacaatctcagctcactgcaacctctgcctcccgggttcaagcaattctcctgcctcagcctctcgcgtagctgagactacaagcacccaccaccaagcctagctaatttttgtatttttagtagaacagggtttcaccatgttggccaggctggcgttgaactcctgacctcatgatccacccgcctcagcctcccaaagtgctaggattacaggtgtgagccaccacacccggccctagttgtaacttttttttttttttttttttgagacggagtcttgctctgtcgcccaggctggcgccatctcagctcactgcaagctccgcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgcagtggttcacgcctgtaatcccaacactttgggaggctgaggcgggtggatcacctgaggtccggagttccagaccagcctgaccaacatggagaaatcccatctctactaaaaaaaaattgtggaacctgagacttaacatagctaacttcttacaccttaaaatgttattcatttatcttttttttttttattttttgagatggagtcttgctctgttgcccaggctggagtgcagtggcatgatctaggctcactgcaagctccgcctcccaggttcaagcaattctccttcctcagcctcctgagtagctgggattgtggacgtgcaccactacacccggctaatttttgtatttttagtagagatggggtttcaccattttggtcaggctggtcttgaactcctgacttcaagcgatccgcccacctcagcctcccaaagtgctgggattacaggtgtgaaccaccgtgcctggcctcatttatttatcttattttgcgatgttcaaagtccagaaggcaaaagggcaggtatataatgaagtctccttcccattctgtttgctagccatctatttcttctctacaaaggaaactatgttagttatttctcgtgtatccttccaaaaactttttatggacataaaagcaaatacgaatatatattttctcattttttacacaaattgtaataatctatgcatactcttatgtagcttgctttttgtatttaacatatcttggagatgattctgtagcagtactctacaggtacggagtattctataatatgagtatgcgatggttttagaagtctgcatgggatatttacattgtttccttcaagaataacatggtatgtggattatttcaaacacatgttctagtttcatatgaagatgtgctttttaatgttttaaaaaaattgtgattgaggtacaacatacagacagtaaaatactaaagtgtatagctcagtgagtttgtacgcatgtctacactgcgtctccattagctagataactgttctaagggcttgctttcttgagttgcacaattccctgtatttacctaaaggattaattaaaggaaccacttctacttgtatcacaccatgctggtctctttctattccactagttcagtaaagaaagaggacacactctttttccctctaatcagatgggtagggataggttaagagataagtgagtcttgtctgtagagttctctattctcaatcatctatagcatgcttggccttatagctgtttagctttttataaagaaatgctcccccaggtgaggtggctcacgcctgtaatcctagcacattcggaggccaaggtggacggatcacttgaggtcaggagttcgagaccagcctggctaatgtggtgaaaccctgtctctactaaaaatacaaaaattagctgggtgtggtggtgcacgcctgtaatcccagctactcgggaggctaatgcaggagaatcacttgaacccgggaggtggaggttgcagtgagctgagatgacgccactgcactccagcctgtgtgacagagtgagactccatttcaaaaaaaaaaaaaaaggtaatgctgtttttttctgaatggctaagaaaatggagtacaggttgactattcctaatctgaaaatttgaaacccaatccgaaaatttgaaacccaaaatgcttcaaaatctgaaatctttagaatgccaacttggcactcaaagtgctcattggagcaattggatttcaggttttcagattagggatgcttaactggtatgtattctgcaaatattccaaaatttgaaacacttgtggtcctaagcatttcagatagcagatacatgaaatgtgttgacatttagataattttagtcaataaaatgtaaaacacaattacattatttggaaatttctggaatcaatgaattttctccttctgctaatacctgcctaagtaaaattaaagtgatgatttaatatcaatttgttcacagctttgtttgctagcaaaatgctttaagcctgcccttccatatcttgacgtggatatgatggatatctgtaaagagaatggagcctatgatgcaaaacactttttatgttactattattatggagggatgatttatactgggctgaagaactttgaaagagctctctacttttatgaacaggtaatctctctaaaaattagctgaggttgttctgaacttgtgtgatcaaaaaagtgctcccataggtttgtggctagagtggtctgatcccagggcctccgtttcaggtgttggtcctttcagagactacttctctgtgatcatgtaaatagtggtaacctgatccctaagttgaggagcagcgccagtgcatagaagagcacttgtctgggggttctaatctaggcttgcacttataccttatctgatttggaataagttatgacatctcttgacctttatagcttcctttgcatataaggaagagattgaactgagtgatcttggttgtgtcttattctaaaaccatgtgtggtattttgttaagttttatttaatcagtgaaacattctcttgattcaaaatttaaagggtagaaaggagtacacagtaaaagtccctcccaccctttctgtgtctgtgtaatgaaacatagtacacaatttggtagaatattctggaggtttactcagactctgaaaaagagatacacaatattgattaataaaccactttacttaaggtaaattagttagatgttcgtaagttcctatttagttcatagcatgtattaagtaataaaggatatttaaaaccttcagagagctcggtttagttggaattctaatacataatacacatgcatacatgtacacacatccgtggctctgaaccataccacaatgagtggttgatgtgtcctgttgaggggacctgaggagggccaccataaggtgccagtaggcagagatggtgtcattaaagcacgtgtctagtcaggttaaatcttcaaggtggcttctctttaagactacgcattcggaaaattataaaaatgcacttcgtagccactggatgcattatcattgctgtagccaaatatagttaactcatgagcaaacttgatcttgaaatatcaggatgagtgggtgttaaaaaggtaagaggcgtccgagtgcggtggctcacgcctgtaatcccagcactttgggaggccgaggccggcggatcacctgaggtcgggagttcgagaccagcctgaccaacgtggagaaaccccatctctactaaaaatacaaaatttagctgggcatggtggtgcatgcctgtaatcctagctactcaggaggctgaagcaggagaattgcttgaacccaagaggcggaggttgcagtgagccgagatcgtgccattgcactccagcttgggcaacaagagcaaaactccatctcaaaaaaaaaaaaaaaaaagaaaaggcaagaggctgggtgaggtggctcacacctgtaatcccagcacactgggaggccgaggcaggcaaatcgcctgaggtcaggaattcaagaccagcctggccaacatggtgaaaatgtctctactaaaaatgcaaaaattagctgggcctggcagcaggcgcctgtaatcccagctactcgggagactgaggcaggagaatctctttttttttttttgaaatggagtcttgctctgtcgcccaggctggagtgcagtggcacgatctcggctcactgcaagctccgcctcccgggttcacaccattctcctgcctcagcctcgtgactagctggaactacaggtgcctgccaccatacctggctaattttttgtatttttagtagagatggggtttcaccatgttagccaggatggtcttgatctcctgacctcgtgatccgcccgcctcggcctcccaaattgctgggattacaggcatgagccaacacgcccagccaggagaatctcttgaaccaggagatggaggttgcagtgagccgggattgcgccactgcactccagcctgggtaacagagactcgtcctcaaaaataaaaagacaagaaagtggccaggcgtggtggctcatgccagtaatcctagcactttgggatgctgaagtgggagcattgcttgagctcaggagtacaagactgaacaacatagtgagcaacataggagtcagcctgagcaacatagtgagactccatttctacaaaaaatatttttttttttgagacggagtctcgctttgtcgcccaggctggagtgcagtggcgcaatctcagctcactgcaagctccgcctcctgggttcacacccttctcctgcctcagcctcccaagtagctgggactacaggcgcccaccaccacacccggctaatttttttgtatttttagtagagatggggtttcactgtgttagccaggttggtctcgatcccctgacctcgtgatccacccacctcggcctctcaaagtgctgggattacaggcataagccaccgcgcctggcctctacaaaaaattttaaaattagtcaagcatggtggcccactcctatagtcccaggtactcaggaggctgaggcaggaagattgcttgaacccaaggagtttgagggtacagtgagccataattacatcactgcgctccagcctagatgacagagcgagaccctgtctctaaaaaatgcataaataaaaataaaatgaattctatctcaataaggctgttataaaaataatgggacatttaaaaagtattattgacttataattaatgtgatacatgtggttgattgttgtttgctactgtggtatgttctctttacagcaagcattcttctcttgcctaggctataactactcctgccatggcggtcagtcatatcatgttggaatcatataaaaagtatattttagtgtctttgatattacttggcaaagtacaacagctaccaaaatatacatctcaaattgtgggtagattcattaaggtaagttttttacataaaactgatttcttacgtgagcatgttgagtatataaagaaattgcaatgatacagttctgtaacttcgttttatactgatttagctctcctagcagcttcaggtgagcagacatttattgaatgtcttctacacattctcattacctgattggaatggaatatttctcaggaacccgttttcaaacttgtgctctagatacttacagctatagatgtttaagctcctataacagttgatttttttttttttccctagagacagagtctcgctatgttggccaggttggtgttgaactcctggcctcaagcagtccttctgcgtctgcctcccagagtgctgggattacaggtgtgtgccactgagcctggcctttattttgttttgttatatttttcattttatttatttatttatttatttatttagaaatggagttttgctcttgtcaccaaagctggagtgcagtggcgtgatctcagctcactgcaacctctgcctcccgggttcaagcgattctcctgccttagcctcccgagtagctgggactacaggtgtgtgccaccatgcccagctaattttttgtatttttagtggagatgtggtttcaccgtgttagccaggattgtctcgatctcttgacctcgtgatccacccgcctcggcctcccaaagtgctgggattacaggcgtgagccaccatgcccggccctgtcttccttcttgctagcagaagtagcagattgtcctgttgcatctggtgaggtgtgagaaagagagagggagagttgggaatgatgaatgttttgactcctttcttctctatatgatttatcagtagaaaaacagaagcactgatgaagacgtgtgccttcactaaattcagtgggttttcacctgctgtgttattacttggtctgtagtacaaaattttgtggaaaatgaattactccatagtgactttctatccctggtcttaaaaaccaggcatttgctttgggtaaattataatttgtagggtaacagtgtgtagttacctgacaatatgggatatacttgcttaaaaaatagtatgtaagtgtgtttttgcttcctatacacatttgagtcttctgaagtttgtttgtttgtttttggttttttttttttttttgagacggagttttgctttgttgcccaggctggagtgcagtggcacgatcttggctcactgcaacctccacctcctgggttcaagcgattctcttgcctcagcctcccaagtagctgggattacaggcatgtgctatcacgctcagttaattttgtatttttagtagagacggggtttcttcatgttggtcaggctggtgtttaacccctgaccccaggtgatttgtccgcctcggcctcccaaagtgttgagattacaggcgtgagtccccacacctggcctcttctgaagttttaatctgaattttttccctcctttgcatctttagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaaggtgaggaaagtgccaccttcacagggcagctcctgaccccctgggggccatgtttccctttctctcccttttcagagctgaggaagcaggtacagggataaagcatggcaggatttctgtgctgagagagaactctcttgtgattggcttcttagaaagaatttgatgtatacctttggtcttttcagggctagagcagggtatttggagcaggtgaagaggaagaaaggtaggagacaaggctacattgggagacagtgaaaggcagcctcagagaggtcagcagctccagcagggcagatgagggatgctaatgatgcagacctcagtgcactgtcaccagccttgcaacctgtctgttctgtctgtgctgatctctattagaacatttttttttttttctctcttgacacagtgccttgctctgttgcccaggctggtgtgcagtggcgtgatttcggctcattgcaccctctgcctcctgagctcaagtgatctgcccacctcagcctcccaagcagctgggaccacaggtgtgagccaccacgcccagctaatttttgtattttttgtatagacaaggttttgctatgttggccaggcggtctcgaacccctgtgctcatgtgatccacctgccttggcctcccaaactgctgggattacagacatgaaccaccgcacccagccaatgagaacaccttatgtgaacatagtactactcggacattaccatttaggccagggttgtacaaactttgtgcaattgacttctaggatgtaagccaattatataatttttattttcttctaggatgtaagccaattctataatttttattgtcaagatgaaaataacctgctaggttttgactatagaaaatatgcttaatgtcaaacgttcaaacagtacagaaaaataatgaaaaatgaaattttttgtgttttaggaaggtataggctgcaagttacaggaatcctgtagctcaacaaatagaggattgcttttttctcttgggaagtctggccagatatgcatagttcacagctgctgagaacacagtgcatctgttcctgtgcacatcctttgccttgtgtcagccatggtgatgcatggttggggacgagccaaggaaccagaatagggtagctgtttttttgctaggctacccagcaatggaaaaggctgatggatttggctacgtgaggacttaggggagaggtgacttcccctagcccaatggagaagctagagaagagaggtgggtcggggtggccgttgaggtgggcagacctcatacaaggataaaggatcctaaggagaagaggaaggaaggtgaggagagggtcaatgggcaagaaaaagaatccttccaaatactctagaaagactagccatagcttctagaatagaaggaaatcagtagtgaatttgtaaaaagttaatttttatgagagaaaaatgaagaacgtgaaagagaaatcaagtcaaagatcaaaaccagtgtaacttgtgagccagaaaaaccagcttgacctacaggtttaaaagaccaggatctaagagacttaaataacaagcagcctaattctctccataaaattttctttttggcccaagtgccaacagaaccattctaagtaaatttctgtcttttgccatcaagaggtagccattaaaaaacagctgccattaaaaacacaaactctgtttgtgactagtaattgaggtttagataaaagaacccaaatgctaacaaacataaaagatagtacatgttacaaaagatgttaaattgcaaaatagcaaatgaaaattaaataacggtttcaaaaattagctgggcgtggtggcacatacctgtaatcccagctacttggaaggctgaggcaggagaatcatttgaacccaggagatagaggttgcagtgagccgagattgcaccactgcactccagtctgggggacaaagtgagactccgtctcaaaaaaaatttttttttgatcaaacaggaagagtctcaactcgaaatggtctttccagggctggggtagtgactcacaaagtcatcaaggtcctgggtccttcgtatgttgacacgaagtggtggattgtggtacactgagctcacaagcactgcctgccagagggacctggggagggctaccataaggtatggtgggcaggaaccgtgtctttaaaggacatagctagtcagaaggttacatctgtgatagtggctgctccatttttggcatgatgtcccagtgctaaaatgaaaagaacggggaaacatcaaaggatttttctagccaagtttttcttactagaaaatccaaagaagtctcaacaggtagactgtatcagtaggtgatggcatggctgggatggaaggcagctggggatgggttaaatctgccacctctcccattgaaatattactttgtgttaacattttagtagatgtttttctttttctttttctttttctttttttttttttttgagacggagtcttgctctgtctcccaggctggagtgcagtggctcgatctcggctcactgcaagctccacctcccgggttcacgccattctcctgcctcagcctcccgagtagctgggactacaggtgcccgccaccacacctggctaattgtttgtatttttagtagagacggggtttcaccgtgttagctaggatggtctcgatctcctgacctcgtgatccgcccgcctcagcctcccaaagtgctgggattacaagcatgagccaccacgcccggcctagtagatgtttttctaggttcctcttctctgtttcttttctatgtgtatgcatagactctcccagttatatgtaattggggtcatactctacgtgctattcttgaccctgctcttttgtttgtttggtattttttctttttttttttttctgtgactgagtctcgctctgttgtccaggctggagtgcagtggtgcgatctttgctcactgcagcctctgcctcctgggttcaagcgattctcctgcctcaacctcctgagtagctgggactacaggtgcacaccaccacacctggctaatttttgtatttttagtagacacggggtttcgccatgttggccaggctggtctcaaactcctgactttaagtgatctgcccactttggcctcccaaagtgctaagatgacaggtgtgagccaccgcgcctggcctacttttacattttttgtagagatgggatcccactgtgttggtcaggctagaatgttgacttttgagtctttgtttgtgttaaactacttgtgtacttcttaaagttagcagtaatttcaatttcttgggtactattctctgaactaaagtatatgtaggttttaaaattattggctcatcaagaatttatggccaggcacagtggcttacccctgtacttccagcactttggggagctgaggcaggaagatacgttgaaaccaggagcttgaaaccagtctgggcaactaagtaagatctcatctctacaaaaaataaaacaataaaattagctgggcacagtggtgcacacctgtagtctcagctactcaggaggctgaaacaggaggttcccttgaactgctatgaactgtgattgcgcctctgcactctagcctgggcaacagagcaagactccatctcaaaaaaaaaaggaattttcaagatgagggttttaatatgcccagctctgaaaatgccattgttgtaaatattaccagctgccattaagaatagagctcttttaatatgtttctgaaaggggtcattttcatcagatcccaagagagcagtggtaaacactggtttccctcatcacaagtgtgtagcctcttttatttaactcccccatttgtttaaaaatgttaactttgaattttgaatgatgaatgttattttttcaattatatttaatagattatacatttataatacaaaattcaaaagatgaaaatcttcataatgatgtgcataccttggattccttttcagtttacatatatatataaaattatttttcattactcctctaggaaattgacaaaccactgggttcatcagtttttatttttttatttttttttgtgacagagtcttgctcagttgcccaggctggagtgcagtggcgtgatcttggctcacaacaagctccacctcctgggttcacgccattctcctgcctcagcctcccaagtagctgggactacaagtgcccaccaccacgcccggctaattttttttttttttttgtatttttagtagagacagggtttcaccacgttagccaggatggtctcgatgtcctgacctcgtgatccactcgcctgggcctcccaaagtgctgagattacaggcatgagccaccgtgcccagcctatcagttatttatttatttatttatttatttatttatttatttatttatttattttgagatggagtctcactctgttgcccaggctggagtgaatcccgcgatctcggcttgctgcaacctccacctcccaagtttaagtgattatcctgcctcagcctcctgagcagctgggattacaggtgcctgccaccatgcctggcaaatttttgcgtttttagtagaggtggagtttcatcatattggccaggctggtctggaactcttgacctcaattgatccacccacctcggcctcccaaagtggtgggattacaggtgtgagccaccacccctcgcccatcagttttaagtcatctacacaaatctattctgtacatcaatgggaagagctctgtacactttttttttttttttttttgaaatagagtcttgctctgtcgtccaggctggagagcagtggcgcagtctcagctcactgcaacctccacctcctgggttcaagcaattctctgattctcttgtcgcagcctcccaagtagctgggactacagacgcatgccaccacgcctggctaattctttttttgttttttgttttttgttttgagacagagtctcactttgtcacccaggctggagttcagtggctcagtctccactcactgcaacctccgcctcctgggttcaagcgattctcctgtctcagcctcccaagtagctgggactacaggcgtgcaccaccataccagctaattttctgtatttttagtagagacagggtttcaccatgttagccaagatggtctcaatctcctggcctcatgatctgcccacctcagcctcccaaagtgctgggattacagacatgagccaccacgcctggccgctctgtacacatttaataaaatgtccttccttcgttgttcctacctgtgactaattctgcttctgactttcagacctttttaactctatcattacaagatatggcaagtcgtgtgcagttgtctggacctcaggaggcagagaaatacgttctgcacatggtaagtggattttctttttctttttcttttttttttttttttttctttttgagatggagtctcgctctgtcaccaggctggagtgtagtggcacagtcttggctcactgcaacctccacctcccggattcaagtgattctcttgcctcagcctcccgagagctgggactacaggcatgcgccaccatgcccggctaaatttttgtatttttagtagagatggggtttcaccatgttggtcaggctggtctcaaactcctgaccacgtgatctgcccgcctcgggctcccaaagtgctgggattataggcatgagccaccgtgcctggccttgattttcatttttttgaaaattaattactggatttttgttactgtaagagtaacagatgttcattgtggaaaatattaaaaaggagaaaagcggggggagcctccaaagtctaccactattgacaatttggtctgtttccttatagtttctagttttagtgtgctcatatgatatacacatcaggcttgcgtcctatttgtgcttcctttttttttttttttgagatggcttcatcttgttgcccaggctggtgtgcagtggtgcaatctcggctcactgcagcctcaattccctgggtttaagtaatccacccacctcagcctcccaagtagctgggactacaggcatgtatgtgtcaccatgcctgactaatttttgtatttttttgaagagatggggtttctccatgttgcccaggctggatttgaactcctaggctcaatctgccctcctaggcctcccaaattgttgggattacatacgtgagccactgtgcccagccctgtactccttattattttcttttattttattttgaggcggactctcgctttgttgcccaggctggagtgcagtggtgtgatcttagctcactgcaacccccacctccagggttcaaacaattctcctgtctcagcctcccgagtagctggtattacaggcggctatatttacatattttcattatcagaatttttgtaaacctcataacactcatgaaatatttttggtatacaaagaggtataaggtagggctacttcctctgcttatctgtgatgagatcacaagcttttgccagtacgtacatcaagcaactgctgcagcaagaaatcttgctgaacaatgtttgctgaactacacagtgtgcttagcgacatcattgactgacattctgacttagcctcttccgtcactgagggttttggtccataagcagcactgacataaaggaggccagagcacacacccaggacttagcatccagcttaggaaatgaaatagcaccagtgccctgacactccctctttatcacctgccagttgcatttccccactctcagccccaccccaaccaggcaaccactcctgatttggataagcatcatttaaatgactatatgataacccaccacattgatgtattgtaatctacctacctattcagttacataagtacatagttctgatctggttttagttcactgaaaacctgtgtccttagctcaggacaggcaaagcttcatatgaccccttgtatgatttcagaatttggagtattttgattgattgattgattgattgagacaaggtcttcctgtgttgcccaggctggagtgcagtggcgtaatcatggctcactgcagccttgactgcctaggcttaaatgatcctctcacctcagcctcccaagtagctgtgactacagatgtgtgccaccacacccagctaatttttaaattttttgtacaggcagggtctctttatgttggccaggcataacttgagatttctggcctcaagtgaccttcccaccttggcctcccaaagtgctgggattacagctggatacagccactgcacccagctgagtatttcattttgatagttgaatttacaagtgttctaaagggttttttgcttcaacctaccattcaaaacatgcacacaccaaacaaaaccatacctctatgacttgtgtctgctaagagcatcttggtaaccccacaggggttacacagaataagctatagacactttccccaagaaattccctcttcagtggcgagtgagaagaaatacatgagtggttatgacaccagacaggacatactagctagcaacgcgttgcggggtcaaagtgggtgtgagttttgagccctgcttaaccagcccagacaccctgacaggctctggagcagtggttctcctctgagggtgattttgtctgccaggagacattaggcaacatctggaagcagttttggttttcacagatgggggtgctactggcgtctaatgggtacgggccagggatgctgctaaacgtcctgcagtgcccaggacagcccacacaccaaagcgttatctgtacccaggacagcccacacaccaaagcgttatctgtacccaggacagcccacacaccaaagcgttatctgtacccaggacagcccacacaccaaagcgttatctgcccccaaatgtcaggactgccaggcttgagaaacccttctggaatgaaaggtctgtgagaccagggtttttttttgtttgtttgttttttaaagtaaacattggaaaagtacacttaagtgtacggctaaacacattttcacaaagattccaacacctagaagaaggaacagaatatgaccagcacccggaaaatatcccttgtgtctgcttccagccctgtgcctctctagaaaggttgttcccatcctgactttttttttttgagacggagtcttgctctgtcacccaggctggagtgcagtggtgcgatctcagctcactgcaagctccacctcccaggttcacgccattctcctgcctcagcctcccgagtagctgggactacaggcacccaccactacgcctggctaattttttgtatttttagtagagacggggtttcaccatgttagccaggatggtcttgatctcctgacctcggcctcccaaagtgctgggattacaggcatgagccaccgtgcccggcctcccatcctgacttctaacatcctattttagttctgtttgtttctgagtttgatgtagaaggaaacacacagcacattctttctgggaatctggttttttggctcagcattgtgagagtcatgcatgatgctgtatgtagccgtagttcattcgttttcagggctacaatgttccagtgtttgatacacctttccattttaattagttggacaggctgggcgtggtgcctgtaatctcagcactttgggaggctgaggcaggcagctcacctgaggtcaggagttcaagaccagcctggccaacatggtgaaaccccgtctctactaaaaatacaaaaaaaattagctaggcatgatggcgggcgcctgtaatcccagctacttgggaggctgaggctggagaatcgctcaaacccaggaggcggaggttgcagtgactggagatcacaccattgcactccagcctgggtgacaagagcgaaactccgtctccaaaaaaataaataaataggtcgggtatggtggctcacacctgtaattccagcactttgggaggctgaggcgggcagatcatgaggtcaggagatcgagagcatcctggctaacatagtgaaaccccgtctctactaaaagtacaaaaaattagccaggcgtggtggcagatgcctgtagtcccagctactcgggaggctgaggcaggagaatggcatgaacctgggaggtggagcttgcagtgagctgagattgcgccactgcactccagcctgggcaacagtgcaagactcttgtctcaaataatgtaaataaataaatagttagacattggggttgtttccagttctggttaatttattatgaatagtgctgctgtggtgaaggtaggtccaaattttgcttagatacattccatctgcttaaagaggcagctctctgtgatcacatagagaactatgcattttgtataatatgtattgggctggttactgtttcactaaatagcatctatcccttccaaagctagagacaagtaggccagcagtttcactgctaacaaatggacaagttattatcaccgtgtggaacatcttgttaggaataaaatacctgttttgtacttttattggtatctcactttttaacttcatgggcaggatttggctttgaggatcagtcaaataattccccagtaactgatgcaaataaataatatatagaccttgaatctaccttggaatccccagtggtagtaaagttttcttgaagaatcggaagatagtttccactgggatgaaaagaaaacgtgttaggctttactttttaaaatacagtggcccagcctggccaacatggcaaaacgtcatctctactaaaaataaaaaaaattagctgggcatcgtggcacatacctgtagtcccagctacttaggaggccgaggcaggagaatcccctgaacccaggaggtggaggttgcagtgagcagagatcaagccactgcactccagcctgggcaacagagcgagaccccatctcaaaaaaaaaaaaaaaaaaggcgatgtaagttatatttcagtgcagctgatgttgaaaaatgcaagggcacctcaaatacatcatgctaagggaagccagaccacaaaagattacatagtatatgattccattcatatatccagaaaaggcaaatccatacgagacaagaacagattggtggtttccaggggctgggaggagaaggagggaatggggagggactgctaatgggcctagggcctctttctggggtgacgaaaatgctccagaactagatagagatggtggtggcacaacattgtagaatgcattaaatgccaattaattgctcactttaaaaaggtaggccagatgtggtggcccatgcctgtaatcccagcattttgggaggccgaggcaggtagatcacttgaggttaagagttcgaaaccagcctggccaacatggtgaaaccccgtgtttattaaaaatacaaaaaaatggctgggcgcggtggcttacgcctgtaatcccagcactttgggaagccgaggcggatggctcacctaaagtcgggagttggagaccagcctgaccaacatggagaaaccctgtctctactaaaaatacaaaattagccaggcgtggtggtgcatgcctgtaatgctagctacttaggaggctgaagcaggagaattgcttgaactcaggaggcggaggttgcagtgagccgagattgtgccattacactccagcctgggcaacaagagcgaaacgccatctcaaaaaaaacaacaaaaaaattagcctggtgtggtggcgggcacctgtaatcccagttacttgggaggctgaggcaggagaattgcttgaaccccggaggtagaggttgcagtgagccaagaacgcaccactgcactccagcctgggggacagcgagactccatctcaaataaataaataaataaataaataaaatggttaattatgttgtgtggacttcacctcaataacaaaaatgcaagggcagggattttgtgtgtatcagttttacacctcttagcatctataatggtgcctagcaaatagtaggtatttaataaatacttggataaacagatggcgcttaaaaatatacaagtttatttatatccatgttgccttccatgcttttctgtgattatactggatgactattcatatagcattcaggtctaaactgctttcctgatttttttttttttctttctgcagatagaagatggtgagatttttgcaagtattaaccagaaggacggtatggtcagtttccatgataaccctgaaaaatataataacccagccatgcttcataacattgatcaggaggtaaacatgaatgccaggtttttatttttttaattgatggttgagatgtatttgaaaattgctcctatgttccaggataattttagttttaagtacaggtagttcccagtctgtgaacatcttagttactagaaagttagtttcaaaatgggctgcttaaggagaattgcttgaaccctggagacgggttacagtgagccgagattgtgccactgtcctccaccttgggtgacagagcaagactctgtctcaagaaaagcagcaacaacaacaaaagaaacccagaatgggctgcttaaaattcttccaggctgggtgtggtggctcatgcctgtaatcccaacactttgggaggctgaagtgggtggatcagctgaggtcaggagttcaagaccagcctgcccaacatggcaaaaccccgtctctactaaaaaaaataaaaaatcagccgggtgtggtggtgcacgcctgtaatcccagctactctggaggctgaggcaggaaagtctcttagaacctgggaggcagatgttacagtaagctgagattgcgccactgcactccagcctgggcaagagagggagactctgtctcaaaaaaacaaaactctctcagattgtatggctgtaaataaatggtgggttagatatcccagctaactcatcaaaacctcccttaactgtgaaaacacttaaagggcccagtataactttatctattcccagctgccacctacaacatagagccttatgtttttgctgaaatgtctgtggagttccaggttgggaggttaggaaacatctctccctatgtgagaagcagagtcggggtggctggaggagaagagcaaagccctccctgacggtcccctttaggcaacagcctggctacagctgcagcagtcacctctgtgtctcctgagggcatgctgcctctgattctgggggctgaagggggagttttgtgggtggtctgtgtttcttacctctgagcagggaagtgaactgaatattaaatctcagaaaactatgtttttttgtaattaatttaatggcaaaatgtcacctgaaatggtgtctagtcttcatttatctcagcgtgaatatactcgtttcactgcaaaagatactatgtgtttgattatgaggtttgcctagatcctgctgggtgggatatttggtattatatgatagatgtattagctttctgagtccaaaatactctggctccaaaacccatgtggccccaggggtttcacatcaagagattgtgaacctatagcacccttgtgaacagtgtaagttagaaaggatgcagctgacctaaacccgccgctgaccaccttctaatgtgcctgtcatgcagatgctgaagtgcattgagctggatgagcggctgaaagccatggaccaggagatcacagtgaaccctcagtttgtacaaaaggtgatgagggttcccttattacaagaagtaggctgggtggagaaggaggggtgttgtcacatcaggcacaggaactaagtttcaggttattaaatatttcttgaaaaccttaccagtacggtcatggagaaatactagttgagagcattttcaaatgatggcctggaagtacacttagggatgcttagggtggttcctggaattgcctgcccttgttcacagggggctttgttctgggagggacagggcaactggtgtgcttattgggctgccggggaacccttgataaaagcaaacataaatacataacttcactttacctttacagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacattaatgtgtcttctgtatcacttttttctcctctgaagtttttaataagcacattcattgtgaacagaaatagctggattttaggaatttttggaagatttggatctgaaaggtttttatttattgacaaatttgtatctacaaaaaaatctaaaagttgtaatcattgtcttcagaaaataaaagaaaagaaaggccagacagacacagtggctcacacctgtaatatcctagcactttgggaggccgaggcaggattgcttgaggccaggaattcagaccaccttggccaacatagtgagaccctgtctctgtttacaaaaaaaaaaaagggtaggagcgtccctgaggcataagctaatttttaaaattaaaattaacatgcatattagtgagagtatgagttgtggattatgagatgccattggtgcttcacttttttttctttttttttttaagagacagggtctctgtcacccaggctgcagtgcaatggtgccatcatggcttacctaaacttcccaggctcagctgattctcctacctcagcttcctaagtagctgggactacaggcgagcaccaccacagccagccttttttttttttttttttttttgtagagatggggttttgccatgttgtccaggtggtgtcaaaagcactttccaacctttagtgggtgctacacttttgtagtcttgaaaatggcttttctccccctctcaacttacagtttttaagagacaaatggcaggctttcccactttttcttgtcaaagcatatcaggtaaactgatagttgcattttgattatgttcagggcctctcctgtcacaggaatttggactaggatttactgatttagccctggaatggtgtggagcagaataaagtgtggtcaggttaaaacacatcaaatttgttccttaaaaaaatctctctcactacaaacattcagtttttaaaatgtttcaagttgtctggtaaggcacattttcattatttaaaaaagaaacctcagctgtgtgcagtggcttacgcctgtaatcccagcactttgggaggccaaggcaggtgatcacctgggtcagtagtttgagaccagcctgggcaatatggtgaaacaccatctctactaaaaatacaaaaaatgagccgggcatggtggtgggtgcccgtaatttcagctactcaggaggctgaggcaggagaatcgcttgaacccgggaggtggaggttgcagtgagccaagatcatgccactgcaatccagcctgggtgacaagagcaagactctattaaaaaaaaaaaaaagaaaagaaacctcatgagtcacataaaaagttaccctaatagagtccacacttaggctttggaggtcatatggcctattgtaactgtggccattttagtagtaaaactttatttataaaaagtaggcagtggccaggcatggtggctcatgcctgtaatcccagcactttgggaggccaaggcgggtggatcacctgaggtcaggagtttgagaccagcatgaccaacatggtgaaacagtctctactaaaaatacaaacattagctgggtgtggtggcaggcgcctgtaatctcagctactcaggaggctgagacaggagaatcgcttgaacccgggaggtggaggttgtggtgagccaagatcatgccattgcactccagcctgggcgacaacagcaaaactccatctcaaaaaaaaaaaaaaaaaaaaaaggtaggcagcaggctaggtctgacctgaagcctatagtttgctgacctatcaactaaactgtcaaattctctagcccttgaattaggactatttgtgggttgcatccctttcacttgtttacgtatacctgcacttaggaaacaaaatatttaatgggaaatgatcatttatctgtgtaatgaattatagaccctgttttatttttaaaaaacaattagcttctcattatctggatctgaa

SEQ ID NO: 15715 - DNA, 80859 bp, Human
ccctcggcactttgggaggccgaggcaggcggatcatgaggtcaggagatcgagaccatcctggctaacacggtgaaaccctgtctctactaaaaatacaaaaaaatagctgggcatggtggcgggcgcctgtagtcccagctacttaggaggctgaggcaggagaatggcgtgaacccgggaggtggagcttgcagtgagcagagatcgcgccactgtactccagcctgggtgatagagtgagactccatctcaaaaaaaaaggaaagaaaaaagaaaatggggtgaagctcacaaccagcagaggagtgagaagaggcagcccagcgtggaggcgagcagggccttgagaagcaccgtcttacccgtgggccccacacccacccctgctggagcacgtgagctgtcagtgccttttgagtttggtgcaggtcacacttgttaattgaagaatgaatgacatttcaccctcctgaaaggagttatggatctagggaactggagcagctgcctgccatttcgttttactgtgggatctagagaccacagtcgcattgtgacattctaacttccacccctcctgccatgaggtggtttttgctgcccagggcttgcctgacctcagattccagcatcggggtcttcccaggagggtccctccagagagtgaatggtgagagagggacctgtattagttgacattaagcagacagagtagaggggccgccagcctcggccctgagtgggccctgtacttttacatctgttcttgcttctgtgcagaaggtaacctcaggtggcctgtctcatcacccccattccactcaagggaaacctgggcttagattggtcatgggaggcttgccatggtccctcacggtgggtggtgaagctcccagctcagacagtggctgccaaaggccagagtcctctgagccaggtggcctcttatgtggaaaaacagggttagggggctggcttaatatgaaatggcttctcctcttctaccagagaataaactttttaaaaaatatttttattttattttattttttgagatgaagtttcactcttgttgcccaggctggagtgcagtggcgtgatctcggctcactgcaatctccacttcctgggttgaagcgattctcctgcttcagcctctccagtagctgggattacaggtgcctgccaccacgtctggctatttttgtatttttagtagagaccgagtgtcaccatgttgtccaggctggtctcgaactcctgaccatcaggtgatctgcctgctttggcctcccagaatgctgggattacaggcgtgagccactgggcacggccagagaataaacttcttctttttttttttttttgagatggagtctcgctctgtcatccaggctggagtgcagtggcatgatctcggctcactgcaacctctgcctcccaggttcaagtgattcttctgcctcagcctccccagtagctgggactacagtcgtgcaccaccatgtccagctaatttttgtatttttagtagaaacggggtttcaccatattggccaggctgatctctgactcctggccttgtgatccgcctgcctaggcctcccaaagtgctgggattacgggggtgagccatcgcgcccggcccagagaataaacttagaggaaaaagactctggcacactcatccttatgtctttgtgccaggcacagggctctaacccaaagttgccctaaataaacgttacccgagtcagcttatggtgccagggcatgagggcagctctgggggcagtgggggctgcagcgctgcaggcagattctgcaggggtgatggatcccaggaggacctgtcccctctccagcagcccccacccattcccctgccctttgttgtgtgtggtgtgtggcctggaatcgatgtgactttgcctgtccaggcctgctgtttgtccatgtgtcacaatgtgacatgttgacccactgcagatcattccctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggtgggtagctcctttcctttagtcagattccgaggcctctgcaacctggagccttggagtgggggttccattagaattactgggtagcagaaagccgggacctctgttgtatgaaggaggttggggctgggagtggatgggagaccgccctttggtcacaggtgtgaaggggaggccatcaagggagactctgacacccggaggcagagcctggatgtgggacccaggactctcctactctgctcacgtctgacctggatttttggttcttttttgccaatccagtttcaggagggaggtccaccctcctgaggggggttttggaaatgacagctatgagaaagggactatcatgtctctgagtggggatcggggagctgggaggggcttccctctgctgcctagaattccactctgaaccattagtcattctttccagcgaagcaggtgcttctccgggcaacataaatcctcctcaaggtgactgaagtgaccggatggacaccaccaccctcctgagacaggctgacctgaggccattgggacctgggcacaggagggagaggggggagggggtggatacgttccagctttgaccagttcagccctaattgggagactcaggtggatgtcagctgctgctgggttcccccagtgttagttgcttaatctttcagtgctcagtttccgtccttcatcttggctcccacagaaggtgaaaaaagcatatttcttgctcactttcccagtttccttgggtttcaagacccagaagcactcacttttatccttgtcccatttttatggggctttctgtctggtagggctggccttgctcaggctggctctgctcctcactgcctggggtctggaggctttgctcttttatctggaaagtaggctaacaacaaggctttacttttagggtggctgagagtatggccagagataggtctgcgctcactgacaggtcctgtgttttcttagatcccctagagtgagggcctccttagtggagctcagctaaggtgactaacatcgagttgaattccttatgagaggcagcatttcccccagggcccagtggggaagtagtagagagatcatttacactcaggaagatgcacctctcttagctgtagagttgaaggggcgccagtgatatgggaagtgtttttcctggccctggaaaatgccctctgtcccttcctggccccaggctcagtgtccctaggcctttcctgctttcccctttcccctagctgagcggggctctgctctgtgactcacactctgccctttctcctctttggcttggctaacagcatgctggtccataggtaagggtccatggggagggctctgggggaagtccaaaggcaggaggccactgaggtcctttgctgtgccctggggagcaaccggcaaagccagggttggaggagggagtggattaggtggttgtgtaagaggcggaataacagatgggccacgggaggattggtaatgggaatgaggcaagggaggggtagggtgaggccaggttttggctgggggctgaatggggaatggggagtgggagggatgggtgaaaactggccgctggcccactcatagggtctgctgtgcacatgcagggagataactcactcttggtgcacttcgtaagtgccaggcatgaccaaagccacgactcttccctgagccagctttccaccctccccccaccaggctgtcaagggacagggccttggaattggatgcgtgttttttgtttttgttttttttttgagacggagtctcgttctgtcacccaggctggagtgcagtgggacaatcttggctcactgcaacctccgcctcccaggttcaagccattcttctgcctcagcctcccgagtagctgggcctataggcgtgcgccaccatgcctggctaatttttgtatttttagtggagatggggtttcaccacattggccaggctggtctcaaactcctgaccctgtgatctgcctgcctagcctcccaaagtgctgggattacaggccaccatgcctagactggaggtgcttaatagatgttatcatcaagctgaagataaggccaggcctcaggttaagccccaggttctagaagctttggggctgcatcacaggccttccctcccctcccttcccctcccttcagggcaggacagcctgctctgagcctggcccagttgtccttcatgagcggccagtgtctgctctggggagtgtgggcctaggctcacagccccaggcgttgggaggcacctgctggagcgccaggccttgttggctgcaggcgctgggcaggcactgcgcagttcccagaggctgtggccacagctaggcaagtggtgcttccctgggttccttcttcccgccatttgcggagtggcttttcttagtcatttgtttactgatgcccacacctgctgccgtggccactctttcactcagctattctgtctacagattccagtagcagtgcacctttggtcctatgtcagctcattcatcccttaggaggggcctgcattggagcattttgtttgtttgtttgttttcagatgaagtgttgctctgtcacccagtggagtgcagtggcgcatcttggctcactgcaactcccacctcccgggttcaagtaattctcctgcctcagcctcctgagtagctgggattataggcatgcaccaccacgcccagctaatttttgtgtttttagtagagacggggtttcactatgttggccaggctggtctcaaactcctgacctcaggtgatccgcccacctcggcctcccaaagtgctgggattataggcatgagccaccacgcccggcctagagcatttaacatctgcttagccctgcccttggccctacagtgagatgattgtttgcacctcagggatgcaggctgatcaggtggggaggccacacgtgggaaggatggcaggccatagcagaagatggctttatactgatagacgtctgagggacatcccatggtcacaccctgcaagtgacctggtagcaggcagagttatgtcaggagactgtcgtttggggaagcaaggattggagtggaggctgcgcttgccccccagggctggctgaccctgggcagaagcaccatctcctccccaccgcttccccaaaatgtgggagatcaaagcgctctttgaaggaatttactgtatttccaaatgcaatagaacaaaacacaccattatgggaaagatcacagctctgatggactttacacttattttttttattttttgtttttaattttttaaaaaaatttttattattatactttaagttctggggtacatgtgcagaacatggaggtttgtacataggtatacatttgccatggtggtttgctgcatccatcaacccatcatctaccttaggtattcctcctaatgctatccttcccctagccccccgccccctgacaggcctcggtgtgatgttcccctccttgtgtccaaaaatgtggaacgcttcatgaatttgtatgtgtcacccttgtgcaggggccatactaatcttctctgtattgttccaattttagtatatgtgctgctgaagcgagcacaactttacacttattttataatttagtatttttaaaaaattttgagttgcatgtggagagacaccataatatttttcagtgcattttagaaaaagttttttattttaatttatttttaaattaattaattgtttattttttgagacagggttgcccaggctggagtgcaagtggcacgatcacagctcactacagcctcgaacacctgggctcaagcgatcctcttgccttggcctcccaagtaactggaactacgcccagctagtttttacatttttgtagagacagggtctcactatgttgcctagactggtctcaaactcctggcctcaagtgattctcccaccttggcctcccaaagtgagcccaggagttcaaggttgcagtgagctatgaacgcgccactgcattccagcctgggtggcagagggagactctgtctcaaaaaaaaaaaaaattgtaaaatctgaatatttgatactatattttatgttgttttctagaaatttctgtctaggtgctgaatcatgcagcctgctcttctactcagccgtgtgtttcagaacgtttcacagtgctgtgtgtagacctcgtgcttttttttttttttttttgagacggagtctcactctgttgcccaggctggagtgcagtggcgcgatctctgctcactgcaagctccgcctcccaggttcatgccattctcctgcctcagtctcctgagtagctgggactacaggcgcccgccaccatgcccggctaattttttgtatttttagtagagatggggtttcaccgtgttagccaggatggtcttgatctcctgacctcgtgatccgcccgcctcggcctcccaaagtgctgggattacaggcatgagccaccgcgcccggccgacctagtgcttttaactgctgtagtttagctgctgtaggaatgggccgtgggttttttttttttttcttcatttctttggttgctggacacctaagttgtttgtcattgttcctgacgttttcatgcaagatgatggcggggcgggggcagtgtccacgtgccccccgtatgcgggtggcgtggccgggatgtgggcacacactttttcagtttaccccgccccactcacaccctcgtgtgcactcaagattgtcccctgtcgagtgtgggcgaggagaggcacaccactattgttttaatttgcttttacctgattcctggtaggttgagcatctcttcacatttatctcagctgcttgggtttcctctggggcctctgagaaccctcatccaggagggtctcggtcacaccagggttggtgtcacctcccttcagggtgccaggcacccctcttcagaggtgctgatttcctcatctggcatccaggcacatttctgcggccgccctcccaggacatgacacagctcattaggtttcagctttttatcttcccttttatgagactacactgtagtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatcccactgcttggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatgaagtgggttgcccaggaagtaggggctctcttccctctctgccatgtcacacagtaaagccacttgcttgtgaatctcccacccctcgtgtgttccacaaacatggttatttttcccacatgaggcttcctgcaaaacggcctgcgcattccggacctaggcgagctgggtggcaggagcaagccggcatgagttgaaaggaagccaccagcgtggcaccagctcgtgatgggtgccaggggatgtttgggtgcccgggcaccagcaccgaggggtgggtggactgcatgggaagtgggctctgggcccttcgaggaaagtgtgggaggggagggccgtcagttccttctgcagcctttctgagatgcctcccacacctcccagactgtggggtgaagctcttggggttcctggcccgctctcccaaggctgtctctggggggtgcttctgggctgcttcccggggatcctgctgggggagtgggtggtcctggggctcagcgggggttgggcttgctgatgcagagccctgagcgtcctgtgatcacccccgaggctaatctgcagagtaaggccaagatcagcgtcagcagcacattgttccagacagttttcatttaaggtgaacccttgatcccagggcagaacaggacatgtttttcatttagtttatgacttgagatttttctccatctggtgagagaagtgggtgggggccagcctgctcatgtcaaagacagtgcattccaaagaatgccctgttcctgctgtcctgaacatgctggacacactccgaggatggatgctctggcggcccacaagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccagcctcctgacatgggcctctggagccagggctgcagccgaagtgcctggccatcctggcgtttcctcccactgcctggcctgcatgcttcctctctcctttcacctttgcacacacccagcatgccagagatatgaggtggtgaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctctggtggaagcacagcccagtcggcaccttgattttggcccagtggtaactaattggggattgctgttgttttcagcccctaagttggcggtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccggaggaggtccctgccctctggcttcctgcaggcctgacgttgaccagcagtcattgaggtacatatgggtctcccagcactgggagcttggctggctgaatgcatagcaggtcctgaggacgcttttatttatgcacaagccccctcaggtcacttcccactagcctagccaacagtgtgtttttaaagtgaagttcattgtgaaggttctcagtggctcatgaatggcagagtggttaagatgcagtaagatttggccgggcgcggtggcccacgcctgtaatcccagcactttgggaggctgaggtgggtggatcacctgaggtcaggagttcgagaccaacctggccaacatagtgaaacctcatctctactaaaaatacaaaaatttagccggatgtgatggtgtacgcctgtagtcccagctactcgggaggctggggcaggagaatctcttgaacccaggaggcggaggttgcagtgagccgagatggcaccactgtactccagcctgggtaacagagtgagactctgtctttaaaaaaaaaaaaaaaaaaaaagatgcagtaagatttggaagacagcatgtgtctgtgtgtttggcatacgggtttttttttttttttttttttggtcataagcttttgattagtctcattttgagatagtttttcactggaacagtttgtggtcattggtgggagagggagtgagctcttcaaagtggtttcaaaaggagaaaagttaagaaacatgttgcagttccgtgggctgctgccggggagagtatccggacggcatctggagtgggatgacgaggcccagctctgtgatgccagaagcccagtgggtggatcagttgagccaaggagttggagaccatcctggggaacatggcaaaaccctgccactacaaaaaatacaaaaattagccgtgtgtggtggtgtgcacctgtagtcccagctactgggttggctgaggtaggagaatcacttgaacccaggaggtcgaggctgcagtgagctgtgatcacactactgcactccagcctgggcaacagagcaagaccctgtcttaaaaaacaaaaacaaagacaggccaacaggccacaaccagggaagcacttaaataacttaatagttatcaatgcagttgtccctgggtatccataggagattggttccagttccccgtggataccaaaatcggcagatgctcaggtccctgatgggaaacaatgttgtattcgagtataacgtatgcccaccctcccatgtactttacatcatctctagattacttatcatacccaagacagtgtacatgctgggtagttacactgtattattttttatgttattactttttgtttttatttttttcctgaatttttctttttttttttttttgagacagcatctcactctgtttcccaggctggagtgcagtggcatgatcttggcttactgcaacctctgcctctcaggttcaagcgattcccctgcctcagcctcccaagtagctgggattacggggacctgccaccaagcccagctaacttttttgtagttttagtagagatggggtttcaccatcttggccaggccttgtgatccacctgactcggcctcccaaagtgctgggattataggcatgagccaccgcgccaggccttttttttctttttgagacagagtcttgctctgttgcccaggctggagtgcagtggcacgatctcgactcactgcaacctccacctcccaggttcaagtggttctcctgcctcagcctcctgagtagctgggattataggcatgcaccactgtgcctgactaatttttgtatttttagtagagacagggtttcaccatgttggcaaggctggtgtcgaactcctgacctcaggtgatctgcccgcgttggcctcccaaagtgctgggattacaggcatgagccaccacgcctggctcttgaatatttttatctgcagttgctgcggagggctggctggtggtggcgggactcatgctcaggtgttgtgcccagtgcatgtcatgcagtatttcaatgaatcttcacagcaaatgctgttaatatcccctttggagactgaagcttgaagaggttcattcatacattcttcaaatgtttattgagcatctactgtgcgctgggcaccatcccggcccctggccctcacgcagcagcttcagtggtgaatgaatgtatagcactgccggtgacacagcaggcaaggggagggacagacaggggtggtggtcagggaaggcctctctgatgggtgtcctttcaccagaaacctgattctcatgcaggagggccctcaggtgtctggggaagagcattctgtcaggaaaacacaagtgcaaaagtcctggggcactcttgagtgtcctcggaggttttaagggacagctgccgctggagccaggcagagggagaatggaggagcaggacggagaggtggctggggacggtggtgcaggccttgcgggccatggggagagacattccctggactctgagctgggagccattgcagaggtggcatgatctgagtcagagtttcaaggtcactgcaccaaggacagaggagaagagacaaaggtggagctgagaggccagcaggccccagatggcagcttgaccacagtgggactggcggaggtgggagcagtgatcagggagagctgagagaggtggcttggccagcccatggttgggcctgagtgacccgtgggaggcaaggccgttggctgccctggggcaaccgtgggaggagaggcttgtggaggaagagctcggttttgcctgtgtccgacacggatgtccttgggctccagacagtgtgagaaggccaggcatggtggctcacgcctataatcccaagcactttgggaggccaaggcaggcggatcgcttgagcccaggagttcgaaaccagcccgggcaacgtggtgaaatgtcatctctgtaaaaatacaaaatttagccaggtgtggtggtgagcaccggctactgggaaggctgaggtgggtgggtcacttgagctctgggggtcgaggctgccatgagttgtgctcaagccactgaactccagtttgggtggcagagtgagaccctgtatcagaaaaaaaaaaaaaacccaaaacaaaacagactgtgtgtgagtctggactcctggggagctgggggcactggagaggggccttggccccaggcccactgtgtgcctttctgggctgtggctctagggagtgttttcccagcattgggctggggtgctgcccgcttctgctcatcagcacccactccgtcccttccctcttccctcccaggcttcctaggtgagccacctgctcccacccctccctccacctggccagctggcatctcctccactctgttggaacatttcttcccaaggcctcctcctgctcttccttgttcagaccatgggaggctttcccggccttctctttctgggtctttgggggagttcacactgcggaccctcactcttcctggagaccggccttcctgtgcgccacgatgcttttctggctctcttcctgctgttcttgtgaattctgcttcctccacctgatgttcatttgctcagcgaatagtcaccgagaacctgccatgcaccaggcactgtgtgtgtcctcagagagtgaatgacctctgtccttccagagcacagatatgtttgtaatgaacactgtgataagggctcaggaaacaaagatcaaggtgtcacagagggactgacaggcttttccctctgtcatctgagtctcagtctgtggcctggactcctcagggcttcaggaccttgggtccaggcactgtggccctacgtgggagtctccagtctccaaagggagcccctgccaagacctccccaatgttctgttctttccctatcactccagatgccagggcagtggtccaaggaccagcatggactccctcttctcacctgcccccggatctgtaccctcgcggactccacctggcttcatgccatcacccccgccagatcaccagcagcagctgcttgcagccagtctccccactgctcctctctagccacccttgagggccatgctcagaggtccccaggttttccaggaaatggaacttttcccctgtcccgggaggcccttctggcaggcgtcctcccacctgtatcctcagtcatcccaggtcttgggcctttctgggtgatctggcttctcttgtgcaaggctgcccacagacctttgttaccgcagcttggagtggtccttgtcaggtgtcccctccctcatacctcctcaccctgccctctctgactcagggttgctgacttttggggccatccctggcactacaggtgtccagcaatgtccccggcctctgcccactagatgtcagtagtaccccaagcccaggccatctgagtggtttccagacattgcctgatgtcccttgagggccatggctgcctgggcgttctgagtacctacccctcagcacagcctgccatacctgctgtcactgtttgtctctcactgtccccttcccaggagcatcctaagagagttgaagcggagcctgctctgcttctgtgtccccaatcctggcatgtgcagtgctccgggtggcagctgctgcctgaccttctgtgtcaaggagggtagggcacctgttgtagctcagtgcctgtgcccagcaccatgcctggcagaaatggatgtccaggcagtgtttattggctttgtgagcgtggattgcccattgactggttttctgcagtggcacctggtggacaaggtgaggctccattgtgccaggttctatgcacaccccgactctgtgaaataaagcactgcatggaggtaaagagcagcagtcatttgtagcaggctcagcgattcctggcatcccagtgaagataagataggcagcctgtgccactccagctcccagagcccccctgcttgccctgccctgccatgccctgtgttgtcccgagggagccagcatgggaggcacagcagctgccttgagcagttatttacaagagcaaagtgtgcacatgctttggtattttaactttattgaagaccagttgcatgtaaccaacatcaaagctgctggagacatagcaagttggaaccctacttccaacctagaaggatttctaggcagagttgcctgtgtctgacttcccttcctcactgggaccccgtaaacctgaaggggagctgtaaggaatcctgccaagacggcagatgcacacggggtcacgccggtttcctccagccttgggagggtgcttcctggtgcctttgtttgtccccttccaagccctgcgtggccaccctgctttctgctctccctgggtgcctggctctcatgtgcaggtctttgcttggggacacccaagtccatcctcaaggtcagtgtgcagctcctcccctctgaggcccctctctcccacagtgcaccctgcccaagacctctcgctccattgggccgggggtggctcctgcacatgtgctccagggaggaaaggcatttgacaggtcagctgcagacaggtgttctgacactcactgtcaaccagaccaaagccccagcccttggccctgcagaggatacctatagaggggcagcaggccttatgtctgtatcaggacgctgacctgtccctctggccggggactttcctgcttttagcctgagagtctctttccctggaacccaagtcagtcctgggcagaacaggacagttggccactgtagtctggagagttgtttgggaagaggcagcttttcctttctgggaggtgagagtccacttgctgcgctgggccgctggctgggcctggggtttcctgggcctggatgtttgacctgctggctggtactggcagcagctgcaccccagggtggccagacggtaggtggcgctgtgggcaaggtgaggtgtgcttctcctggctcctgggaggaggaagaggaggaggaggagaaggaagaaaaggtgtgggtgctcctgcctcacctcagtcacctcctcacctgcagctccctcacctgcctaccacccttagtgtgagtttgctgctgctgctgcctcagtttccattttcagatccccagccagcggtctatggctcgtttctgagtgccccaagggatccctccaggtgccgggaaagccgaccttgtaggtgctatgggatcagcccaggccctgtacccttgtcattcacatccccttcctgggcatcggtttctccatttgtaaagtgaggacgctcagctgaggccccatctagctctgaaatgctgcaatccctgcgctttaccaagtcctggctctggggcagctctgtgccgggacgggaccctgccctcctgggctggcactggattaacaaggtcagattggacattagatgttacatagaaaaatcagcatttggttaataagaaagctcacaacttattaaccaaggagttacggagagagcataaccaggtaatgcgtggggagacagggtcgtgggggctggaggaggtgatggtgggccataggcagggcagcacttggcccacgtgggctttttggaggagtcataggggcagggtgggcaggagttgaggccaaggaaagggatatgagtgtagacaaaaggtggactacaggtgggcctggggcttgtgagggaggaccccaagtgcatacctgcaatctggactgtctgctcaaggatggtggcatgtgtgtgtgtgtgtatgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcgtcctctgccagggcctcttgcacttgtgggaaagctgagctgagctgggcttactggcggagcctgtggcacaagaagggtttttctttgagcagagccagctggctcatcaggcctgactgagaccttggctctaggagcacagctcttgtctcttcagaccagtgtcacctaagatactgtggccctcctagctctcccccgctcctgtctgggctgtgctcacagctggactcctgcagaacgaatggcaggtctagcttcagctccatggctggggacagtcagtgccttgtccccagtgcccacgctcactcccctggccccttgatgttgggtctcaagtgcaagccgttccacggcacatgagtgtgggatctttcagagccaggcagtggacgtgggcttttagctggcaacagccctgctgcccctggggcactgcctgcctctgaatggcagctgagctgggcagcagcattgctctgtgtgctgctggcactggcctggtggggagcctctgctatcaggctagggctaactttagaattgtggtgcctgagcaacgtggtgacaaagtgtacaacaaggtgtctcgaactgggtcagctcacagcctgtgccaggatggctgggagtgacatggacaggaacaaaagggaggggagagggagcgcactcccacctggagcctggcaggcaggatccccactgagccgatctcttccactgagccggcccatccctccctgtaggttcctcatactccagagatggctgggtgggacccaagcgtgtcttccctggatgatttatttttggttctggcatttacagcatgatgaaggctattggacactgctagtgtgagcagaatcaccctaaccgaaaggcagcgtgcggccctgggcagtagggtttggtgtagacatctctcgggatccctcccacactgaggagaggaggcaggggacccaggctgccttagttactttcccttttcttaggcattcccagtaggttgggcctcctacttccacctttctgtggacccggctggtggccttcaggctaagcatggctggtgaggttcgttcgcgacctgcccccctgcgcccagttgggtgcatctcctgaaacttatctcccagagcttgggccacctgagccaccactgttctgcagacgcgttcttctccgtacttcagtgcctttgcactttctgcttcctccccttcgccagctttcccgccttcacctggctgccttggctcttccagcctggcttccctgagccctggctctgtgcagacatggctgggccctcctccctgtgccttcctgaaccctgcggcagtgctgagccctagccccgggaactgaggttgaaagtgtgtgttttgcctcctgcctagactgagagctcttggaaactaggggtggggtctgaggcacctgtggatgtcccgggcctggcctggtgctgtgaggcatggatggtgaagggtgccctctttcctggaggaggaaccctgaggcgtccccaggaagccatgcaaccaggcacactcacccccaactctactgggatcacgcacaacccgcttggctgttccccactttctcatgccttctttctctccctgtaaaactccctgccaggccccaggcctgcactgtcaggaactgagatgcagcccagcggggctgtgttatttgctttaccccattcctgggtcttctttggaggctgaatgaaattccatggacaatttccaaggcatgagtttttgtgtcatttcactgctaacctacttggtgacccaaaacaaaacccttcccttgagtctggaggagcagcctctgccccactttgctcagaggtgcaacaaggccttcaggagggaatgggtgtaaaagggtttgggctccaaggagaagcagctgcgggagctgcctggctgctccatctccagaagagctcttgcatgagtggaaacacccaggcctgcctctttcagccactgctcccagctttaggccaagcactttcacttagccccagaaactcttgcctagaaaattctcatggcctctagggatacatcttggagagtacttctgtagctggcggcccctttctctccagaagtgcggagtcagcctgggagggacagcttgagactcaggagctgatggatgtgctcatttgtggccaatgccacagggccacacagtggcagctggtgttgggctctccagtgtcacggatgctgctgccagggttcatcagttgccctagaggcagccctgttcctgccacctgtcctgactccccgccctccccatttcctgccaggcgtggcacagtgagacttaggtgggctcagataggagacggtaagtgctaggctgcccactgggcctcccggttcagaagatgctgggctgagaacactgagcttctgttccaggggagtttcccttgtttgtgttactgctggaccttgagatgattccattattttattcaaaaaaggggacactggcctgatgcagaggtgtggtctctctcctgcaggtgttggtggctggtgagcctgggctggctgtggggacccttcgcttacaggcaaggtgtgccctgggcagtgggcagagatctcaagagaagctgaaatgggggcagagcagcctgactcaaaggtcctgggggaagggggatggagaatctggttgcctgatgggaagtagccaattaggagggtcctgaggatggacgcagagggtgggaggtggagcctgcagagattccccagccacagttttcaaaaccagctgttgtctcgcaaggcactggcaggcaggcgcagggctctgcaggtgtgcaagaggttccaggcagctgctgggctcaccctcctaggaagacatttgtcccaccatcccatgctgaaaatgacccaaggcagggaccccacccggtgtgtgcagtgcaggggtgtgtgttcctggaggcctttctcccaaggccctccctggccagggcacccctaccaggctgagtcccacctgtccagctgacgtcacagcctcttgcttgaattggcatgggcggtgggtgtgagcccctctggtgaggacagcgttggcagctgctaggcactgtcccccttgggcagctgtgggagcagagggaagagagactgggggtacccgccttcccagatggagcgggctgctcatgggacttagctggagtttccaaggagactgaggtttgggggtttctgtgagctggccggatgttgctgaagtgcctctgccctctctggcctctgtgcccttattatgtgtaattctgttctgcaccgccctgctgtgtaaacttggcaagttctggtcccctctcctgcttatagtttcctgggctaaaatcaaaggaggtaaattatctcccaaggtcctttccattctggatcctctgttaatccaagggagatggggaagagggcttggaaacagctggatttggggatgaagattccactgggggcagaggggaggcagccccccacccaagccccatactccatctccattcctcactccctgccaggagtggaatgtgggcaggtaagagtcccagaggggtaagagccattggtgggaagcaactgtgggaccagtgccgccaccatggcccaaggacctggtgttcgatgccgcatccttccggtggcgtctgtggctcttctccttccccctgacccacccatgcctccgccctggggctggtgggattgctctcaaaaccaccttagccaagagggctccttcccagactcaggaggaagaacataggggacagccaggcctaaaggggctgggcaggggctctagagaattaaagctgcccaggccacagccccgccctgtgagggcctcacaagccctgtgcaggccgagtgctagagactcccctcttccaggagccagtgccctcctggggaggcgggcagactgtgccccactcctgggtgaggtgggtggggctgtgctggagctggctgccctagtggcctcagacctggccatgtgcgttcttagaaaggcgtttggtctttcctctaagatgagcatagcgtcccttcctcagggttggctgaggagcttggtgtggacagccgggctccaggcacacagcggccccagtacacctgtcgctttgcctgccacccgcttacggtagcagcatggttgtaataaagcaataaagccagcgtggatgggcgatgttgctattgctattaatgatctttgctcatgaaatttttagtcgcctttctggccttcctctatctcaggccaaaactgccccttcttcctaaggggcaccctgtgcttcttgctgcagaatcctggggcttcccccttcgcatttccgtggaactcagagatggtacctccctgcgaggtggggctgagagggggcccctgcggatgcggttattggaagggctgaggggtcagaggccaggtttggccccaccaatggctggcaccaataacaacacccatgtagaccaggtgtctgcccagaagccccatgtacctgaggtcaggaagcctccctgggaggtggaggtgctgttaaggagcagctggtgggaacccccaacgtgcttctctccgagggcctcaggggctcttagtctgccggctcctcaggctggggcttcctgcacccctagcgcccaccctccaactctcccctgctgctgagacagatcttggagcctcggccaggctgtcctagtcacaaggtaagtgtccaaggcaggcgtcagagtcaccagcagccacttgaggcctccttccctttgaattgagaggcatggaaaagggagcgtctgcgaggaaaggatggctgcatgcaggttccttgtcaggtgggtggggacgtgggacatgcctgacatcagagaagccacatggggcagggggatggggaaatggcctcctctgggcaagggtctggtgggacctgggggcatttctctctctttttttttcttgagacagactcttgctctgtcacccaggctggagtgcagtggtgcgatctccactcactgcaagctctgcctcccaggttcaagaaattctcccacctcagcctcccaagtagctgggactaccggtgtgtgccaccatgcccggctaatttttgcaattttagtagagacaaggtttcaccatgttggccaggctggtctcaaactcctgacctcaagtgatctgcctgtctcagcctctcaaagtgctgggattacaggtgagccaccgtgcccggccaggggcaattgtctgctcgaaggcacatgttccccaacagcctttgagcgtgggatcaagggagtgcagctgtcttgaggggcgggacagcccgtggcgagggacagtgccctccccatcaggagctcagtgctaaccgtgcctccactgtgactgtcacggtggtcagcctcatagtcatcatcaacactcctgccactgtcgtggctgccgctgcagtgagctcagtgcctgagacacaacacatggatccagcggatccgatctgccttaaggggcagcactggtgttacagaagcagcagctgaaggcccgagaagtcacttgacttgtcagggcctcggccgtgtgtgcagagctggtcccgccctgtgcttcatgccccctatgcctctcactgcctggtacatggatgcatcatggcaggaaagtggaaaaacagccccgagctgcagcacggccgactccaatgggccggaacgccagccttgctggcaggaagaggccctccaagcgcctctcgtggatccggcccagatccggtcctgaggcccctcccaccggagcctggggtgccctcacatgccctgcgccaacttcgcaacagcccagcttcccggctgctgtgtgccctgcctgtgtcaatattatgactggacttcctgtgggtcaggccgcacgtggggcgtccgcgtgaggtagccacgtggaagtggtacccccatgtccttgagcccactggagtctgtcccccttgccatcctcgggagcccggtgcggttgtgcccccctcatatctctgggcctctcagcacacaggtctgtcctgcctttgatagcaagacggacctgggcaaggttcctggcttctccgagccttggtattctcatctgtgacccaggcacagctgcctggctcactgttgcaagggccgggatggtgcctggagtgggtggtgcctggagccagctcagcgtcagtgaccctcgtctgttccctcttcctacctccagtcttaccgtccgcttccccctcgggcagccaccccagggcatctgttgtggaactgctctgtgggttttgtccttgatacctttccaggcttcttcaggttgggctcaggcagggactcagggggacttagcttccagcttgcagcctcaccgcttgggttccggctgtggctggccattcactgtgctaagcttcgtgccttggcgttcttaactgtgaaagagggttacctgtaggttccacctcctgggtcgtgtgaggatgtgacacactccgtgtgcagcacagggagccaggcagagttgaagcctgaaaaatgtgagctgggagtggctgttgtcctctgggccctgccccacggtgcccagtgaatgtttgatgactgtggtgtgtgtgggtcctgcccatcatgtgagactccctggaacctgaggcaaataggatttgagtgtggggtctggaggaagggaggagagaggggagaggaaggcgcggccggggtccttgctatcttcagtcacactgcacacattgctgactcctagacgtgtgtcaggccaggcccagggttcagggatcccagggcccaggggatggttggttaaaggcagtcttgggagcgggaaggacaagcggaagctcaggcagcgtgtaggtgagggtggggtgaggtggaggtggggaggagtgtcgaggggaggctggacaccctgcccctgtggctagggcagcagggagcctgtgtagacatgcagctggtgtggacgcgaagggtggcttggttgggacctgtcacccggtcaccatgctgctccttggctaggcagggctattcctcaagggccagtttggttaaaaggtgatgatgtctgcacagatgtggctccaaattccaccatccccaggggcccgcgcccccattcccggttctctaacccctccccggggccggtgtggtgaagacagcacagcttctgggccccaggcagcccctgttgctccttagctatgtggctttggataggttacctgcctacccttttctggataggtacctctgtctccttttccgataacctctgccacagcctctgctgtggcatttggtgatgaaatgagaccatgtgtgccaagagctggtccaggacctggccccggctggcgagtggcggggatggggcggccccttggtgtctgctcctgcctcccaggcgggcagctcggcctggcccagggcacatttctcctgcacccaggcatgttcttgcctctggtgtccccgaggctggggcctacagcctttccatcgtacttggcacactggaggcctccctgtctgccttcacccgatgcctgccttgaccatgtgatggtcaaggagtgcacagtgtacagcacatggggtgctgtgcaaaggacatgccccagccaggtcaccggggatctttctggccaggtcaggccgtggcttcgctgtgactgtcttggagaccgggtcttggcgggcctggtggaggccttaggtggggtagagtagccggtaggcctcagaggctttgtccacctctgacttcccagcactcaggtggggcccactcaggccaggaagagcaccgggccactcgcagccgtgcagcggggctccagccccagtcacaccactgattggcctgggcttgccgtttcactgctctgaaccataggttccccactcagaaactgggagggcgtggggctgcatggtgggccttttctgcccccacacttctgttgccatcctgttctcgggctcccctctgtgcctagggtttcctgggaatcctggcccagactcactgataaccacaaatgcccacccaatccagaggccacaattcctccacccctacttggacgtcccttaccagccagaactggccttcatctggccccaccagcctttggcacctctgaggactcacaggcccgtttcaaggagctcagtgctggactgcctctgacccctgtccctctccacaggtgcccaggctctggctggcccccttcacagcgggttcccttccccgacaggcctctgaggggcaggcacccgctttaaacaggctgcctggcttccagtcctgttctgcctgcctcgagcaggtcagttagcctctgtgagcctcagtttcctcttctgtgaaatgggtacagtggtgttgatctcattggcaaggcttgcatgggaagtcctaacgtagtgttccttcagaccccactgcctccagccctccccagggtccccttttctgaagtcctatgtcttggagccaggcgtggagaaggggctgggaccagcctcgccagcacacttgctagctgtgcagccccggcgggtcataccgggcctctgggactcagtttccttgtctgtaaaaatgggggggagcgtaagaagctgcgacggggtgaagtgagcagagacgaggtctgatttggattttgtgaaggtttctgcaaccatggcagggatgcagagagagcagggttgggatgggatgcattttggaaatggtgaaggacttgctgatggaaacctttccaatcagacttgctaagaattctttcgtgcttctcttaggaccctggttgggtgggctgaccttggagtggtgcttcctgctaggtggtgggggcaggctctgggaggggtgtcggctggaagggaccttgttatagtgtacatggagcacctgaggcctaggagggctcagaaatcactacaaacccgttgtcaagccaggctccggtccactctgctgccctttctttttgtttttttttttttttttcgtgagactggttctcactctgcctgggcaggagtgcagtagcgccatctctgctcactgcaacctctgcctcctgggctcaggcgatcctcccatttcagcccaagtagctgggaatacagccacacgtcaccatgcctggctaattttttttgttttttgttttttttttttgagatagagtttcactcttgttgcccaggttggagtacaatggcacgatctcagctcactgcaacccctgcctcccaggttcaagcaattctcctgcctcagcctcccaagtagctgggattacaggcgtgtgccaccacacccagctaattttttgtatttgtagtagagacagtgtttcaccatgttggccaggctggtttcgaactcttgacctcaggtgttccacctgcctcagcctcccaaagccctgggattgcaggcatgagccaccacgcccagccctaatttttaaatttgtgtgtgtgtgtgtgtgtgtttgtatgtgtgtggagacgggagtctcgccatgttgcccaggctggtctcaaactcctgggctccagcgattctgccgcctcaccctcccaaagtgctgggactgtaagcatacgctcctgtgcccagcctccactgccctttctttccgtgcctccagctggctcctctgactgtcctgcagcaggaagctactgcaggtgccaagctcttggggttctggtgtttagcccagccagccaagcatggttctgtccctagctagtccctggccctccctggccattcgcttagagatgccatttcctcctagtaaaccctggggagggtgaggccggcttgaagctcagcttggcagccatgggctccaggagccagtattttccctcgggaacacctgacagtcccggacgcctggctctacatggaactgggagagtggcctgtcattgtcaccagcccctgcaatgtccccctctactccttggtgctggcttgggcccaccccatttcagtcctgctgagctttgccttggttctttattcattcagcaaacatctcctgggcatttgccccaatggaaagtactgttctgggcgctgtgggcttttggccatgagcaggaagttgactccggaggctgcagggacctgcttaggcatcctcattaccgcctgggtcccagagcgagccaggagcctctgaggcagcgggggcttctcaaccacacacctggctctcctcctccaagactttctgcgtgcaccagcatcttccattttgtgtttcctgtctgtttaccatgtgtaattttgtcagcatgtcacgtccctttcataatgaagcaagggacaaagaaacaagggccagtggagcccagtacagggtggccagaggtgtcggctctatgtaggtctgctgctctggtgtgtccctgcgtgagggtcaggctggggaggtggcggcaagaatcagccaggcaggaaagactaacaggctgcccagaggccgggagccggtgcatgggtggtagtggttgggggcattgctgagtgcagaggctccgggggaaaagccaggggttaagggatgccaggcaggcatctgacctgggactgaatcctctggcagcaacctagaagcagctcagcaaggtgagggagatttgaggcatcagaggcaaattatgtcctcttagagcccctgcggatctgccaagactgagggcttctctgtctcttttctgcatcctgtgcttggctgaagatgagaaccttgctttcccactgagaggcagtgggccacagcactgcgggagccacgacatctgcagacgcatttgatttccccattaatagcaaagctcccactccaaggatcttccagcagacaaagggcattttaaccttcctctcagtcccagttgcttggagtggctcatgtggcctctctgaaggagggaggaggcttcagacagccccatgcatgttcagaggcaacagaaatttgcaggaagggccaggcgcagcggctcacacctgtaatcccagcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctctcatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatccagccacttcagtgcgacgtgtgactgctgcttgtgcccttccccaggagtggctgtgttccgctcatcatggaggcctggtgcccggcacagtgcgcagcacttcaaggcctcagagcatgtttccttaaagccacatcatctgtgaaaggagcggagcattcaagcctgctggctcttcccaggcagagggagacctggaggagaagcccagggacccacgcatccccctccttctatgggagccactctgcctgccccacccagatgccatattcagaggatgggaggcagaaaaacaggtggcttccgccccagagggcgagcatttgcttctgtgtgatcggagggcagcacaggggctggctgggccctgggatcatcgtgacaggctttagtggtctgggtggatgggccgtggtcagagccgatgtgaccaaattggctttcaggggagcccaggccaccttctgagtggaacccaagcaccagcataggtcctggaggggccaaaggaaaagggaggttcagactcactcaggtgtgaatgctgcccctgcccaggtagggacatggcacccccaccctcttctgtgatgcaggcctagaggtggcagttctggaaagttcctcctcaccttgcaggggaaactgttgaggtggagggcacttgtccagggcagcacactgtgacaggtgggagccgaggctcgggaggtgggccgggctgagctgtgacaggtgctggtgagcatctcctccgcttccccgtgctctggccgtagcagaaagtgtcccactgctgtctccaggcagctctggctcttccctaattcggccccatccctccgtgtcgcccttcttcttgggggtgggtacagtgctctgcagagctccatggcttcccagctgggtgacatggacaagccatgtcctcactctgggctccagtttcctcctctgttaaatgggcatagtgggagtacctgcttgtaggatcatcgtgagaatccagtgagttggtccctctgcagggtttagagctgtgcccattagtgctcatgcatgtgtgtgtggtcactctggtgcccatccgcatccccagtggaggccgtgcatggccttgaatgagtagctatgtgctccctttcacttctgtgctgtgggacctttaaaaaaatctgctggccgggcgcgatggctcgtgcctgtaatcctagcactttgggaggccgaggtgggtggatcacctgaagtcaggagtttgagatcagcctgaccaacatggtgaaaccctgtctctactaaaaatacaaaaattagccaggagtggtggcgggcacctgtaatcccagctactcgggaggctgaggcaggagaactgcttgaagccgggaggcagaggttgtagtgagccaagatcctgtcactacactccagcctgggagacagagcgagacactctgtctcaaaaaattaaaaataaaaataataaaaattttaaaaatctgctgaattcactctggccgtcactgatgaaaccttgcagggaagcggctccgttgcctcagcctgtgccgctcgcagctcacgtttgctggcttaaaagcagccagagcagggaggcaagctgcccacgctgttggccgcgcactctgccttccgaacacgttcctgtactgcttgccgtgcacggagggccacgttcatgcctttggggccacgacagctctctctagagtaggacatgggaggggggctgtgaacatctggggcagcatcttctcttcatggattgtcaggaactgcacccttgtttaccgagggacagaggccagcctcccactgccttgtggctgaggggagggggccgggtctctaacgctgtcttctttgtactgaaaaccaaacaccttctctgcacaaggtatgtctgtgagagaaacagacaagaggacagaacggagcaggtgctgaaagggttgctgttggctgcaggatcccggctaccaggccccgagcctggcctctgctggccttcacagccagttcctgctcacgggccaggtctcaggtccagtgcctcctcccgcagaagcctccagaccctcctgcccagaggagccccccaccccacccctggctgggtgtgctctgggtgggagggctgtgactgccgggcagcggggagggagggcgagtggttcccccaagtgcggctcctctcctgtcgtggcagggacatggcagctttcaggacaggcagaggacatagtagggaactgaggagagttgtccagagaagtttctagatttggctcagctttccacgtagggtacagacctggaagggaccgtctggccacatctgactgccaagtgctgccggggagaacctgctgaaggtgctggacgtggctgtcctgcgagaaggccacgcgtgggagctgaactgagcagggggtgctgggtcaggttagtgctggccattgggtggacgcgggcccatcgtgggcttgtgagccactgtgggcttaaaaagtgcagagttggggggatccagagtgaggggctggagcacaatttcatgtgaggggtcattctgggacagtggcaccacaagcagacccgggtggccgctggtaagggcctgtgtgtgtggttgcctacgctctttccatctcttgtcggcttctcacagcctccacagaagacagggatagttacagggaggacagggaaagtccgaagtgtgcaggcgccctgcatccccgcagccaagttctgggcggacactgccctgagccaggacggtgaggtgggacgccttccccacccagctgccagatcacccctcctggagggtggggtggggccctgacaccttgttctttgtccctgccccaaactttggggcctgaatagaggaaggcagtgacattaacttcttcctggccatggatacaggtccctgaggacaccgtgtgtggggacagcaaagccttcctaatcccccagccggccaggcaccttcacacctaaatggaaacctgcatgctggtttccatgaagaaaaggttgcgattggggtttctgggaggccagtgaggggttgggactctacagaggagagtggactcacggggcgctgggccgccctccagccaaggctcctggcctgggggaaagggggcaagggatgagggatgcagggagcagtgtgttcagaaaaggttgttccctgagcacagatttgacacctcttcactgtcagcgctgagacacgcccctgccctggggagctcagaaagtcaggtgcgggatccagtggcctaattttagatcttgggtctccatgtcgaaacgacagcagagtgattaaaaaagaaaacgacagcatggccttgcccccttgttaattatggatcaagcacatttccatgagaggggcatctccacgcagggccaccgtggccgcatttctgcagcctgcaggtctccgtggcacccacaccccccaaccgggaatgggggtggactccccaccgccctgatggggcttgggtgcgccgcgggtgaggagcagcgtctcacccacagaggtgtctcctcacggggatcagcaccgggtcagggatgggagggacggtggtggccgtttcaggcaaggcccttattagacatgagaatcccaaatggcagatgaaatacccatttacccaggaccctcgggaggaacccattttgcatcagagaattctccagtattcagtgaaacttttttttttttgagtcagagtctccctctgtcgcccaggctggagtgcagtggtgagatctcggctcactgccacctccgcctcctgggttcaagcaattctcctgcctcagcctccctagtagctgggattacaggtatgcgctaccatgcccggctaatttttgtattttttgtagagacaacctccacctcccaggttcaagtgattctcctgcctcagcctaccaagtagctgggattacaggcacgcaccaccgtgcctgactaatttttgtatttttagtagagacggggtttcgccatgttggccaggctggtctcgaacccctgacctaggtgatctgcccgcctcggcctcccaaagtgcaaggattacaggcatgagccaatgcgcccagccttcagtggaactttaaatgcctgaagtttttttgtatcgtctctttaaaaaattaaccgtccgtctcagtctcaggtaggttccctgccctcctccatccaaccgtgtcatggtgacgaggggtcgctgaccagcagctcaccagagctgggacacacggccctcatgccctgcgctggtggccgagggtgctacactttttcaggactctccttgttcagtgtttctggcccctccttccagtgtcacattgctgcttatggtgcctggtgcctgtcccgtgcccctcctgttttgctgctgcttatctgctgttcggggcatcctgtgacaggccagttggaatcctacgtagagtgaaagcatctcagccccagacaggcccgaccactcccacgccagcttgtcttctcatcagggactgggctgggctgctgtggaggcctgcaagcccgcgccagcttctccaccctgctgggcctcagaggcgcctgtcagctccagctcaccaccgtgtgtggccctctgccccttgcctctgggacaggtttagtctgcagttattatgttcaaaattttaaaattttaagcagttaacactgatgcgtgatgaaaattccaacagcacaaaaaggcagatagtgacaatgtgccccttgaatccctttcccctgaacccctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactggacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacgttccagaggggggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatagttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaataaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccaccctccacacactgcccagacaggctctacctcctgtccttcaagacctgtactcggccggactcggcggctcacgcctgtaatcccagcactttgggaggccgaggcgggcggatcacctgaggtcaggagttcaagaccagcctcaacatggagaaaccccatctctactaaaaatgcaaacttagccaggcgtggtggtgcatgcctgtaatcccagctactcaggaggctgaggcaggagaattgcttgaacctgggaggcagaggttgcggtgagccgagatcgtgccattgcactccagcctgggcaacaagagcgaaactgcgtctcaaaaaaaaaagacctgtgctcaccgtgaagccgtcacagactctggtatgaatttagccacagacttgatgttctgatgcctcgaggagcttctgggtccctcaagggcccaggtgacatgatctccagtgcagcctagagctttggaatccctcttcctcccccagacccctggtctccagaagacccctaggagcccagggaccattctagaatggcatgttgtatacacgctgtccctccccactggatggtcagccctcaggggcagcacggcttggcccagcctacccagcccagggcattcaagctttggcctcacctagagccaggctggacgccagcagggctgtgtgcagcttggccagctttggagctcccatctgtggactgccgccatgacaatagctacctcaaagtgttcttgaggaccaaaggaagtcattccttcccctcgagggaggctggaacctaatgggtatcccgggaggtggggggaggttcggatagaacatcccgctgctgtgcgtgcagcagagtggctgccatcagatttctttggggtggcctgcgcactggctctgatttgatgacgttctctgtgttttccaattttcttcttgctctttagctccttccttctggcttctccatcttcacatttcccacagaattcagttgtgatttagattttccatgcccctcactagcgtgttctggctcctgtcatgcagacaccttacacttaaataccaagtccgagataaacctgctttcagttcacgggcgcttggaggtcctgggagttctgtccttgagcatgaggaaggagatgcacagggtagggccctgtggctgtgccccagacaggaggaggaggacgaggaggatgaggaggaggaggaggaggaagaggagggaggctttccagacacacaggcagggctgggggagccatgcaggagataagccaggctgaacttgggacttttgcacacaatgcttctctgcctggaaggcccttctttctgtgttctgtgtggtgtctgcttttcatcctgcacgccacagtgtgaaggtcacctccctgactgccctcgctccaggttattctttctcccagcaccctgttctttggcgagcgcatctctggcatcatcacacagagtccatgcggcacagacaggaggcccccttgggcagaggccctgaacgcctcgcctgcttgccctagtgccccagggcctggcacttggcagccctccatagctacctgaagaacagatctgtgtgtggagaggggtcgggagctctgcactttgggaggactatggctggcatttgcttgcagttggggctggtttgcaaatatttctctctgcctcagcaggtgagaaatagcacctcggagctccttgcctgttcaattatttccgattgaattaattatcctgcagtaacagcggagctgctaatagggaacattgggtgccccccaggcggagcatgtggctcgagagcacgcctggagctggagaccagtgggcagcccagctcttcgggggcgcaggccccctggagctcttctgacgatgggcagcttcatcctgcagtcaccagtgcatgcagaggtccagccacggccacctctttcttttctgtcctttaaatggagagggtcagcacgtagcaaatgaaccaactttgctttgactgcagctgtgaagataatgaggcagccttggttgtcatctaaactcagcaatggtcgagagctatttgggatttcctggcctgcttccaaattgcaagccctgttgggctactaatgccccaccttgtcccagcctctctttggccataggctaggccagccccagggtggacagggaggctccccagggtcggacgaaggcaggcgcctgtgagcagaggcctgggggctggatgggtggcaggtggccaggccactcttcctagcccagctgatgccatcccgttatcttgtaattttcttcccggggccttatcagccttattagcaaatgtcagaaacaatgagagtcacttaaacctgatcatgcccactgcaccccccaccagcctggcaccagtttgaaccaagcctgcttctgaaaatgtggtggagaaagccctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgctgtgctgggagtgagcccaggcaaggtggcccagggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtacatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgacagcacctgtaatgtaggcaggcaatgggctcctccaggtggcaggaacaccgtgaggagcatgcaacgtgctggagaccatggggcatgtgacctccgggcacaccctggacagacctgggtgagaggtgggctgggacgccaggacggtgaggggcttcaaggtgtgtttgtcctttgtccttatacaggtgacctgcatgggcgggtgaggtccatcagaatgctctagaacaggacaactgaggtcccggctgccccgctcaacacgccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcatgcctgtaatccctgcactttgggatgcctgaggtcaggagttcaagaccagcctggccaacatggtgaaaccctgtctctactacaaatacgaaaattagctgggcgtggtggtgggcacctgtaatcccagctactcgggaggctgaggcaggagaatcgcttgaacccgggaggtggaggttgcagtgagccgagatcacaccattgcactccagcctgggcgacaagagcaaaactccgtctaaaaaaaaaaaaaagaaaagaaaaagaaacacaagctgggcttcctgcttcccagctgtgtggctttgggccagttactcactgtctgggtgcctccatgttcttgtttccttatataaaataaagttctttcctcgtggattgtcaggaggattctgtaataatccacaggatgtgttctgcatgcactaggtgctcaactttcctgacccccgtccagtgcccccctcaccgaccacgtctgccctctaagctgccagtcctataggaggcattaagacgtctagcaaggctgtgttctcagatgcctcgaaatgggacctcagccttggagttctctcctcccacatggaggcaagtcactgacagtcatctagcaaattgtatgcatggtcaagctcagaggttctattttgggtcaaaaaaggcatgagctggctgggcgccgtggctcacgcccgtaatcccaacactctgggaggctgaggcaagcaggtcacctgaggtcagcagttcaagaccagcctggccaacatggtgaaaccctgtccctgctgaaaatacaaaaattagctggatgtggtggtgcatgcctataatcccagctactcaggaggctgaggcaggagaatcacttgaacctgggaggcgaagtttgcagtgagccgagatcgtgcccctgccctccacctggggtaacaagagcaaaactccatcttaaaaaaaaaaagcacaagctggattttgccctttgtcgtgagagcatttcatgccttcatgaaagtcactgcagctgtgcttcaggcagagggcccgggatccaggtggcgtgcgctgccttccgtggccccttcaaagggcagccaccttcccagtgccgcaggagctcctggtctggggccacatgcttggaagggccactgaatgtggtgaagggctgggtcctggtactgagcctgttgagacttctgcaggattcactgccgtatgcctgaggaaggcagacgaaggaaaggacagtgtggagtgctcagcagagtccccatggtcgcacttgggaagaacgccctggcagtggacggtcagtggtcacatgcacatgcgaggccctcaggactctgtaggacacgacgtggcttctccacagtcctggggatcggaagcagatgcagaatgtggccgagtggcccgggccagggcctgagagtctgcattctgacatgcttccccggtggtgctgctggtctgggaaccacactgggtttaagtaactgatttaagtaactgatgcgaggaggccatgctctgggggaaggcagctggagaggagaagaatgatgtccccatgccccttccagcctcagagtcctctagacccggcagtgtgcaggaacggcagcttcactgcccatcccctggggtactccctgcagccttgggccctgctcctgcaacggtggccgaacggtgcaaaggagggggcggcccagtccctgcaggctgccctcagcctgggtttgctcatctgtgagatgggatcacatgtataatcctggctacttcacagagcccaggcgaggatctcatggacttgtgcatgtggaaaagccctgaaactgaaagattctagaaacaccaggattgtggtcactgtcattactggagggcataacccattcccctgtttttcctccatgaaagacaatcccaccaaaacacgaaggccctgccctcaatctgtttgtgtccttggcatggttcagcctgctctccccatggcctgagaggaaagcgttagccaggagggtagttggaggtggcgggaggtaatcccaggagcccgtggtgagctgaggatatggagaaggctcatctggggtgacctgagcaagcaccctctatcccaagccagtccccagaggccacgtaggcacctgtttctggattaactgagcgggagctcaatcaggcaaaccaggttgcttggcacggtgtttgccttaaagaagaacaaggtgggccaggcgtagtggctcacgcctgtaatcccagcactttggaggccaaggcaggcggatcacctgaggtcaggagtttgagaccagcctggccaacatggtgaaatcccgtctctactaaaaatacaaaaattagctgggtgtggtggtgagcacctgtaatcccagctacttgggaggctgaggcaggagaattgcttgaacctggtaggtggaggtttcagtgagcagagatcatgctgctgcactccagcctgagcaacagagcaagactgcatctcaaaaaaagaaaaagaaaaaagaaaaaagaggaaggtgggctgtgcccttctggctcaggcactgatattcaggggccagtaccaggcagatgagccctgggtgttgggctcacatgtctgtggcctgtcgttttagccttggggccaggggtagcagccgtttctctctgggcaaggggctcatgaggaaacgtttctgccttggcagcccaggccacagctgtgctggctgcagacaccctgggcaggccccggtcgctgaggagccttcttgggcaggttgcttcatctctgaagctcagaatcctttcctggagcacagatatcaaaatatttatccccagaagcctcaacaaacctgtgctcaccgctgctttaggccctgcagcagtcccaggtctgggcagatgtttcaagttcagtgtgtgggctctggcttgctggagctgggcccagggaactggcgccttgggatgaggcccgccatgtccgagcctgcccatgccccgctgctgctgcggccggtggtcttggggctgcctgccagccttctctcctgggagctaagtggggacaggtgctgcgggccacggtccacgatgctccctgcttcctgtttggtgggcagcctgggttttaggaatgtgtagagctggaggagctgaaagagctggggctcgggatcaggtggttcagctgactcgggaaactttgaggcaccaccgcacatgtccgtgcgtgagggagacatcttccttgcagggctctgggaggatggggtgcttctgtaatgcccagtcttgggcctggcgcctacctcatatgggtgctctatatagcagcaggcggagcacaattctgctaacgtcagcaacaatcctgtctgttggaataaacatgcagatgcatctgtgaccccagaatcccagtggtggctctgtcctcgtctcagccgagcactcatcggccagggtggctggactcagcacggggctggcactgaaactggcagtcactgctgtcagtgcccacagaaagcaagaagagaatagacaaataccaggcagtggagacactccctgcccactgcagatttataatcagcgaacatttactgagtacctgttgtatgccttgaggtgctcacaggggagcactcgggagcccattcactcgccagtgatgagtgggcactgtgccaggtgctgtccaaggtgggggagcgagggggtcactgcaggagagggtgagaaggaggctgcatgctgcacgaccctctgaaccctgagcctgcctggagaagtgggctgtgctgcggggaccctgttggagaggggcagcatggggaggggcggagcctgcctggggcctctcatcctgcagctgcctggaagttgggctccttctgacagtgtcctcaagtagacgcgggttctgggggtctggctggtggaggccagctggtgctcctgactcactggctcctctccttgcacagtggctgctgccacctgcctagggagtcttcctggggctcagttcccctgaccccctgggacataatgccagaactcatgctggctggccaccctccctcacgtgtgctgtgctcagcccgaagttggtgctttcacctgtgtgctctgggcaaagcaggcgcagaggaggcactgggatagagcgcagagtccacctggggcagccccctcctcgtcccggccattgccccatgttgggggtcttctgtcgggggagggagggttggagctgggattggaaggcccctctgaggctcttcttccttcctccatgagccctccaggccccaccctccatcctgcgcccctgccccatccccacccacggccagggctggctgctgcccattttggccccttcccttggggcgttgcttccaggttcaactcagattctgtcttttccagaagatgtctctgtccttccatgcccccagcctttgttccttgtcctcccctgtccctgcactcctggggtgggccctcctgctcccgagcctcctgcgtggaggctgtgagctccctgccacctgcgtggtcagtctttcctgcaccagcctcccaggacccctcctgcccacgctcctgagagattcaggcgccagtgcatgggtggggcacaggggctgcggcagacagagggtggtgatacaggggtggagtcccacaggccggatgccttgacacttctcagctgcagggctgtgcccggggctctgtgcccctgaatgagggcaatggttcccctgcacagtgaccttgtgagctgattcaggccccatgatcgtgattagctgacagcacattggccctcagagaaatgaaaatacacagttacacagtagcaaaatcccacgagcagtccctcagctggggcagggacacacggactgtggcacgtccacaccaaagaatcctgcgtagccacaaaaaggaacaagctggggatacatgtgacaccctgggcgcatcgcagaggcatcataccaagtgcaggatgccacagcctgcgcgattccatttctgtgacacttgaggagggaaacgggatggaacacaggacaggagtgtctggggtgggacagggaagggcccagctctgggttggagcctggagctggctggaagtgctgtgtcctgatgtggtggtggtatgcatttgtcaagactcatagacctggttggggcacagtggcttacagctgtaaccccagcattttgggaggccaaggcaggaggattgcttaagaccaacagttggagaccagcctgggcaacatagcgagaccccatctttactaaaatcaaacaacaacaacaaaactcacagacctgtgcattaaaaagggtacattttactttatgtgttaccttcataaatctgacctaaaaatgatttttaaagtccccccttctaaaatatactaatctttaagaaacaaaaacaaaacaaaaagctggctgacagtgggtcctactactagcacatgggcgttgatgatggtgataatgtctctcgcccataaaaggccagcttggaaacctgagccccagctgcttatcggcctgtgtagccagacaaccattctgccactcgccaaatattttcaaatttcctttccgaggcaggctgaagtccaggtaaatattgacccaagaaggcggatcacgctttgtgctatatttggttaatagttggagtcactcctaagctactttttcagttgctttgtacaggtgggtttgttttatgtaaaaagaaaagacactttaaaaagctgcgcataaatcagacatcataaatgcagtagaaagcctccctatttaaatgactcagcgaatcttctgatgaaacaactgcctcttcccctttaatgtatttattaatttttttttctttttttggagacagagtcttgttctgccacccaggctggaatgcaatggtgtaatccaagctcactgcagcctcaaattcctgggctcaagtgatcctcctgcctcagcctctcaagtagctgggactacaggcatgtgccaccatgcccagagaatttttcaattgtttgtagagatagggtctcaatttgttgcccagcctgaggcaaatttttagatatatattttatttaagtgagagctgtgacagcaatggcacaatactgcctctgtcctggcctgaggctctctttgccgctggtggccatcgtctttggagaagccgctcagcgtgtattgatggagtgacctccctgcctccctgtccagttgggctcaggtacccagctctttagcaccctccctctaccatcgtggggcctgcaggtcactgagggctgggagggctgggacccaggcccctgactggccccctgttgcagcgttggagagaccacctcagacaccaaggacggtcatgccatgggtcccggcagcagctgtcccttcctgaggagggcgtttgccagctgaccactccctggtgatttctgccctgatcttccctggaggtggcaggttggacgtgaggatgaggtcccacccaagtcacaactgtgtgactgtcttccaagtcaacaaacatcctcctggaaggctgagtggcgggaaggaaagacacctgccttctacgccatgctgggccctgcagcaggcactgtccatgtctcaaatctccctccccgggaaatctaggcacaggtcatactgctggaaggcttgtctgtctctcccagtctcagggccagagcttccaggagcaaagagtggtccgggcctttccttctctttctcccactctatcttatctctcctcctgctttctcccagaagacaagtatcagggatggaagaggtggccacgtgcagagcatgactaatcagcagctgagtggcacacacacaggggatctcgcctgaggcctgggccagcatggggaaggcccctgcaggctgctgggcacggggatggctcagggtcctgggctgggctgggctaggcttgggggagcccggtgtgttgggctggagctggcctctgctgtcgctggaccacagtcacccatggagggcaggggttgggaacctgcagggacagcatctgccctctggccggtggggggttcttagtagcagggcaaggggaaggcaaagggggccaggcccaggagcaggtggggcctcctcacaggagcagggcaggattcgaggagctctgggctcccacctccgagctggactctgagcatgctggctccttccttctttccagggcagcagcagccccacattcaggacagagccatctgtgtaagcagggctcagagaccctcagacagacagggaaaaggagcaaaatgtattgtcatcgtccagcctgaaatctccagtgggacccgtcagtggagcacgtagcagacaccctgtccctcccgtgccccccggcctgtaagggcagctgaggccgtcttacctgctgagggagaccccgcactccctgacttcccgggctgggtgctggcactggtgaagggtttcgggctgtgagcctcttgccttccactcagactgggccagacccgacagcaccatgaaccagagccgccctgagtaggggctgacactgccaggccagcctcatcctgctcccggccataccaggtcccacggggccaatggaccatttcagtggatgcagggagcacagagcatgagtcgcacctggtggacgggcaggtgtagcaggccctcatgagaggaacaccattgactttcccactgggtgaggaagggacagctctgtaccatttccctctgctcaaacccacaggagccagccagggcatggacactcccatgaggtcacctttgctggtctgttccttgcggggctgctgagttcttgatagaggtaacaagcaaccctggggctcccgtgtgcaggaggaaggttggggactgcctggttgtgcttcggacccagaggcagacagaggaggcctttgaacttggcctgagcttgttgggtgaagccaaggacagaggctggggtctgagtgaggggagatggtcccgtgaagtcagattggcacagattcccccatcagagttgggaggccccagaatgttcaggaacagcatgtggcaggggtcataactgaagccagacctgagttacaatccatttactcactgtgtgtccttggcaagtcctgcaagggaggcacactatcggacgtcccccgtggggctggcatgcagattgaataggatacatggctgcactcaccccagcgcctggtgtgcagcaggccctatgccagtgtcggctgacgtcactgtgctgtgggtgtcatcagagcctgcatgccacagtcagtgcagtggcacagggcctgcatgccacagttaaggagattgtaggcccttggggagacagtggcagaataagggagtcgttgccagacactggaccaaggccctcacagaacccaagggagggcaggggcatcccctgctcaccgatggggactgtcacccttagggaagttggggacctgcctgagctcacacagctgggaaacagtgaagcctggatttgccttctaactttttattttcaaaaatatgcaacatacactaaactagaaccgtttaatgacccctgcaccaccgtacccaatgcccagcttcaagaattctctcacaatatgtcattcttgtttcatctgtcttctgccccctctccgcctcttccccttcactcctgtctgcttcctttcactagagtgttttaaagcaaatccagacatcaaatttcatcagtaaatatctcacatgcatatgaaatgcagaatgtatctctaacaagtaaggacttttttttttttttcttgagacggagtctcagtctgtcgcccaggctggagtgcagtggcgcgatctcagctcactgtaacctcgtctcctgggttcaagccattctcctgcctcagcctcctgagtagctaggattacaggcacatgccaccatgcttggccaatttttgtatttttagtagagacggggtttcgccacgttggccaggatggtcttgatctcccaacctcgtgatccacccgcctcggcctcccaaagtgctggaattacagatgtgagccactatgcctggccataagtaaggacttttaataatataatacattaaacattcagcaaaattaataatttcattttaaaatagccttacaggccagacgtggtggttcagcctgtaatcccagcactttgagaagccaaggctagtgaatcacctgaggtcagaagtttgagaccagcctggccaacatggtgaaacccctctctactaaaaatacaaaaattaaccaggcataggggcgcacacctgtaatcgcagctactctggaggctgaggcaggagaattgcttgaatctgggaggcagaggttgtagtgagctgagactgtgccagcctgggtgacagagcgagactccatctcaaaaaataaaataaaataaaataaaataaaataaaatagccttatagaggaataaccaacttacaacaaagtgcacctatatgaagcatacaatttgagttgccttttttagagatggggtcttgctctgtcgcccaggctggagtgcattcgtgctgcagcgttgaactcctgggctcaagtgatcctcccacctcagcttccagagtagctgggactacaggcatgtgccactgcactggctaatgtttttatttttgtagagatgggggtctcaccatctggcccaatcttgtctcaaactcctgggttcaagcaatcctcctgccttggcctcccaaagtcccagagtgttgggattacaggcaagagccgctgtgccctgcctacaatttgagttttgatgtgtttctacagccaggaggcacgtactcaggttaagactgtgaacatatccattcccacctttgagatccccccagcccctcttgccctttctaacccaggctgctgctgatctgctttctgtcactggacattagtttgcattttcaggaattttatgaaaatggaatcatacagtatactctatgtttgtctggcttctttcactcagcatagttattttgtgggtgatggatgctcttgcatggactggtagttcctttttagtgctgagtagtattccattgtatccattcaccgtagtttgtttacttattcactggttgatggacatttggattgtctccaggttttgactattacaagtaaagctactgtaaacatccatgttcaagtctgcctggatagctgctttcatctttcttaagtaaatactaggagtggaatggctgggtcatgtggtggtaggtgtgtgcataacacttcaagagactgccaaactgggctggatgcagtggctcatgtctgtaatcccttgcgaggccgaggtgagtggatcacctgaggtcaggagttcaagaccagcctagccaacatgttgaaacccctatctctactaaaaatacaaaaattagccgggtgtcgtggcatgcacctgtaatcccagctacttgggaggctgaggcaggagaattgctagaacttgggagacggaggttgcagtgagccgagatcgcaccactgcactccagcctgggcaacagagcaagactctgtctcaaaaaaaaaaaaagagagacactgccgaactgccttcagaagtgattgtgccattttgcattctagcaaggagtgagcattctaattgctctgcttctctccaaccctctttacttttagccattttgtaagaattctttatgtattctagatacaatcctttatcagataaataatttacaaatatgttcacccattctgtgggttgtctttgtattttcatgatagaatcatttgaagtataaaagtctaaatatttgataaagccagtttatttttctttcattgcttgtgcttttggtgttgcatctgagaaaccattgctaaatccagggtcatgaagatttatacctatgttttcttctaagagttttatagttttagctcttacatttaggtctttgatccatttcgagttagtttttgtatatgatgtgaggctgagagtccaccttcattcttttgcatgtgaatatcctgttgtccttgtgctatttgttgaaaaggctattctttccacattcatttgttttggcagccttgttggaaatcacttgccatgtatgtggaagtttatttctgggctctgtatgctattccattggtctatgtctatccctatgtcagtgccacactgtcttgattactgttgcattgtggtaagtttgaaatcaggaagtgagtcctccaactttggttttttgtttttttgtgtttttttgagatggagcctcactctgtcacccaggctggagtgcgatagcacgatctcggctcactgcaacctctgcctcccgagttcaagcgattctcctgcctcagccttacgagtagctgggattacgtatgcccaccaccactcccagctaatttttgtattttcagtagagacaggtttcgccatgttggccaggctggtcttgaactcctggtctcaggtgatatgcctgccttggcctcccaaagtgctgggattataggcatgagccactgagcctggcctttttgttttttgttttttgtctttttttaaaaaaagattgttttggatattttgtgacccttaaatatccatatggatgttagaatcagcttgtcagttttacaaagaagccagctgagattctgattgtgactgcattgaatctctagatcagtttggagagtattgccatcttatccagtctgtaatccatgaacatgggatgtctgtccatttatttagatcttttgtttctttgaacaatgtttcattttcagagagtaagttttgtacttttgttatatttattcttaagtattttactcctttaattgctatagtaaatggaattgtttttttgattcctgctttcagactttttattgcaaatgtgtagaaatacaatcgtatcttgtggccttgctaaactcatttattagcttgaaatttttttagtggattccttaggatttttaatgtatgagattatgtcatctgtggatagagttagttttacatatttcttttcaatctgaatgcctttatttgattttcttgtccaattgccctggctaaaacctctagtacaaagttgaattgcagtggtaagagtgaacgtcctttcattgtcttgttgctgagtttagggggaaggcatccagtctttcaccattaagtatgatgttagctttgggtttttctgcccattgaaaaaaattgagttttttgttttcttattatcaagttctaagagttctgtatatatttttgatataagtccctcaagaagtatgtgctttgccaatattttctgccagtctatggctgatcctttcattctatcaagaatgtcttttgaagagaagaagctttaaaagtttggtgaatttcaagttatcacgttttcttttatgaatcatgcttttcatattgtgcctaagaaatcatcatataatccaagatcataaagattctctctagtctattttcttctaaaagttttagaagactttatatatttagattgatatatttatatatagatttaggtttatatttctatttatagtccatcttgaattcatttttatattttttctgagttatggattgaagttctttttttttttttttttttttttgcatatgatagccaattgttccagtggcatctgtggaaaggctgtcctttctccactgaattgccttagcactttgtcagacatctcaaaatctggttgtgttagttccactttgtccttttatttcagagttgtcttgagtattctaagttttttgtattttcatatccatctatttgtggtttccatctgatttttgacatagatgattattgttgtctgtgaataaagacaaatcctactgagacagactgagaccatgtctcataaaaaagaaaaaaaaaaccatttcagaataatgcgttagtgtcctagcaacctcagcatgtctgcctttagccagctggggacccttcaagtgtttcttagtgttcttctggcgtttccacctcgtctttcatagctttcagtctcaggttcaacatcttctgttcccagagtagactggaatcggccttttaaccaaggagctctggttatttttagtggaaaatgatatttggagaccacagtttgaatgctagggtgctcactgttccaggcctctctaggaaaaatgatttttttttttttttttttgagacggagtctcactctgtcgcccaggctggaatgcagtggcaccatctcggctcactgcaacctccgcctcctgggttcaagcaattctcctgcctcagcctcccgagtagctgggattgcaggcacctgccgttacgcccggccaattttttgtaatggaaaaatgaattttttagaaatagaaataaatcatgaattcataccaatatttccacttcaaaagtttttgttcaacctttcaatttcatttttgtaccacttttataggaagcttggatcctaaatacagtaacataattaatgtgtatatagtcaaaataataataatatctgtattattaaatattttatcaccaacaatagatttactcgatgcagtctagaatctttctggttcttttgtcctcaggctgtgcggcaggagggaggattagtcaaaatactgtatttcaaaatcacttgaaacttcttatctgtgtttttaccaggtttattgattgagtttttggatttctagtagttcctttgttctctctctttttttttggagacggagtctctctgtcacccaggctgaagtgcaatggtgccatctcagctcactgcaacctccgcctccggggttcaagggattctcccacctcagcttcccaagtagctgggattaaaggcacccgccatcatgcccggctaatttttgtattttcgtagagacggggtttcaccatgttggtcaagctggtcttgaactcctgacctcaggtgatccgcccgcctcggccacctaaagtgctgggattacaggtgtgagccactgtgcctgccctgttcttactcttaattatgcaaaacatttacatggttccatagtcaacaaaggacatttgtaaatgtctggcatgtctcctccctcacctgtaggtaataattttgatcagttttgggtttgtccttcccctgttgctttttgaaaatgtaagcaagtctgtgtgtgtatcttcccccagcccctcttcatgtccttatacaacaggatgggtgcaccttccgcacttgcttttttacttaatgaatatatcctggagcttacaccatagcaatagatagaaatcttcctcctttctacaaggagcccttctccagggtggggctgtagcgcagttcattcagcccctccccctgccagtggacactggggtgggttccatctttatacgatgctataggtagtgctggagctagaatttgaactcagagcccatgttcctattgctctttctcctgtgctctgtgggccgtcataatggaggaggcggggagcaaaacggagtgaagaggttgagcatgagcactgaggctgggggaggcgagtgtcccccgctgtgccatggcccctcgggtgtgaagctgggtcatgttgctttgctggggcctcgggtgcaggttgtctggaagtgggcagctggtgctgggacctgctctctggcactagtgtgctcactgcagggcgagagcttgggtgcaccttggacagggattgattcactggactagctggtggagtgggcaggtctgttgatctgttggagacaatgactgttggagcccttgagcaggctgtgtcacgtggaagggcagttgagccatgtgctgtgggacgctttggatgctgccctgagctgccactggtcctatgtcctggagaggccctggcccaggttcagcagcactggccagattggggcagatctgaaaggagccagggctgtgcacacctggcaggacaggtggaactgggtgttgggaagggcaggtgtgatccaggtcaccgggccggctgggcctagcgtgtgcagagcagagggggctgacacggtgcgacctcggagagccgcctgttcatatatgcacttgcttgctggcccagggcctgcctagctggcagtgactgggtcctgtgctgggctctgctgagctcccacaaacacaccccatccactatgagccctggtgagaagggagaggggtccaggccccgctgggatgcgcggtgtggacagcacttggcgtgcacatgaagcttatgtgacggtatcacagtgaccttgatctggggctggggaggaaatgcctcgatgggctgtcctcatgctgctgggcctgggccatcggggccggcctaggggatgcccagtagccttggcagcctcagccatccttgtcaactccagtgggactgggggatcctgaatcccgcctcctgatgccagtggagccctgagtttctgttcagaaggccaatggagggctgggctccaccgcctctgaggtccctgacctctcataggttctggggggccagggtgggatgagggagagacaggagtcatgggcagactccctgctgccccggggacgtctcactcagacatttgtatgtcacctacaggtaccctgggggccttagggcccctcctctcttcatggagcccagctagtggccccctcccttcctggctccctgcaaggcgagggaaagaggagaggagagaaggcctcggagcgctgatgtatccatcattccacacagacccgtgcttgttgagtgcctcctcgggtggtagccccacgtgggattcagcatagtgcaggcagaggtggacacagtgtgaactgttaggccacagccacatcttgccggagccgcaaggcaggagttcaggagtgagaaggcactggctgcggctcctggggctggaaagggggccagtcaggcaggcagaggggtgggtccagctgtagaagcgagatgggggcggttcgggaggcaaaagcaggaaggcagaaggaagcttggagctcatgagcccctctgtgctggcgcacggcccacgtcctctaaacaaaagggatgggctccttcagtggttccgtgggcccttggcaaagctcgtggaaacaccagctcctccccagcattcattaccaatgcgaagcactagccctttgcttggggcattctagacccccaggtgcctaggctgggagccctgggccaggtggtgggggggtcctggctgtggaatccagatgggacctaccactgcagctgggtattaggcagatttagccagggaaggacaaggtgagagaggaggagcttctgagagtccatcaagggctggccgcagaggggagaggcctggcagccggcgagcccagtgtggcacaggtctgtctgcctgtcctctccctggggacactgcttcacaacagactttcttcatcagctttgccggggcctgtcaggccaatagcttggacttagcctcttgactctcacccttttgcccattccaaaacaaaacaaacagcagcaccgccatgcgcccatgtgcctggtgtagtatcgttccaggcatttcatgggcaggaattcgcttaatccgcacagcagctctgtgacgcagtcgagagtattattagctccattttacagatcaggaaacaggcagagagaaaggaaataacctgcccaagctccaagctgcaagtagaggagccggtgtttgagcccagaacctggcgctgggagccacgagctgccctgctgggcactggggtggacacttgcccatcagtccttcagtgagtgcgaaggagccgtgtctcacttcaaagagggatttaaaaattctaccctcgccgggcacagtggctcactcctgtaatcccagcactttgagaggccgaggcgggcggatcacctgaggtcgggagtttgagaccagcctaaccaacatggagaaatcccgtctctactaaaaatacaaaattagccgggcatggtggcgcatgcgtgtaatcccagctactcgggaggctgaggcaggagaatcacctgaacccgggaggcggaggttgtggtgagccgagattgcgccgttgcactccaggctgggcaacaagagcgaaactccgtctaaaaacataaacaaaaataaaaaactcgactttctgcggcctcacttcaaggatgcgtaggaaatttgagagaccaataggaagtctctaggaaagggtcttgttcccagaagggggtcgtgcttcttgggcccttactgcatagctgggctggtgtaggccttgtggggtgggaggctgtgttcattgccaagatttgagaagccttggcttttatgtgaaaaacgctgagtgtttaattgttgatccaaatattttaaacatgctatgagtttgaccagaacacatcttgggctgccagttacaacctctgagtccaaggacaccaagaatagcaccctggaaagggcagggaagaagcatgggtcctggcgtggagacagaggccggagctgccacctcaggccagacgggcaccacgggcatgtgcatgggcagaggctgttcccatctgagtgggacccagaaggaaatcagacacagtccctgctctgagccacggatagggggagagacgggcgctctcacatgtcctgggccacatgccagggctaggagcctttcatccctcacctgctctacccctccttccacgctggccggggatcggggtggggggtactgtccgtcctgtttttcgtactttgcagctgactcagtttaggtagcgggcagctgagtgatttgcctatgaagtgctgtcggcttttggcgaatgtcaaggccaggatggtgtccctgggtctcgaccccattcctgttttcctcccactccacttgccttgggcctgtctcttctgccctagggtagaggctgtgggtgagatttgcaaaaaaagaaaaggagccggcatttggggaggagacctgtgtgttccagagctcagctgggaactccttgccagggtgtgggagaggctgggctactgaatggagcaaacacacacccagggcccggttgcattagggttccaggtcaacagcacagactgttttaggattaaaagcagtcccatgggacaggttgcaccaaaacattgtttgtttgtttgtttgttgtttgatacagagtttcgctctgtcacccaggctggagtgcagtggcacgatctcagctcactgcaacctctgcctcccgggttcaagcggttcccctgcctcagcctcctgagtagctgggactacaggtgcacaccactgtgcccagctaaatttttgtatttttaatagagatgaggtttcaccatgttggcctggctggtctcgaactcctgacctcatgatcctcccacctcggcctcccaaagtgctgggattacagacgtgagccactgtgcctggccaggttgttgtttatctgaagcttacatttacctggagggtcctggcagtgccggggagaggaaatttgagccagggtcacggagtgttgggcaaatgaatccccactctaggattctggaaatctagaagacaggcaaaaaccaggagcagtgagagcagagtgctgggccacgccgctgcctactaagggctcacatgcatggccctgggaggcgactgcgtccggcacccgctcattgttggatgaaacgagcagctgggctcccagtgaggacacggtggtgctgccaggcagggaaggaagttctgggagtcctgctggctgctggtttatcgattgcctcggaataacagccccatcgaataccagttcgctgggaggcaaggcgtggtttcctctttttctttcccacatgggttagtcttgcttgatgcttttctgttgtcgttagattgttctgaaagctcatttagcatcagctctttccgaggctaagggacaggtgtggcctgggtctgttgggggaggggggctgtatgggaggctgaggatggcagagagaacccttgaaggaaaggtttttgttgtttttgtttttgttttttgagatggagtcttgctctgttgccaggctggagtgcagtggcgcgatctcggctcactgcaacctccgcctcctaggttcaagcaattcttctgcctcagcctcccgagtagctgaactacagatgcacaccaccactcccagctaatttttgtatttttaatagagacagggtttcaccgtgttagccaggatggtctggatctcttgacctcatgatccacctgcctcggcctcccaaagtgctgggattacaggcgtgagccaccacgcccagctggaaaggtatttctttatcattagggaaatgcagaccaaagccacctgacacccactaggatggctacagaattttttttcttttctttgtttttgagacagggtcttgctctgtcttcaggctggggtacagtggtgtgccatcttggcttactgcatcctcaaccttctaggctcaggcaatcttctggctaacttaattttttttattattttttttttttttggagagacagggtctcactatgtctcccaggctggtcttgagctcctaagctcaagcaattctctcacctcagcctcccgaagtgctgggattagaggtgtaagccaccatgcccagtgtcccccacccctgaaggctataatttttgaaaagggaaaataactggtgttggggaggatgtggagaaactagaatcttcatgcattgctggtggggctggaaaatggggcagccactgtggcaaacagtttcacagctcttcaataaatagatttaccatgtgacccagcaattccactcctaggtgtatacctgagagcactgaaaacacacatccacaaaacacttgggcacgattgttcctagcaagcgcccgtatgttgcttggctttggccttggtcaccgtggacagtgctgctaacgcaacctaagtgtccatcagctgctgaaccggtggacaaaatctttatatactggagtcgtattcagccgtaagagggaatgaagtgcatttacgcactgtggcacagacgaaccttgagaacgttacataaagtcaaagcagccagacacaaaagaccatgtagtgtgtgattcagtttatatgaaacgtccagaataggtgaatccatagcaacggaaagcgatgagtggttgccaggggccggcagatgggggatggggaggacggggtttctacttggggtgatgaaatgttctggacttagaccgtggtgatggttgcatagctaaaaactactttgaattttatctcagaattggaacaaaacaaaacaaagcaggctgtggtcctgggcccccgcggtgctctctgcagactgctcctcttctgcccccaccccaccccacacattcccagcaaggtcaccgcagccccctcctcacccctgcagcgcttattccttccgccttttgagcttcccacagagtcagcagcggccacctgctgagacctggactagggcctgcttaccttctgggagaattggctgcagtgccaacagctggttgaggggaaggcccgggagctacctccttcacttctccttcctgtaaactttggcataccctgccccccgccatctgctgccccctagcctgccactgccaaggagctctgaggacaggggccagaggactcactagggagccaccttctgggagtcagtggccttgaggaaatcatcgctaatcactctcctgccgcaactgctgggaaaggcaggtccacttgggaagtggagcaggcagcagtcatcgctggggctggggtggaggtaggtggctgggagcaggcctctgaggctcttcctgtgcacacacaggcgcctactctgggcccacagacaacttgctcacatacctagagcccagcccctgaccccaggctgcatgcttgtctttttgcatcctccttgccccctcccctcctctccgttccttcctcagtgtgctgggccaggcccgggcgataaccagctcaggactgtggaaacagcaggcaggcaggaagagctcccttctctccaccgttggtggccagatgttgagattccagatgtgattagtttgaaaaaaaacaaagtaaaaggattctgaggctaaaagtcactgtttgaaagtctgtgccttgagaagagcacttgggcagagggaggagggtgaggggttttctttgctttgctttgcgcctgtgatggacactttgtgaggcccccagcggaaatttgggcctgtgctctgaaggccgcgtgctcctgcagccttgggctcctctggcagttctgctggggcccttttagagtctgtgggatgcactcagcagctcccaggtagggcctgaggtcagaccccatgtgtctccccagggacagatcttctccgccagacgtctctttctgcctcttggtgggttcatggctgtgtctggttgaagagttgtttccagaaggaccttgttgtccgtccagatgaactgagcaagtgtgaaaatccctgtggaacttgctctagggcagataatgtgcagctggggtgcatgtggttgttgctcccgtgtaattcttcttctttggaaatgggggctttggagcctgggaagcagagagaggcatgtgctccccacccccaccctggagtctccccaggaaatatctcgttcttgttctctgctcacggtttaggttgcacgatgggaacacaagacccgcaagctgagcagggccttcggatccccctacctggcctgctactctctaagcgtcaccatcctgctcctgaacttcctgcgctcgcactggtaagcacagctctctcactggggagccacaacccctgggctagcgggagggccgctactggtggtacctcatccctcaccacgcgggagccttgtgtctgagcactcaggggttagctctcaaagccacctgccacagcaagccaccctacccctcccagccgtttagactctggccagcagaggagccccagtgacctcaggaatgggggtatgtgaatggggggcaagggacaatgcctgggtggtccccaggtcacatcccagcctctgccacgtagccaaggctgttttaggagtctcctccaggaagcgtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccgtctctactaaaaatacaaaaattagccgggcatggtggtgcatgcgcctgtaatcccagctactcgggaggctgaggcaggagaattgcttgaacccaggaggcggaggttgcagtgagccgaggttgcaccagtgcactccagcctggggcaacagagcgagactccgtctcacatttttttttttttaaaaagaaagcttctttgcccatctctggacttgggacaggcaccttcctgctgtcaaatgaaaaggtcagagaagaagaactggaactagatgatgaggcacagcccactgcacttgggagcgaatttctctgcccagacaccaggctagacaaggcccacctgcgtggaatgtgatggctgcaggcgacctggggatgcaggctgtgcagggcagctgccccatctctgggccccggtctcacctcccacagtaccctgagaatcattgcgcacggcagctcatggactaaacatggaccacgtggttctccaaaaaatgagaaactagctgcaccagagaatccccatttttgacttgtcgagacagaccagaagttgtgtgtgtgcctggccacaccccacgtggagcgctcactggggccgaggcacagctgccccctttggatggggcgcgtgtagcctggctctccccattgcccgtggccccatctccgtcggaccagcctggcttgcaggcactgggtgcacacaggaaggggcctgtgaatgctccatgccagcacgtgcggagccggggcaggccttgctggtggtcaggcccctcacacactcaccgagggtggcctaggccttccccctccgtggccaggcacccttgctgccttctcgtcattgtcatggccttggccacaggaatgtgggtgagcagcgtggtcagggtcctactgaggtcagccttccgcactggacccctggctcctggcctttgcttcttggccctttgggccagggctgcctgctttctctaggcctgggtggctatcccacggtcttggtcctcagaggggtgggtcccctggcacctgccctgggttgaatgatgtgaagaggcttccccagagagggcttttcacccctcggagggcaaggggtttggcccatggcaccgcctcggggcctgtgcgtctgcacagcctgcatgcttacaatcttctaggctctccggccccagggagcattttcacatttatagtctctgggtagagaagactctgactgtgcagatggaggaagtgaggcttggaaagaagcaatggttgcccgaggttttacagctcatgaagcgctgaccagcattggagaacaggcagcttccagctcagcagtggcttagggagaaaagattccatccatttaggccagaggaacctggcaggcaccggcaccacccaggctgggttatgggagcatcaggggacgggagatgggcctctttcctacccatgctgcctcttgggccaccggcagagtgtccctccttacccaggatggggccctggctgcattggcaggacagtcaggggtctgtgccctccagcccccaggcatccacactccccagcggccaggagggagggggctggtgctggccgactgaacgctcagagcttggagtccccccacaggaacagcgaggctgaagacaggtggagggctgcagagggttgagactcagcccagggctggcacgctgagctgttccaccactcctgctccctagagcatgccgggaccaccatcagggccggcacaaagcaggagaagtgggctgcagcccacagcgcacacagatccaggagcagctagaccaggccaggtgactgcccagaaacaccggccagcgccacaaggcagctgccttgatggagcccctcctgccagccctgccccgggagctgctctgagtctctgctgagttctgatttcctgcgcaatctcatcttgcactagaaaccccagaggcttccttgagtcctccccatcacctccctgctggtccagcagcacagcctgtgatctgcctgaccctggaggtctgcccccgtcatccaccccttttcaaggcagagagtagagggccctggaaggggtcatccttcctcctccaggccccagccgagtgctgtgtgtacctaggagaccagggggacaggcccacccacagcccagttccagccgtagacagcagcaaagcactgtctggtttgttcttggatcccggggcctgggagtcctcctggggtagctggaggaagtcagcttcttaccgatggtggctcccagctttccctcctctcatatcagcgttggcctcacctggcatctgcccagccagcagggccatgacttttggttgaactggccacccctggattttggggaggagagaaaggatgtcctgggctgcttttctcctctcaccttttgtgttcagaggcagaggtgtgccctggtcctcactctctcccccactgttcttcccctccaggcccctgcctgcaccctatcctgccatgtccctggtgacccatccttcccgcccacacctgccagtgtgaggcacacaggtggcaggtgctggagccggaccgggctgttgggccaggctctgacaggaccctcgggaccagctcctgcataccccacacccccacaccctttcccatgcatgcctcgcttcagtggctgtctagaggtgggtattcttttttgtgcagtaaaatagacataacataaactgttatgaaccattttaagctttacaattcagtgacatttagcagcttcccgatgttgtgcagcccttcctcctgactagtttcggagctttttcctcaccctataggcctggagcagtcatctcccgccccccagtccctggcagcactcgtctgctttctgtccccatgagtgtgcctgttctggacctttggggtgtggcatcgttctccatgggagatggcaagctttgtggggtccaggctgtgctcaaaagcctctgcacccagcaggagtcggttggtgggcagagaacacaggcacgtgcttgagccaagcctgggtcatggatgggatgtccgagaggccaccagcagctgacctgccagcgggtcccaggggagagtaggtcactatgttagcaggtctgcaccagcagtgcatccagaggtggtcaggggaggcccggggcaggatgagccactgttatctggaagcaggtgtgctccatccagtcccgaaggggccattagcacagacctgtttgctctggctgtggagtgtgaatggggaggaaggctgatgggctccggggcacttgttgaagtcccttgcctgagctgccccctgcacagctgaacttggccagctttggctggaccgctaccctctgatgagccacaaggctggtctcgagaaagcccacgggggtgggcgaggcgtggatggccaggcagggctcgaatgggcttcacaggactgggctgcagcccttcctccctcctggctgtgggaggagacagccgagcttgttagggcatcagcgagctcctggtgtcgttcaccagtcacgggatggaactgtgctccagcgcacatcggaattgcctggagtctcccagggctccctctgggtcttctgaggggagaggctcctgtgtgctctggtgtggcgggcacagccaggctaagaagctgcatcctggcctcggagtgtggctgtcgatcaggaatcttcctcaacctggaggtattcccaggctgggctaggaggcacctggaggggcagggtggtctctggaaggtggtctgggtgggtggggtgcaggcggagccctggctgaagaagcgttacgaccaaggcctggaggagtgagccggctcttcagatggctgggcagggcccatgagtcccaggagagggcggcccccactcacaggctgggcagcaggggcagggcaggtggggactcacctcagcgctctgtatactagaggccgtggggcaggtgcaaccctgtgggacaccagactcaccccagagcccctctcccctagggaagtctgttttcaaaaactccctgatgattctgaggccaggcctttggggactgtggccctggaggaggctggcacaggtggccctctgtcctggtgactacatgtcctggtcactgctgcatcccacccagtgcctggccggacctgctcaaggatgtggtcaggacaggccgggggttgagcagctgcatgaaggagggagggcatggagctgatgggacagtttgcttccgatggagcaatggagggctgggcgtgtgcagcgttccatggcagaaaaaagcgactcctgctgtcttggcagaacaggccagaatttttaaagagtctgtggactgggaagccaagtgtattagtttccttctgctgtgtaacaaattcccacacacttagggcttaaaccacacaaacttactatgtgacagtttctgtgtccaggaggctggatgcgggggcggggtctttgcttagggactccccaggctggaatcaaggtgcctgctgggtgtgagctcacccaaggcgtggtcctccactctttcgggttgctggcaggacgcgggtccttgaggcccagctcctggtggcctccccgcagcacagcaggcagctctgtggctttggcttttggtctctctggcttctagacccttttggaaaggcctacccagggtcacctcccttttgattaactcaaggccagctgattaggacctgaattctatttgtgaaatcccttcaccagagtgatttcctcgcggcaggtgcctggggtagccactgggcggggtccatgagggcagctggagagtaaggggtgggggggcacttaggacagggaagctggcataggctttcctgggcacaagggcccccagctgctgggaaggaaggagggagaggggctgcagttcggcaagagtgggtccaggccctggtagaccaggctggtctggcacctgaggggctgtggctgggaaggagggaagaggcaccctccccatccccaaagcacacacggccaggaagtctggaaggagagtgggtgtcagcctgggattcccaggtgctaggggtgctgggatactgctgcctgttgtccttggcctgcccgtgaggcttgagcctatcccactgtttacaggtcgtgaggaggcaggagagccatcctgcccctcctgctttctaccatctgcttccctgtttgtaaaacaagacagactctctctcagctattgatgggttctggaaacactttggaaaggtgacgtgttattcaaatgctcagaattagtgcagcgtcaaagcccgaaattcaagccctttgatggtctcgggggttgcatagatgaacattttttgttttagtagttacatgcttattttaatatgtcttggaaaagaaatgagcccatcagacgactcatttcatggctagcgtcgtgtagctgagatggagtggaaagagcgagtcactccaagcctggggtgaaggatgtggagtacatggcactcaggccacacatggatgtggacgacgttgcggagacaccccaggatgatcaaagtcagggaagtgtttctggtcggctgcagatagaaacgggacaggcctgtcccaggtggggccgtgtgcctgtggcctggtgtgtggcccaggactgctggctggggacagggcggggacactgagggcagtgatgccccctccccacctccaccccagggtttccgggattttatgggagcagagtgcagacagcctcaaatcacattaatgactgaaggttcaatccaggtcttaaaaatagaacccaaggcaaatgaatgagtctccgttccccacccctagtgcggaatacttccaagggaaattgcgtcctatattacctcattctgttagggagcttgtggtcacagagctactcatccatccactaattttccctgtggaatggacggactgtgctttcctggcttaatggaggagctagaacactgtcgattgcctaattcgggccatgagattccagtaaacctggaatctagaatcagagtgtatttgactgggtaaggggccacttggtgagaacgccagggaggagctcagcccagttcctctgccgactctgagcaaatgacccacagagcattgtgccaggagccagcccaggctgtcatctcagagaaaggaaaggaaaggccccaggactggggccgtaggcggaggagcagctgggggactgagggtcaggtctggggcaaatctggggcctctcccacccgctccctggccccggatctgcccttcatcaggaatctgcttccaagcagatctgatttgcctactgagccatgcccccagggaagctgggccctgaacgagctgggcttttgggccacaccagagggaggaagttccctttcatctgctgcctgcttgtgtgatgcagatgaattctggcagaggaaccctgagcatggggtatggacccaggcctggctcgggtctccgcaggagggggtaagagcgacagagtctccgtccagagtgaccctccagcgtctcgggcctggcctctgcgcccaccccctattgcagcacctggatgggtctccctggttctgcattttccacagcaggcagagtgcattccaaaccctgccgggccgaggcctgcaccttccctgctccatgccctgccccagactctaaggcacacctccctgctatttcctctttctggaatgctctcccctgttcgcccctcccaacccctgtctgttttctggtccccactgcagtggcagccaaggagccagatgcttgcaggggagccatgctcctgagcagggccggcacccttcctttccctcccactccaccatctgcaggcaggagagtggagggtgccaggcaggggagaaggtgtgcctggatcgtggcaccacactgggtgtgcatgtggccacctgattccatggcagcccgtgaccctgagccaatcccagaggctcggcctggagctgcggggtgaccctgagcccgggcagcagcaggatcagggcagggcactggtgggtggagagctgggggtatgggcagcatgaccggcagtgggtttgccctgacacccgaatgccgctgtttaacaggtcggtgtgcccgcctctgccaccgggtcctggtggctttgtccacaggcccttctccctttctccctggctccttctctgctcttggggatgggaggagaaggaaggagcggctactgcttctctccagtcgatgaatatgcactaaacatccattctgtggcctgggccaagtgctggggggatacgcagggaaggaggagcaacttctgttccccaagagctcccagtcaagctggaggaaggagttccagggaggcataaagacatgtctgtatgtccttagctcagcataaggagtttcacaacaatctgaattcaccaatgaatggaacgagtggatgaagatgggggcttcaatctgcttgaaagagcctagcaaacaaagatacttcatggtggatggatggatggttgtgtgggcagatagaggatacattgatggatggaaggatggatagctggacagatggatggatgtgtgggtgcatagaggatagatggatggaggaaggatgggtggtggggtggatggtaagctggccctgctgggagatgccgtctacagactgggtgtgaaaggcgctgccctgcgtgaggtagcagatctccatgtctcttctgtgttgtgattattgtgagcatgggaagtgcacatttggtcacacatgtccgtgctcccacacacagcctttcctgtgagtgtgcctctcatctagcacccagggcccccttcccaccagcgcccgctcccctgtgatgaggcctgggtacatcagcacatgcctagcccctgtgccctccctgcaccagcccctcagttctccggagccaactggagaacctgagcctctagacccactgctgtcatagtcacccccttttggtcacgccactgccttttctttttttcttttttcttttgatactaagtctcgctctattgcccaggctggagtgcagtggtgtgcaaactccgcctcctgggttcaagcgattcttgtgccccagcctctcaagtagctgggattccaggtgcccaccaccacacccagctaatttttgtattttgggtagagacagggtttcaccatgttggccaggctggtcttgaactcctgacctcaggtgacccgcccacctcggcctcccaaagtgctgggattgcaggcgtgagccaccacacctggaccccactacctttttacaaggccttcagtggtttggccccaaagggagcctagtgggggaattcaggtgtggaggaggacattaagggcccccaaagtgcctttaaatgcaagtcaagccacccaggatgtggccagacccacaggggctgtggaagcgcaatccctagcacagagcatgccccaggcctcggggcactgagtctgttggggaatgggacacctgggcctgccctgcaacctggcacctgcgtctttcctgagcctcactttcctccatagtatgagttgctcattggacaggatgagagtttgcaagctggtggccttcgggctgaatccagcctgctcacatgcagggtctaaagtggctttcatgaattgtctatttctaaaaattaggatatttcacatacgagtcaggatttctggcttctcttgaaaaaatttaaaaatctgacaggcctgggcccctccctgttactgtcacccacctcccaggtggactggaccccacctgctgcctgcctggcctggcagccctgggctggctactctctaagggtccctggggagagggcgagaagatgaggtcggcctcctcccgggctgtgacatcctccctggccatgacgtcctccctctccatcccctgcccacagcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtaagaccctgagggctggggtgaccctgagcaggaccgctggagccccagggaggtgcagggccaggtggctgctgccctgctatccgtgacatcggtgggagtgctaggggccccctccatcggggcgtctttgctcctccaggcctggcttgtctgtggttagaacaggaggctgggctccaacagctcctcttaccccagcgtgctgagcggctgcctcctggggagtgaaggcagctcctgctgcttctctccagctaatgaagatgcactcaatgcccgttctgcggcccgggctgggtgcaggactccttgagtccagctccagcaccagctcccccttgcagaagactctcaggccttgttgcacagaagcctgaggtggtggtgagtcagccacctctctggcagctcccggcacgcgtggctctcaggccaggcaggattgtggtttgtgccgtgtttggccgcaggcagggctggtgtaggtctggggaggggtgaggggtggaggcaccttatcccttctccatttccctctgcctgtggctgaggtgctttcaggctgtgagcccagtgctggcctggctagacgcccaccaatgaccctgatgatggcagcaacttccagctccttggaatctgggaaagaaaagcagccatgggaaaggcagtaggggtcggggtgggaggggagatgggggcaggggtgggggacaagagggggccttcggaacctggaaggagagaaggaggcagtccctgtccaaggggagcccctcccagtgagcagggagttggtccagctggccgcattgcccgctctccgtcatgggtgggaaggcccacgtcttcctccccatcagccctggccagtgcaggagcttggaagtcactcggcttcagtggcctcagtagcctcctgggaccaacggtgtcctgaggagctcccgggcctgcctgccatccccatcctcagatgccggctacagctccttgggcccagcccccagggcaccgtgggctgtcacagggcactccaagttctcaaggagcttgtgcctgccagtaggggtccccccgagggaggaagtggcatctgtgggtgcagcattctggatcgcccatggccaggcctctctgggactgtggggggcacccacaggcagttcagtgcttcctgctcaggcagacgctgtagggagtttggtccaggaagggggacggcagccaggagcgtctggatctgccaggtgggggcaggtgcgggcaggtaggaaagagaaaaaagccttggtgcaaggagagggaggttgagggcagagtagctggcagctggaggtggggggcagctggactggccgcacaggtgctgtcggttgggacagggcaggaggatgagccgaggccttgaaggccatccaaggggctgaggctccatccccagagaggtgggagccatagggggggtcccagcaaggaagaggttggaccgatggagccaggatcagaggtggggctcaggaggagctgtggaggggcccttccaggatgtgagggcggtgagggccccatgggaagggggactccgggctgtgcaatcaggtcctgtgggagaccagcggcgggggccctccagtggccagtgctcgggtggatctggacagggagggctgcagaggcagcgtaaggagagccaggatggtgggtggagcccctcagcagtggaagaacaagctgggggtcctggacagtcagagggagggaaggagcctgcaaacaccagtggccacagcctcctggcggccctgccagcagacatggcctagaaacaccgaggaccagcagcgcggtatgtaggcaaaggtggtcacttcctgctgtgactcagctcgaattgggtttctgtgccatctacgcacaccctgtgccccacttcctgcttcctgggaagaaagaactttccagtggtcctgggccctgccccgtgtccccagatggtgatgaagctcctggacccctcctgcccatgctgcccattgtcgggcagctgccctactttccgccttggatgaagctccattgtcctctgggaggagagacaaatgaggggtttctggggacagaaggctgggaggaacgaagccacaccctttatggagcggttactctgtgtccagtgggactgtcctctgtgggcctgggacagacactgtgactgtgaccccggccactcccttatggctcagagcagctctgccgggggacgccttgtggctgtgcggctgacgggtgcatggctggcctgtctggaacaggctgttcaatagtcaccctctctccactgggtctagctcctctgggcagctgagtgagaaaacaataccagagctgacctcccagagcaacgggaggcgtgctgtggccaggccctggtgccagagccacacagcctggggtgtggagcagagcagcccttagcaaccagctgaggcccctagagggagaggaactcaccagagcgaggaagagtgggaggtaggacaggaagaggaagggtctgcataaagaggcgccatgagcagagggcgaagggcctgaggaggaaaggcgctctctgtacagagagcagggaaaggcatcgcaggggagggaacagcgtgtgcagagccaggaagaagaggaaggccagcatggctgggtcagagtgctcgagaagaggagcagtggggcaggggcggtgctcagcaccttagtccttaggccccacgccctctgctgtctgcgtgcctgttgggtccctctgactctgcccattgttgaactctctgaagtctcctggagggcagggccctgtctcacctgcaggtctcgccacagcccgctctggggcctccctcagtgatggtgtggccagggctgatgaatagccgagggaccctgccttgcctcatccacaggtgattacttcgggatcctcaaggaggcgagagtgaccgtgttccccttcaacatcctggacaaccccatgtactggggaagcacagccaactacctgggctgggccatcatgtgagtaccaggcttgccacccctctgccctgctggccacctcccggagaggagctggtgcagctcaggacgcgggggccagggcccctggagagagagaaaggaagaacgtgtcatttgtgggggcctaggcgccctggttctccctttctcagaagcgtcttatctatggtaacagaaacaacatcccagaacagggtggtcagcttctccaaagagggctggagtgtggaggctcaaaggctgcaggcaggtcacagctgctcagccctggtcctgccacacaaaacagctgcagacgcaggaaaatggatgcgcgtctttggcgccagcacagctccacttacagacactgaagcctaaatttcagattcttttcacgtgtcatgaaacattctttttgatccttttgcttttaaccgtttaaaaatgtaacaggcgttcttggcccctaggccgtagtttgcggacccttgtgcggggacatcagggctgggaccacccgacccatcttccccgcaggaggggttggccagagccgccagggcccagctcacccgcagctgacagaactccctgtgccccaatagcctctgcccatgtggcagataccccttcccacagagggggccccgtgccatgagggaagcctagaactgctgtcggcctcagccaggtacgggtactgacaaggtatggagatgtgctcccccggggggtcagaggacctgcggtcaaggatggcacagcgggcgctgccctcggcttcatacccagcccccaccccagcagttctagtttagccattttcttccatagaaggttttttggcagacagtgttccactgcttttgtttaacacttgaaaaccactggcctagaatttacaggttctccacaagacctgaggatcccaaaggagtgaatcgtaaacagtgaatgtcaagcgcaagatgttgcctcctggctcccaccttcagcagttgggaccgtagcagcgggggttggagacagcagaagctagaaggggggctgtgggtctggctgggacccaccctacccccaccccacgtccaggccaggcagtccccagggacacgtcctacctgccttctagcctggtccctctgcctgctaaggcccagactatgtgcccccaggctcaccggccatggagcacccccactggggccacaggatgagcccaaactcaaaacaatcccccccacccaggtcgtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccacctccagaggacatcagccatgcagcgtgctgagagatggcatcaatggtccaggagctcattagagatgagccattatctggccagacgctgacacagcggggacccccacaggcctcccacggcccatctgtctctcacctgccagggccccggagatgggccttccaggtgtctgagctccccggcatgtaggaccccagcaggctgtgtggcagtgagcccgatgccaggggacagatggcagaggtggtggcctggctgtgagggacaggtgggcctcctgcttcgtgttgtgcaatcagggactcctgtccccctcggcgcccacagtggggtcgctgctggttgccaggcctggggttggagcctgggcttggatctttgcttacgtctgccctgcctcctgcagctcccagacaggcagaccagtgtgaggtccaggggtggaaggcagtgggcagggcagagggtccccacggggtccacaggtgtcctccagccctcacctcgatccagccctgcctgaggttcttgtgatggtttggctggggagggggcagcttggcacaggggcagccaaggagggcacagcccctggcccaggcctgcccatgcgccctctgtgcccgccagacagctcctttcctccctctccttcctctcttcctccctccctccctcctccctggcagcagcccagcacctgcgggagctgtgggatcagaggtaactatagaaatagattgggggacagcttgacggcagctatttctggaaacccaaagcagctgcgcccgggctccttggtgccgtcactgacgagctgccgctgcttactggtgtggcggggtcaggagctggtcaccagcaaagagcccctggcgatgctccatccggccttgggcctgctgtatgctctgcctggggcctcccgtcctctgggctggggtgaccgggggctcctgggcgtggggctgctgtcccaccacctgggagagcccaagctgggctaggtgttgagggctgggcggggcggcagctcctaagcccccttccccacagccagatcctcccagggcgtggccatggggttgcacctgtggccaggggctggggactcagggtggaccaaactggctttgggggaccctggacccatttctagaaaacagcctttgttcctcagagcatggtttctgggagacgggagcactttgccccagaatctcctcctgtgcgggaatgaacagccctagccactgggactcttccgcctggggctgcgttcccagctctgggctggcggctggagacccggaaagagtgagcaggccccaccctgagggaacccagccaggccagacaggcagacaatgatgataaatggatcaggaccgagaacatggggaccctggtcctggcacaaaagccagactcaggaaggggcagtgctgcctgggctcggtcggcccaagtggcccagcgtcggccggagggcctgggtcacggcaggaagggccagcctgggcaggtgggccgtggccctgagagaccctggctccagccaggcctgacctgcctctgtcctttcaggcacgccagccccacgggcctgctcctgacggtgctggtggccctcacctacataatggctctcctatacgaagagtgagtaggggctgcggcgggtgggggcgtggctgcccgactggccctgtctctccctctagaacctttccttgtggccagggcaggctcaggacaggctgccgtcagccaggcccactccagggctcccaggtcagagtggccatggtagcttacaatgcggcctgcaggacccagcaggcagccggcccctctcccctcccctctcccgcctgcgctctgaaggctccaagtcagtgttgccccagtggctctgggggatgaaggggatcccggtcccatctggacaccctcaagctgatggacgcagagctctggtgcgggcagtgggtcacccccaggacctgctgaccgaagcctctccccgctgcccggcaggcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaacatctgctccagcctctgtctgtctgtgtggggaaggagcaggcctggggcacgaatatcaggtcaaatagctcccgagcaaggctggctccagcctttctgtcttgaaatctcagagctgaggggtgggcacctctctccaggcctcccagtaaggtacttaggaggcgtcaggggttcacctggccatggccatggtttcatctccaggagacttggtgtcttgtgtcacctgctcccacccctgccccagcacacccaagacagcccctctgctgcctcttcccttggaggatccagccccgtgtccgtcagcatgagggtggagaggtgtgggcatgttgtccttggccaccccagtctagctgggcagatgacactgtcattcctaaatgaatggccttgtgctgaccagcagctggacacatgctgggcaccctatgtgtctgtatgggggtgaggggtgggccctgcaagggtaagcctcatctgggggaggcagggcacagtgaccaggagtgtaggctcagccattgccactgggactcctgaggtggacagaggggacaccctccccctctcctcctggcatccatgccgccacttcctgttttcatcccagttctgctgctggtggcagggtcacccctcagcccccaggactccaggccccctgactggggcaggtcgaggacttctatgcttggtgggctttggggtgattctccccggggtgctagaggccctcagcccttcagctttggtcaacattatccctcagggtctctctgtgagccccgaaggccagtcaggggctcccggaggccgtgtggggattagggttctgcggggagaggcctccacctgttccagcccctctcctcttccacctgtgacctcaggcagatcaccgccctcctccagctccaggggtcctcagtcaagctcagagacagtggccgagggccggctttcccttgacctcccgttactttcgctcagggctgcaaagccacggcctgaatggatatttacaaagcgccctcaatccaggatcttcgtgctcacaccgccaagatggggtcccgggccgcattcctgagccttccaggcaagcctggccctctccttggagggctggaggcgggtgcaaggagactcaccccccagcacaggagtccccaggccagagctgtcagaagccacagggcttccgaggagtgaacctgaccctttcatcacacggcctcttgtcccacttccttggcccccagggcacatggtggaggcagggctgccagccctgaactcctcttgccccagccccagccccagccccctcgcccctggacctgggcaggttccccaacttcccactctgcatatggaggtagagtggatgatggtgccagggttgctgggcaaggctgaccctcacctgtgtcttcgctatcccaggtgcccagttgaccgggccccacagcccaggcaggtggccttcagggtctgggccacagagcctctccatccctcagctgtgctggctccttctctctctgggcctccttccctgtctccccagccaggatgctcggcctgggatccgggccatgggtgggaggtgccagaaagtctcagcctgagcactgctcatgttcctaggcagttccctgctccccacctccgctccccatcagtcccagcccccactggggggctttatttttaggtaccacttactcagcacccagctgtgtgtgcagccggaggaagcctggttccctggcaaccggcctggctcagtccagtgggcccctcccctcagggctcccacctcctgcccactccccactcacccctgcgcttcaccctcacaccaccccccctgccaaatgcaaatggggtcaggacaccccctcaaccccctgttgtcctcagaaggaagtcttggcccattaaccctggggcccaggacttattctctccccagagcctgtccc

SEQ ID NO: 15716 - DNA, 30360 bp, Human
  misc_feature (1)...(30360): n = A,T,C or G
cctgggtgacagagagagactttgtctcaaaacaaaaaacaaaacaaaacaaaacaaaaaacagtgaggcagatctgttgtgatgatgactccaaaacaccctccctgcctctgcagagggactgcagaaagggttattcccattttatagatacagtagctgagactcagaagtgaggtattggatccaggtcacacagcaagcaggtgaaaacccagatcacctgcctagctctgaagaaaatggtatttaggcttcacccagcacttcctaccccaccccctccctgggaagggctgtttaaattttcagggaagtcaccagcttcctgcagcctctagagtgttggtgggggtggggcactgaggagaagccagctttgttctctgtgttctccagcagttgttcatctggagggagtgggtcctgggtggacccttgagcagggctacttggggagatgtggtttggcgacccctgtgacttctggcgcccctattctgggtaattttccaccgcagccacttctgggagaggaacaaagggagctggatgtccaggctgagccccagggacttgggctctgtggcttctctcccccacacaccccttctaaaatgcatcatgaatgttactcctgcttagggcgtgcgtggccagataggctatatctggagtttgagcaaggcagtctgcaggatggcttgacttatgaaggtctggggtcgggaaggcctgaggcccaggcccctgatgagtttcctggactgccctccaccaagggtgcttctctctgcttgcatacctctggggacagggagctcactgccttatcacattcagattcctgaatgttaattctggtttatttcaacccacctcattgggaccccttccctccttcctgccccacctggctctgtccctaggccacagaaccaggttcggtttccagccctcttctcaacagggctgcctgctctgatctagtcccagcttgtgatgatccagggcagcctggctctgatctaaagcacagctacctcttccttgcggcccctatcctggctgctcctgggaataagtgccaaatctggggtcagacagccctggggccagtcttccttgggtactggcttcctccttcaggagctgcactgggcccactggtatcctatccctacagctggatctgggaggaaaccagatgacgaaattccagcctctttctttggccactcctgtcctcaagaggccaatcttctggtttctttgcagagagggggcaggctgatctcacaggtcatgctcccctccacattgtcactagcctcccagcctgcccgtgagaaagcatcattaggcccatgttacaaatgaggaaaattgaggcagagtgatgtaactggcccagcagttacatcaggcctgctcacaacacagcaggcctgggacccctataacttggatcctggtctgtcttgttctaaagagtcaaatctaggaaatgaggaaatgaagtttgggatgggcccaggcctggggcttccactcggcttccttgcttggtgctggagaaacagaggcccagagagggggctcggcttgcccgcgttcccgcagcagccggccagaggccgctgccattgtgcgcgaggctggataaaatgaatgactggagggcgctctggaggaggggccggctgaggggagatttgtggcgcagaccggggatcaggggtcccccgctctctcaaggtggggcggggccgtctatctgggagggcgggtcctccccgaaaggccccgcctccgcctcgaccgcccannnnnnnnnnnnnnnnnnnncgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgcgtcagggcgggcagggcttgaagctgcgccgggtggcgcgagtagggggcgcgcaggtgtctccctggcctttgtctcccccacgggcgccagctccgtgctgtgctcgcgcgggacttcccggtgtctctgagctcggtgtcccgagcctcaccgagcctccctggttcccgcgctagcgtctcgggccgcgcgcttgtgggtgagggctcctgggccgggccggggtcccttggcggctccgggccgggacacgtgcgcctctacgcgtcccaggccgggtgccgcccgaccggtgactctccagccctgtgatggccacggctgaagctggggacccaggcgtcgccgaagctccgccccagccccagccgtgacgtaattgcgaggttactcacggtcattccctccggcccgagagttcagctcggcgtcggagctcttgcgcatgcgcatgggcgctgcctcgcgcccttcccccgcctcgtgtcgggttctcccggtctgcgacgggcacagcctccgcactcattcactgacatccaccgaatgccaggccccgtcttaggcaccgagggtttacagacagacctgggtaccccctcttttagggaacacaaaaatctcccgggaaaccaaacgggtatttagttgtaccttgggtggagcgaggctgggggagggcagggatgtggctactttgggtagagcggtcagggacttctaagctgagacctgagggtcacccccaggaccagcaaggaaagatgttttccaggccacggcaagggaagggcaaaggcctcgaggcagggcctaagtgtgaggagttagaggcttgcaaaggagtgaggtcagggaggaggaggacgcgaaccgacttggtcggccagggaaagggcggagcagaacagtggcaccggcttccatctttggagcatcaccctggctgtgatgagaaggggtttggggccaatggtggcaccaagtgccaattaggaggcccgttgcttccattttgtagatagagcaaacggaagcccctagcaaattgcctgcatggtttctgtgcaggagttttagcagcactagctaagttgcacttggttgatgaggaaactgaggccaaggtcgcaggaacaagatgcctagactcacagcctgaatggacatgtccatggaacccgtggccaccctggggttggcaaaacagatatatctatgccaccaccactcctgccctactgcagccttgcagatgagcccagctggttgccagccccagaagcttcccagccctccctccttccccctggggctgggctaggggaggaccccagaggagaggccctgattgtgaggcttttccaaaacagcctcccctatccctggcacgaggggttgtccttcactgccctctggagtgatgaaccctgaaatcccaagccctagggagatctgggcctgactcaactaccagttccacatcactgggcccagtgagtgtagtcccaagaggcaacgtgaccaagccaggaggacatgcgctttggggtcagaacttgaacctggacactcctcacttcctttgtcatcctgctcaagccctctcaccctctaaaccttagtttccacctccagaaaaatgatgcaaaccctcccttcatgggcaagttggacaacagaacccgttctgggccacaggtctgatacagacctttgtttgtttgtttgtttgttttctgcagtggcgcaattttggctcactgcaagctcctcctcctgggttcacgccattctcctgccttagtctcccaagtagctgggactacaggcgccagccaccacgcctggctaattttttgtatttttagtagagacggggtttcactgtgctagccaggatggtctcgatctcctgaccttgtgatccgcccgcctcagcctcccaaagtgctgggattacaggtgtgagccaccgctcccagcccagacctttcttactgacagaatctggtctgggccagaggtctgatacagacctttcttactgactcatggataaaaacattgtctctccagaaccaaaggccaggcatgggcagccatgtggcccaaggtctagtctatgagagagtgggggcagtcccagccccttgaagactgggggcagccccttctcactaggcagggctcagctttacccacttcagtagaggatttttcagtttttattcaaacttcctgtttttcttcccaattacacacatcttttttcattgtagaaaacttagaaaatgcaagtgagcaaaaagaagaaaataaaatctttagacctggggtggtggctcacacctataatcccagcacttgggaggtcgaagcaagaggatgacttgtgtccaggagtttgagaccagcctgggcaacatgacaaaatcctgtctctacaaaaataaaaaattagctgggtgtgggtgacatgtgcctgtagtctcagctactctggaggctgaagtgggaggattgcttgagcctggacttagaggctgcagtgagctataaccatgccgttgcactcagcctggatgacagagtgagattctgtttcaaaaaaaactttaaacctaccacccagagataagccctgctaattatgtgaaagagcttttcttctctctctctctctctctctctctctctgtgtttatatgtgtttggggatgggtgcacactcttcataaacttttttttttttgagacagggtctcgctcttttgcccaggctgtagtccagtggcatgatctcagctcactgcaaactctgcctctcaggttcaagagattctccagctcccaagtagctgggattacagtcatgcaccgccacgcctggttaaattttgtatttttagtagagatggccatgttggccaggctggtctcgaactcctgagctcaggtgatctgcccacctcagcctctcaaaagtgctgggattacagggcatgaaccaccatgcccggccttcatcaattttttaaaaacgactttattgaggtatactttatgtatcacaaaatttacccatttttagtatatcattcaatgatttttagttaactttttgagttgtgtgacaattactagctgtcgaacatttttatcacacagtgagatcccttatacttctttagtcagttcctgttcctgctcccagccccgggcagctgtggatctgtatgtgtgtgtgtatatatatatatatatatatatatatttttttttttttttttttttttttttgagacggagtcttgctctgtcgcccaggctggagtgcagtggtgcgatcttggctcactgcaagctccgcctcccaggttcaaacagttctgcctcagcctcccgagtagctgggattacaggcacctgccaccacgcccggctaatttttttgtatttttagtagagatggggtttcaccatgttagccaggatggtctcgatctcctgaccttgtgatctgcccacctcggcctcccaacgttctggaattacaggcgtgagccaccgcgcccggctggatctgtatttttataaattaaaatagggtccattggttcacagctgattggaatctgcttggttccatgtcaacagccagacgacagtaaggtttcctcttattacccacctgattccctgtcgatggacacctaggttgttttatctttataaactgctgcagtggacactgaggccggtttttttctttgtttttttttttttgtttgtttgtttttgagacagagtcttgctctgtcacccaggctggagtgcagtggcgcgatctcggctcactgcaaactccgcctcccgggttcacaccattctcctgcctcagcctcccgagtagcttgggactataggtgcgtgccaccatgcctggctaattttttgtatttttagtagagacggggtttcaccgtgttagccaggatggtctcgatctcctgacctcatgatctgcccgcctcggcctcccaaagtgctgggattacaggcgtgagccactgtgcctggccactgaggccagtctttgcccggatcctcactgtgttcctaggatgaggttctgggaggggaattgctggtcagaggtcgagcctgcttttgaagcttcttctaccaggagtggagctgagcaggtttgataaggtctgaagatttgggggtggaaatgccaggtcccttgagagacatgagggataagagggggccaggctggccttgagtgccagagtgcagagctgggctagatgtgaggacagtcgggggtcagagcaggggcacaccgagcttcagttccctctggctgcttggatggaggatcgtaatgtgaacagaaaacactaattgagtacttactgtgtttcagacagtgtgttgataatcccacttaatcccctgacaaccccaagtaggtagacatatgatgaagatgacggccttgaggaccagagaggttaagtgatttgcctgagatcacacagccagatgatggcaaagccagaattcaaacccaggctgtgggctccagagcctagctcttaagctcttaagcactgggctcctaagaatggggatgaggggttgagggaggctcctccacaggggctactctgggggcctggaagtgggtcacagaggggtcagaggctatgtggctacctccccatcccagtccagagcagtgtttgagtcattagactgggaaccagccctggtgagccagccaagggccttgggccccatccggtcctgctgcctgccacagccaaactcttgtcatgtgaatggatttggggatggagctgcctccatgagtccttgcatctgtgggtgaaggcactgccctggctatagtgtccctgggtttgagtcctgcatctgcaccaagacctcaggtgagcctgtctccttctgggcctcagagtaccttgcagctgtcgggggaggatggatcaggagatggccctgtacctgtgttggggattattgttaagcccgtggcagtcttcacctccctgctgaggattaatttatccaattttgcacaagcttatgagtgcagaagaggcagacggaaacagagttctggccaagagcctggaacagggcctcggggtctctttcctatgcctggaccccgtcatgtctgctctttgtctgtcggaccccagatgtctgccaagccccgtcagaggctgcttcccagaaagcccttctgggtgtcaccttgccccgagcagtgcgttctcagagttctcccgccctgatgtccctcccagcatgcccagcccagccacaacagggccttgcttctagtcatgtgtctggctgtttgctgggtccaggccagccctggtagggcacaatgggggcccgctctgccaccccatacctctccccaggatatctcatgccccagttctctccctagttccaccaagcactggcactccttagaaaacacagctctagactagttactgccctagcttacagcacagaactcccctggtctccaaccattcatggctccctagtgctccaagataaagttcccttgtctcagccgggttgggagttaccttctgcccaacattcacctagctggacacaaacatcctgagtgacccggtcagctccaggcaggagtcactgccagcagaggcctgggatctggactttgcctgctgacaggtggagcccaggccggccagaggaagtgcctctgaccttgtctcctagcagccacgggccatgtggacatgccttttgaccctgggcactgacagtgtgtgacagcctgcaccatgtgctccacaggggcggctgtgtgtgtcgggggtgaggtggggaaagccttaactggctcaggggtgagaggtcagggagccattgagactggctccaggtgtgggtcccctgctgggttggggcttgtgggaggtgggacggggcnnnnnnnnnnnnnnnnnnnnaacacagctctagtactagttactgccctagcttacagcacagaactcccctggtctccaaccattcatggctccctagtgctccaagataaagttcccttgtctcagccgggcgcggtggctcatgcctgtaatcccagcacttttgggaggccgaggtgggcggatcatgaggtcaggagatggagaccatcctggctaacatagtgaaaccccgtctctactaaaaatacaaaaaattagccaggcgtggtggtgggcgcctgtagtcccagctactcgggaggctgaggcaggagaatggcgtgaacccgggaggtggagcttgcagtgagctgagatcgcaccactgcactccagcctgggcaacagagcaagactccatctcaaaaaaaaaaaaaaaagaagttcccttgcctcagcatggcattcaagacatgcaaggattgccaaacatgcccctcgtgtgatattgcccatttatccagaacccccacctcaggcagagcctgctctggtatggtgccccttctccctcattcccgtgttgacagcccctcaggggtggagcctgaggggtctcgcctatcagacatgttccccttcccatgcccttttctgcctctgcatccagcctgtctaaccccagggcagcagaaagtcctcccagtgcgaccacgcattgctgttgctcctagggaaagtatcttgccctctctgaactgtgggggcctcccttgaaaagcaggagatggaggctgtatgatttgctgcctttgagcccccaggggttcagccctaatgcatctgaagggacagggttggggggatggagaggagggtgctgggagtgggtccaaggaggcagtgggcaggtggctgggagttaccttctgcccaacattcacctagctggacacaaacatcctgagtgacccggtcagctccaggcaggagtcactgccagcagaggcctgggatctggactttgcctgctgacaggtggagcccaggccggccagaggaagtgcctctgaccttgtctcctagcagccacgggccatgtggacatgccttttgaccctgggcactgacagtgtgtgacagcctgcaccatgtgctccacaggggcggctgtgtgtgtcgggggtgaggtggggaaagccttaactggctcaggggtgagaggtcagggagccattgagactggctccaggtgtgggtcccctgctgggttggggcttgtgggaggtgggacggggctgggggtccatccccctagggggaatttgtggcctaccccgaaccctgtttgagctcctttcctaactgactccccatccctgcacctgtctcccagcaggccttgcctctgcatgctgcccctgccaggctctggggtccctgtgctccctgcagctagaaggctgggatcaggggtcttaacgagcagccctactgtatgaccttggacaagtccaagaaccttcaggttcttaacaatgtaaagggaacagtactaaaagcagcttcttggaattgtggggatccgatgagtgaaggcttaagcagtgcatggcacatagtaggccctgaaccaatgccagttagtgttattattatcaccatttagccagatgcagtggctcacgcctataatcttattgactttagaggctgaggttggaggattgcttgagaccaggagttcaagaccagcctgggcaacatagcaaggccctgtttgttttagagaaaacaaacaaatcaccatttagagcacctaaccagtacctggcacgcgataggtttagctcaacaaatgttagcagcaattacccaaggagcctgtgctggaagtttctaggatgtaccaggctatggttccaagttctgagcatctaccatgtggtggtctggagttggtgagagacaggatggggctgactaggccagtggggagcaccccccgccatggggaacaagcaccctatccttggcttccatggaagataattgatgctgggcacagtggctcacgcctgtaatcccagcactttgggaggctgaggcagggggatcgcttgagtctgggagttcaagaccagcctgggcaacattgtgagacccaaactaaaaaaattagcttggcatggtggagtgtgcctgtcgtcccagctactcaggaggctgaggctaaagctggaggattgcttgagcccaggaggttgaggctgcagtgagccatgatcataccactacactccagcctgggcaacatagtgaggccctgtctcaaaacaaacaaacaaaaagaacctgctgaggaagcagtgtttctggctgggggaggacgggcagagtggccatctggccacagatggcggtttctgtgcaaaacacatcaaggcagccttggaaatgtgagtgaaagcaccttcaaagttctggtcacagccttgggactaagcaaagccaccaaaagtacataaaagacaatgaccatcacccagtgccggtgatgctagaaggaaagggaatacgttgtagggaaggttgtaaagggctttatcttttccagactggagcctggcagctcgaaaacatcttgctgccttcatatgagctttaaaacaagctgcagagaaacaactcaagagggagaaatatatatatatatgtgtgtgtgtgtgtatgtgtgagtgtgtgtgtgtgtgtgtatacatatatatatatatatatatatatatatatttttttttttttttaagatggagtctcgttctgtcaccaggctggagtgcagtggtacaatctcggctcactgcaacctccgcctcctgggttcaaatgattctcctgcgtcagcctcccaagcagctgggactataggcacataccaccacgcccagctaatttttgtatttttagtagaggctggatttcaccatgttagccaggatggttttgatctcctgacctcgtgatctgcctgccttagcctcccaaagtgttgggattacaggcgtgagccagtttgtttttagagacggggtcttgctctgtcacccaggctggaataccatggcacaatcacagctcgctgcaatgttgaactcccgggttcaagggatcctcccacctcagcctccagagtaatggagactacaggctcatgccaccatgcccagctatttttaaaactttgtagagatggggccttgctacattgcccaggctggtcttgaactcctgggctcaagtgatctgcctgcctttgcctcccaaagtgctgttattacaggtgtgagcccctgcgcctaaccttagcactgccattttgactgaaaacaggtgcccagcagcaggggctactcccagaattgccactgcatcaggcccgtgggttgttttcagctgccagtgataagtatgtgccctgggccacctctcggacaaggtgtctgaattggtgccgaccagcatcacatgtaattgccatctcgcaggtgctgctgagggtaattccgcacacctgtagctccgggaagagcctagtggggaggaggaaacgtggctctgaggtttatagggtcagacggtcagtatgttgggagctggcgtgtggaggggcacagacaagggaagaatgggaggtggcatcagagcaagttttgatggaggaataggaattcaccaggtggaaagggcattcctggtggagggaacagcctggccttcaatagcttgtggtgttcagaaagcaggcagggaaagggaggcccagggagacaccagttaggggatgggggtggaggcagacgagggtggaggaagccatggctggagtctgcacggcctctgactggggtccctgctgtggtcagccctgtgctgggtgaggctggggtcacagctggttcaggccctgacaggaggggcccccagctgaggcccagcctctaatttggcagggcaggtggataggtctgggggggtggtggttaggaagcctccaggaggaggcagtgccggagctgagccttaaagagcttcgtgttgtcctctctgtccttgcactctgcacacactcactgaactgcgacaaatgaggatagctggtcagggcagaggcaggccggagttggggctcactgctgtcccccacaggctggggctgaagggcaggctctggggccgcagaatggggtttgtgtaccagattcttcatatggcagctgtgggactttgggcacgaggcctccgtctgagccttagtttcctcaagaggacctgcgcccaggtgcacctggggctccagccatgggtgcgtcccattccgggaagagctggcacacacttgtgcccccggggcagccatgagtgcacaaagggcagcctgtgccactgctggatacacgaccagctgagaacacgaggaccgccgactccagttaggaggatcaaggaagtgcctggtgggagcagaacagcaggtggggtgcagcccagctccctggagggatggtgggcacccatcctcaccctgctgcctccattagcaggccgagagggtgtgctctggaatcccatgagcacctgtgccacatcctcccctgtggctgacccttcttcacagttggtgcagctttgtggtctgtagtgcagggatcaattggcaaatccctttcccacccattccctggagaattggggtccttggctcagatgacagaccaacctgagttggaatcccagctccttggtggccgtcctggcctccaccccctcactgcctccgctcctcctatcctgcccacgcccactgcagggcctttgcacacactgtttcttctgccctcccttccggcccactccctcatatcattcagtcctcctttcagatgtcacctcctaagatgggctgccctgaccacctcatctataatggccccagtgcctggcacaggattggcacacagtagatattgtcagagatggatctgggttctgtggacaaggctgtgggggcaggtgaagagctccctcttccaggaggttgtttggggttcgaggccttgtttgggttgtaggcttctgtgctggtcagcgttgggccctacaagcgcatgccatgaggcctgcccaggatttccctcatggcctcacagaatacatcggccagagtcattaaagggcgcctgcatctgccttcagagagaggtttgaaggtagaactggggagggatgccaggtgggggttcaggtttcctgttgggtcctgatagaatcagggcaggagaggaagaagaagagggaagaggaggaacccaggcttggggaggggtggcagggcttcacaagcctggggaaggtgaactagggagcagttggggccaccatggcccagagtctatgcctcctcttccttcctgtgttcagagtgtgtgtgggaaccacaagggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtgcctcagctgccttactctagactggccccgttaactccccttaaaaaaaaaaaaaaaaagactcagtcgaatggtaatggagctccaacgtgaatactgcaagtatcaggcaactcactacctgactttccagttctaaaccattctaattgctgtagagagaactaacctttgttgagactgttgagtgatggatgttttacacacttgctttcccagaattcccacctctggagatcgtaggtgtgggagctcagagggtggggagtggactgtccccatcacacagcaagggaggggctaaaggaagagcagggcctggcatgcagccccagatagcccacttgggtgtgtctctgagggaggctgcagggctggctctagagtttcctttttcagtcttaacctggtgaccagcttccacagaaattggcacggtgactcatgcctgtaatcgcaacacattgggaggccgaggtgggaggatcacctgaggtcaggagttcgagaccagcctggccaacgtggtgaaaccctgtctctactaaaaatacaaaaattacatttcattacaggtgtggtggcgcacacctgtaatcccagctactcaggaggctgaggcaggagagtcacttgaacccgggaggtagaggttgcagtgagctgagatcgcgtcactgcactccagcctgggtgacagagccagactctgtctcaaaaaaaaaaaaaaaaaaaaagaaattggccagtagatcagccccaggggagagtgagccagggtttggccaggccttgagtttcagaggctggccatggccagtggcacccaggcccttcccccttcctcggggcatcttagcttagtctgtgccctctgcccaagggccagccctctgttcccaggtcacaccccctcctcttggaaggccccccccgccccacccccatcagagtctttaatgactctgctgcccctggggctcagagagcaaccgccctctcccatcgcgcttcctcagtgggatgggagggggttagagcaggaagatgagacaaataaagacacaataagaggcaggagtatgtggtaaagccaagatgggtaaggggaggggacaggcttgactgttcacagtggccctggccctgctgtctcaggctagtatctgcttgttggtctcaccacattctaggctcagaaactggggagcaaagtaatgaaagaaccaggctgggaggccatggggaactcatgcctggagttcagctctcagtgtgcttttgggtcaaggacgcttccctgtcttaagtcactcatgtcagagcctttgccaagagcaatgctgtgttttgttttgggggtgagggaacacccgcgggctgaggggagggttgggccatgctagagaggccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgggtctgcccagggttcaggcaccctcccaggttgcagccaactggggtgtggaccaggcagaggcgctggcctgcagtttggggcagaggcaggctttgctggtggtctacttggctgcaaaatcatctggccaggctctgatcactttgtgtgtgtgtgtgtgtgtaacttttacctttgacaaaagagggaagacaggcccaggcacctcctcaaaagaaccctagagcctgtcaccccttccttacccatcttctgtcctagggactgcagcccttcctggcttcccagggccctacaatgaatagtgggtcgggactcacttggtgactgctgggttgtgaggccttgagggggaggggcagacttcacccatctggcagagggacatcggtgctggcagtcaggaaacccttatttccaggcctcagtttcccggaagtgacctgttttcaggagtggcctcatcccagaccatcagccccgctgtggtgaggggtggccccttcctggggctgccctagaagggggaggtccctgcacccaccgcagctgccactcggcagcccttggccttaattaaacgcttcttgcgtactaagtgctgcacccatattatctcccttctaccattcgacgccagggagataatgactgtcctgttttctggaggagtaaacggagggttggagcggttaaggctcgctcagggtgccagcgaaccagtgatttcgaacacagagttctggtgtgttgggccaggacttatctgctttgaccctttaacgaagggggcgggagctgagggccagtgaccgccagtaaccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcaccgcagcgctcaacggcttcaaaaatccgccgcgccttgacaggtgaagtcggcgcggggaggggtagggccaacggcctggacgccccaagggcgggcgcagatcgcggagccatggattgcactttcgaaggtatttttggaggcctccccaccagccctttatacaatgcctccgtctcctgcaggttctcctggggtgggcgggcatgcgggctacgcaacttgagcaggaaagagccccttcccgagggagaaggtgtgacagttaccagctcgctggggaagtggagggctacctccaaccaaattagtgccccctgcaactcaagggggaagggtttgcttagagacccaaaagcagcatcccgacctaagagggtttggagggagagggtggtcttctctacattctctgcacccgctttgggacaggaccaggaggaagcagggaggagggcccgttgtccctctgccacagcgtctgccctattcggcacccctgcctattgtgggcatcttagacttttcaggaagacagtgggagccctagattgtcaaaattgtcagtttttctttcaggcctcagtttcccccatctatcgaagaggctcacacggactggggtaaagggatgggaaaccctgcagttgaaagtccattatgacttgatgacttgtgacctggggggtccacaaaccaggagagtttctacttgagaagccaggaagactggggctgccaccccatcctgttctgccaactgctctaggaaattcccctcctgcagtagcttccctgcctgggtacctgtcagtaggcaatgttgggtctccactcggtgccagctgcctgccaagcaaagcctcgggcagccgtaccaaaaggggtttagtcttttctgttgtacagatgaggaaactggggccagtgagaggaggctgttggtccaggctccacttcaagctggtggtgggcagggctgggagctcaggctggggatcctgagagcactggaggcccccatgggtcctgtagagcattctgacccagtgggtgccaccacgagtgggttagagggccctgggctgagccagataggctgctagtcaccagctgggggagagggcccttggccaggtggggctgaggtgggagtgtgtcccagtctgtatgaggaggaaggagtcaggacagacagcacttgcttttacagagatgaaatcaaagccctgagtggccaggcctgggtcttgaggctacttggctgcaggcaaagcctggacttgagcccagaactctacacagagacacactggttggccatgtggccagcagctggcttggccctaagccttggtctgttccactgagtaatgggttggtgatggcagcctggctcttggcttcttagtggggcaagaaaaggcagagagacaatagatttgggattttgtagacctgggtttgaaccccactgcatgctcttgggctgcttgtggtcctccctgagcctcagtgtcttttcttgtctccaagatgaggtgagctaatcttttgaggtagtctagggtagtggccagtggttggggcattggagtcaaaatagggtctggactcagttgagtctctgactctataagaacttaggccagtaagtcacctctctacagctcagtttcttcacgtgtagaatggggccaatgatcacatcaccctctcagctgtgggtgaggattaggggtctagcctggccccatcaatgtgggtagccccacagcgggcctggcttttggaccagacccacccttctgacatgggcccccacccttagagtccttctagtgtggatgaggaccctgctctgatctggggtcctcttgggggacttccctgtctgccattctctttggggatcctgcgctgccctaggaagagtgggcccaggctgcacagttggtccttggtcacagaggatcccaccacttcttcagggcctcaaggcaatcctgcctctctctgcacccctcttccccctgtaaactgaggggaggggaaaatcacccactcctcagcagtttctaagttgctttgtcaaattcagtgcccagaggatcctgctgggggtgcgttttaggatgagaccaggagtggccaatggtggggtgtggggcctatcgctcctatatgaagaccccctctgccctagactgctcctccctccccatccccatctccatcccaaagactggagctgctggatctgtggatggaggcgtgccccccgtttcacacattgagaaacaggccccaagtggagccagggaaggctgcacctgggcctctggattccttttgttctgtgtggggttgggggtgatggactgtggagagggcaggagagctgtctggaagggttggtcacctcatgggcaaatgcttggaagctggtctgagtccacggtgcagtgtgtatgtgtgtgtgtgtgtgtgtgtgtgtgatgtgtgtggactcagaggtggatgtcttgtagaatgcatgccccatgaagacaggagtaaaagtttaccaccatccacatcaagctacaggacactcccagctccccagaaagttgcttagttctaggcagggatttcccttattcacagccgggagcagtgcctggcatagtgtgggcactcagcactcagcacatgctcactggatgagtgaatgaatgtgagcctgctgtttgctgtggactaaggatgtttctagatgtttgggcaaataccggatggtgggaagagctcaggctctgaagtctgcagtcttgggcccgaccctgggctcagccccagcctagctgtggggcaagattgtgagccttgtggtgcccaccttgtccaggtattgtgatgcactcgcagcagcaggcattgctttagacagcacaggtgctcgcaaaatggctgtatgtccgggaacaccagctcctgtgggtggctttctgtcctggtggcattgcccacacatacagctgtgtgccaacaagggttgtgcaaataaggttgtgtttggatgtgtgtgatgccctgtttgggggtcagtctctgcctcactcacgcaccctcttctccttttcacagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggtaagggggatgtgtggcgggaggggacacccggggtggggcttccaggagcacaggaagaagcttctgctgtgatgtgagtagaggtctgtgcaggctttagaaactggggctccactcggctgcttgagatgccctgttactagcagtcctggtgtgcttgttgccggggtaggcgcaacctcgcactggaggcctggcttgaagccagtgcatttgcatcagagcccaggcagggactgtccataggaagccacatggggcaatgactcatccaaggccagtcggtgatagagacctgaagagcaggttgaaagtgggagagggaggtctgtgtctgcagccccatgctttatttctgcaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtgagggggtctggccaggggttggggagggggcagccccagcccagacacacagcttacagccaagcctctcccaccctcaggtcctgctgcagccccacttcatcaaggcagactcgctgcttctgacagccatgaagacagacggagccactgtgaaggcggcaggtctcagtcccctggtctctggcaccactgtgcagacagggcctttgccggtgggtgacgtgggcagggcataagggagtggggtctacacacacacacacatgcccacctggtaacatgtgcctggccctgcagaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaaggtgtggagaggcctgcaggggcacagaccggggtgtccctaggaaggaacagatcaggggcaactggaaggaagagagggagtgagactgagcctggacaagcagggaattggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccgacctgacaggccacctgtgcgctccccctccctcccacaccgtgcagctgaataaatctgctgtcttgcgcaaggccatcgactacattcgctttctgcaacacagcaaccagaaactcaagcaggagaacctaagtctgcgcactgctgtccacaaaagcagtgagtcctggctttattgagctccagtctggcctcttctctagccttgctccacctcccggccccaccccatccctagccccaccccacccttggttctggcccaccctctgccctgcccacctcacccttggctgtagccctgcattcagctctagtcccttggttacctctggtcctgaaagagacctggtgcctccctttggccctaacccagccccatcaaagcgtcctgggctagctttaggagctacagtagtccctaggcctccaagggcctaggctctgatttggggtcacatatccagcctttactcctggctctgttcctttcggcccacagaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggtgggcagaatcctgaccccccccttcccagccccatgctctctggggtccctccgattctgccctcaccaccctgcccaaccccaccaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagaggtgggaccggccagcctgggcatctttgggagggacactcggggtgagcccccaggcttgtgaacttggggctctggatttcctgggagctgtgtccccagctttccctctgtccatagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccgggtaaggggctggccccggcagagtgggcagggcagggaccccaggctgtgaaggtgctgggtgtcaacccttgttcctgctccctgtgcacaccatgaatctgtcccgtcctccctgtgcctagccacgcatccgcagacccccaccacccctccagagcctgctgtggacggctcttctgagctttggggcagctgctctgacctcacttttctcacctggaaaaccctcatccacagggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatgggtaggactgagcgtggggcgggctccgaggtgctccctgctgcctgtgctccacccacagcctcatgcctgcttgccttccagggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacagtgagtgggttggggggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctctctccagaggctccctgggtaagagctacacgggatgtggcagtggttaccagggggactccaggccaagctgggactcggcccggggtctggccccaggctgtgtccactgtgacagcccagtaccctcccctacagcgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccaggtgctctcttaccccttccctgtcccctctcctgtccctcatcctcattcctgtcctgtcccttgtcgcctgaatctctggctgtctctggccaccccagtccttctccctgccatgggttgttgctgtgggggttgcaggaagggaaaggcctgggtgcctctcgttcccattggggctttcagaagcacatgcagggattgatgggcagatggctaattggagaagtgaccccaggcagtgccgctgtggagtaaggaagcggagccaacaatggcatcttctcaagtcggttttcctttggaagcagtgtagggcaggcctcagtgttgtctcctggccaaggctggtgctggtgatagttatgtccacccgctttcccctgtccttggcaggggctgcacccaggggcatgccggcacttcccagtggccctaggtgtggccccagcccacccaggaaaaagcccttagcttggagaggagggtggggccctgctccccaccccactcacctcctcctctccacagtggaccccctggcccaggtgactcagctattccgggaacatctcttagagcgagcactgaactgtgtgacccagcccaaccccagccctgggtcagctgatggggacaagtaagtgtcgttgtgccctcctccaggcaaggcccctccggcgggattctgagaatagctctggcctcaaccctgtggagagagcccagagctgggctaccgtgcgtgccatgcacgcttcattcctctctgagtttcctctccccaccagcctgtgggaggagacagtggcactttgcagagccaggggccaggctgtactctggagggcaggtggggagcaccctcctaggacccctgccatctgttccgacagccagctctctccttccacagggaattctcggatgccctcgggtacctgcagctgctgaacagctgttctgatgctgcgggggctcctgcctacagcttctccatcagttccagcatggccaccaccaccggtgagtccccggcccctgtcctggctcccttctcagctcccccgtgcagcgtgactgagggttcaggggaccctccctcttctgcaggcgtagacccggtggccaagtggtgggcctctctgacagctgtggtgatccactggctgcggcgggatgaggaggcggctgagcggctgtgcccgctggtggagcacctgccccgggtgctgcaggagtctgagtgagtgcacggcaggttcctcctgcctggtcccgggctcagccttcctcatcccctgggcactgtgcctcactcagcctttgttctgtgcaggaggagtcaccaccttttttcctcagggaactcgagccagggaagtggggggcactcagccagggcttgtggactggtctgactggcactcttctgccctggtcccaacaggagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggtgaggggtggggtcaggggcctggcagggctgggggattcagctttccattccctggttcctctccccagcccccaggggctgcagaagaccatggggttagcccaagcagcacaggatagggggtccagcagaccctgctttttggctaaggcttctgtccagaggagaggggttgcccctatctggcctcagtttccccatccctgggaggaggggggtggatggtgtggtaggatccctttggaggccctgcatcaggagggctggacagctgctcccgggccggtggcgggtgtgggggccgagagaggcgggcggccccgcggtgcattgctgttgcattgcacgtgtgtgaggcgggtgcagtgcctcggcagtgcagcccggagccggcccctggcaccacgggcccccatcctgcccctcccagagctggagccctggtgacccctgccctgcctgccacccccaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgagtgcccgatggccctgtcctcaagacggggagtcaggcagtggtggagatggagagccctgagcctccactctcctggcccccaggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagttgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtgggcagggctcccgcgggggcgtggccagcttgagacccatccctgacacatcctcgtgtgcgcaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgcccccccccccagcccctcccttcattcccattccccaacctaaagcctggcccggctcccagctgaatctggtcggaatccacgggctgcagattttccaaaacaatcgttgtatctttattgacttttttttttttttttttctgaatgcaatgactgttttttactcttaaggaaaataaacatcttttagaaacagctcgatacacacaatcttcagtgtgaagcaatatactaataagaacactagtcgtcttaacatttacagtcttcatatatattatatatatgtatatgtatacatatatatacactatataacgaggccagatataatacacacgtttaccattttacagtcatatgtacaggaagttgctagggcggccctgggctgggggctgcgtcaggcctatcgaagcgtggacagagctgaggacacggacggacaggcggacggactggcagggactggcccgggccggtggtggctgcgtggacaagtggcgtcgcggtagccccttacccggcaaaggcccggttggggctctgttgcgggcgcacgacgcacggcggcgacacacgggagaagcgagcatgttcccaacatatatacattctatgtaacatatatatagaggggtacacaggttttgtacacgaaatctagcgctgtccctgctcccgtgcagagtaggcgcggcggtccctggtggtgcacaacggtcgcgcgtccgccggagccggaggtgcgttctggccgcttcttgggttttgcgctcccaggctgggctccaggggtggggtggaggactggaaaggggacaaacagaggccaaagggtgtcccagtcccgcccacactcggggatcccgcaacccctaactgagcatagcccaggtctaccccggctttgcccgaaccgcacgagagatctggcaaaggctgggcgggaaggcccctggacgcgttccgcacggtttgttccaaaggctccggcctctccagtgccggcctagcccgctctcagaaaggcttcctttctcccccgcctagtccacggagctaggagccgccctccgcctcttccagtactgtttcgacccccacccccaagcccagggctcccagctgcacgccacgaccgactggggtggcggcagcacccacgtggaatgtgtgccacgtcgtcttgagattccagagggaaagtgtccccaggacaaagccgtctcccaccctcgccggaggctgagcgccccggggagtctggccgctccgcgggctccccctccgcaagcctggcccctggggtgggcaagaacgccctgtgccgtccggttccgggagcaggcggctccggaacgggttttcctcccaacccggggccgcaagtctgagccctaggcggccggatccacgatccgggacccggatcaaggatcggctctggaccagcgctgggagcag

SEQ ID NO: 15717 - DNA, 48318 bp, Human
gcggggaacttgtggtgcttttccccaggcctgctcatggccacctatggccgcccatggaccaatcagcactcacttcttcccctctgaggtccataaaaaaccctggactcagccagactcaaagagaggacgggtagatggggagaaaaccagctgcagagaggaactaccctttctgctgagagctggacacttgttgggatgaactgcctaccagagaggagctaccctctctgctgaaagctgaacacttgtggggaaaccctggctatggagaggagctgcccactgcaggtctcttctgaagtattctgttgctcaataaagctcctcttcgtcttgctcactctccacttgtctgcctaccccattcttcctggatgcaggacaagaactcgggacctgccaaatggtggggctaaaagagctgtaacacaggctgggtgcagtggctcacgcctttaatcccagcactttgggaggccgaggggggtggggcggatcacctgaggtcaggagtttgaggccagcctggccaacatggtgaaaccctgtctctactaaaaatacaaaaatcggccgggtgcggtggctcacacctgtaaccccggcactttgggaggccgaggcgggcagatcacaaggtcaggagttggagatcagcctggctaacatagtgaaaccctgtctctactaaaaatgcaaaaaagctgggtgtggtggtgggcgcctgtaatcccagccacttgggaggctgaggcaggggaatcgcttgaacctgggaggtggaggttgcagtgagccgagatcctgccactgcactccagcctgggcaacaagagcaagactccctatcaagaaaaaaaaaaaaaaaagggagagaatgtggtacatatataccatagaatacttcacagtcataaaaaaagaataagatcatgtcttttgcagccatatggatggagctggagacaattatcctaagcaaacacaggaacagaaaattaaatacctcatgctctcacttaaaagcgggaactaaacattaagtaaacatggacgtaatgatggggacaacagacacggtgacctacttgagggtggagagtgggaggagggtgaggatggaaaaactacctatcaggaactacgcttattacctgggtaataataatctgtacactaaacccccaagacagtcaatttatataacaaatctgcacatgtatccctgtacttaaaagttgaaaagaggccgggcgcggtggctcacgcctgtaatcccagcactttgggaggctgaggtgggaggatcgtttgagcccaacataggaagactcctgtctcaaaaaaaaaaaaaaaaaaaaaaaaattaccagggtgtggtggcaggcccctgtggtcccagctactcaggaggcagaagcaggacgatcccttgggcccagaaactcaaggctgcagggaaccgagatcatgccactgcttccaccctgggtaacagagcaagaccccgtctccaaaaaaaaaaaaaaaaaaaagcaatacaggggtacttaatatttattcatatatttacctgagaatcatcagttttactaaggctgtatgatgttagcagatattggttctatcagtctctccgcagacatttgctgtaaataaagcagagaggctttcagagtgcaccctgtttttgttcctccatcctgttgtctggatccccttctaaaacgtaagttccaggatggcaggaactttgtctatttggttcacactcgacacagttagtgctcaaaaatgtctaacgacacaggcctgcttctcggtttgcactgctcctccatggtagtctgtgcagtgggagaaggcagcccgggcccagggtccacggagaagacgcaaatcgacagcgcgggagcgcggaccttctggaggcgcgcggcgcttaccgctgtccgtcctcgaagccccgccccggggctccgcctccgccggcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgtgagcgtccccgccccgccccgcgccgggcctccttctcgccccgagccccagacaccgcccctgcgccggtgaccttggacggtcagcgccccagcctcggggtggccctctgatagaatagggtctgggggggactaggggccacagcgcaccgggaagatgcggccccgcgctcaggatctgttggctgccatccaaggtttctgaaaatgcgggagagtacaaagtgttaatatacctaactctgcatttaaagctgacttcaaaatttgtggcatatttggcctcaagtcgtttgttaaatttttagaaaaataaacgttataagttgtcctctttcaccccgaccgcagtcacattcccacttctttgtccccaggactttgatgggtgtctttacccatcttttttactgttgtccatgaaagcatagcttccaggggtatttgaggcccagagaggttgtgtgactttctgggggtcacacagtgagtcagtggtccaggtgaggtgggatccacctcatgtcttatccccttgcagagctggccttgctgaacacctgagctcaacccctaccatccgactcccgaggtgttctgtccaggatggatagaggggaaagatccaaggagggacgtttacacacagatcttggttggtaaatttgaagtattttgcaaaaggaacaggggattttggtatgcacaaaattaaagaggctgagtgttttttggcatcccttgattggccacctagggttgctgctggagggtttgataaagaggagaaggaagttacaagagcccgttttttagccacaagttcactgcatcctctcttttgttgggtagatattattatctctgttttccagatgaggaaacttgccccaagtcacatgctgctcaggggctcagtcaggactcaaacccaagtctgtctgcctcccaagcacagttagtgctccccactccacagtcctgttctctgtactactgtctctaacaagtgacatttcttctgacatcagaaagatgcctcatcagtaatgtggtttgttgagggacaggtgttaaaaaaggaaaccaagtaccgtttgtctccatcaacaccaggcacttcagaaggtgactttcacagagcccagtgtgctgagctcttctacagcggatgcctaatgataaactttaaactggagaaaatgccctggtactttctgcagcctcaggaataggctccagtgtgtggcgagtgttcatttataggcagcgctcggcatggggagtctggacaccatatatccgcccgggagtgtattaacgtggaaaccaagcccacccccaactccgaaaagtgcagcagcttttccagttctttgtgcaaatatgtaggctctgtacgtgtggggttactggtttccaagcacaaggcaaaggcacggggcagtaaggagggtgccttgggagtaatctgctggcttccactacttcccttcctgaggcacggcttgctgctgtggacatccctgggcctaccccaagctggcccagtatctgtggttaaaacaaccgcccccccccccccgcccccacacacgtggctccttatgtgtatgtaggcatttctacttttcaaaattctgctctgtctgtattccctttggtcttcacagtaccctatgtgggatgtgaggatcaaatgtgtttcagtaataagcacgcatttgcctagtccctgtggttcctgagagtgttgctggtatgctgtcagggcatcctccggccgtccatgtgacagggtggctgtctttctgtagtgtgcagaacagctggtagaggcacttcctgtactgcacacgtgggatttaggctcctgctcataggctgagatgtgtctcccctctggttgtcactttccccttgcctgaccctagaaaaggtgctgcattctggccctgcagcagaacaggggaaggagaaaggcagcgggggttggggagtggggaggagagggttggtgttgggggttcttctcccagctcagctgctgttttgctgtgtgacatcaggtggatctcttccccgttctgagcctcagttttctgacatgtaaaatgagggtctgcatttttgctttgcaactctaaaagcagcagaatcctttttttaaaaatgtacttattggcacctcaacatataaaaccgataaaagcagagctcttctggttaatgtggggaggatcctcgagctccctgaattgtccttttaccctgtctccccctcccccttgtccctcatggcaccttaaagatctctgagtccctccagttctcaagtttaaggactctactaccatggtaagagctggtccagcctcagtttccacaatgcttttggccactcgaatccagcctaacaagcacgcagttcctgatgattggcctcaggtcccagagagctccagcaggtgtaggagtccatgggcctgacacctttgctggtctctgctggatcccgacgaagtcaggtcctttctggaaaggggttcgaagtccacatactctccgcactacccccaggaagtacgtccttgggtgtgtgtttgggggagtgagaggaatgaagaaccactccccctatagcctggccatactccccaagatgagggcagtaaggtgctgaggaccctggaagtaacttgcttttctcaacttctcaggagaaggccatcagcatttgggagtcaaagaatttcttttttgaacttgagcctctgccaggggccgtggaagctgtcaaggagatggccagcctacaaaagtaagtttgtcctcccagccactcagtaagtttgtctgagcagccactgagccctgtacctccttcctgcttcttccctcctctgccttctcctttctctctccttggccctgcgcaaggctgcacttgcctcgtcattgctgagcctggggaaaaccaccaaatacaatgatctcggtttgtaggctgtgatgttttgatccaggaacttgaggaaatacccagtttaatttgatctggttccctgggtgttcaaagctcatttattcaatgcccggacgtggtggctcatgcctgtaatcccagcactttgggaggctgaggcgggcggatcacgtgaggtcgggagtttgagaccagcctgaccaacatggagaaaccccatctctactaaaaataaaaaagttagctgggcatggtggcacatgcctgtaatcccagctactcaggaggctgaggcaggagaaacgcttgaacccgggaggtggaggttgtggtgagctgagatcgcgccattgcactccagcctgggcaagaagagcgaaactccatctcaaagctcatttattcagcaaatatctcagaactgactgtgctagatactgcaggccgcagtgtttcagcaatgagcaaagtatagtccttgccctcatggagcttctagtccagacagagcagacattaaagaatcacaaaatggccgggcacggtggctcacgcctgtaatcccagcactttgagaggccgaggcaggtggatcacctgaggtcaggagttcgagaccagcctggccaagatgatgaaaccttatctcagccgggcgcggtggctcacgcctgtaatcctagcactttgggaggctgaggcaggtggattgcctgaggtcaggagttcgagaccagcctggccaacatgatgaaaccctgcctcagccaggtacggtggttcacgcctgtaatcctagcactttgggaggctgaggcaggtggattgcctgaactcaggagtttgagaccagcctgcgtagcatggtgaaaccccgtctctactaaaatataaaaacttagctgggcgtggcggcatgcacatgtagtcccagttacttgggaggctgaggcaggataattgtttgaacccaggaggcggaggttgcacggtgagccaagatcgcgccactacactctagcctaggcgacagagcgagattctgcctccaaaaaaaaaaagaaaccctgtctctactaaaaatacaaacaattagctgggcgtggtggtgggcgcctgtaatcccagctacttaggaggctgaagcaggagaatagcttgagcccaggaagtggaggttgcagtgagctgagattgctccattgcactctagcctgggcaacaagattgaaactctgtctcaaaaaaagaatcacaaagtgaagacacttgcagattgtccaaagagctgaaggaaaagaggttcagcgggaaacttcatttagaaaaagtgtttaaggaaagagaagtagtattgcttgagatatttctgttttgttctggtgaaatgagtagttttatggactgaagcccccactcagtgacctgttgacaattacagaggatgtgcttccctgagagatttttaaaaacagccttattgacatataataatgacataccagctgggcgccgtggctcatgcctacaatcccagcactttgggaggtcgaggcgggcggatcaagaggtcaggagttcgagaccagcctggccaacatggtgaaaccccatctctactaaaaatacaaaaattagctgggcgtgggggcgggtgcctgtaatcccagctactcgggaggctgaggcaggagaatctcttgaacctgggaggcggaggttgcagtgagccaagattgcaccattgcactccagcctgggcaacagagtgaaactctgtctcaaaaaaaaaaagagacataccgtgcagtccacccatttgaagtatataatccagtggttttacaaaaccatccacaaagttgtgcaaccatcatcatatccgcttcagagctttttcatcatccccaaaagaaaccctgtacccatcagcagtcacccccattcctgtgctccctgccagcccctggcaaccactaatctactttctgtctttaggaatttgcctattctggggatttcatataaatggcatcatataatatgtggtcttttgggtctggcttctttcatttagcacatgttttcaaggttcattcatgttgcagcatctatcaatacttactatttttatggctgaatgatattccagccattggatatgtatggatctaatgtatggactacatgtattgatccatttatcagttgatagatgtttgggcagttttcacttttgggctattgggaatagtgctgctatgaacattcgtgtaaatatttgtttgaatcttgttttcaattctttttctttctttcttttttttttttttgagacagggtcttgccctatctcaaaaaggctggagtgcagtggcatgatgatggcttactgcagcctttaccgcctggactcaaatgatcctcctgcgtcagcctctagagtcgctgtgaccacagatgcacactactacacccagctaatttttcattttttgtagaggtaggatctacctatgttgtctaggctggtctcaaactcctaggctcaagcagttctcgtgcctcagcctccaaaagtggtgggattacagatgttttcaattcttttgagaatatacctaggaatggaattgttaggccataggataattctgtgtttgacattttgaggaactgtcaaactattttccaaagcaattgtactattgcacatttcccactagcatcatatgaaggtttcagtttctccacatctttgtcaacacttgttaatttctgttttactttagccatccttgtgggtgtgaagtgattttgtgaattttgggttgcatttctctgatggctaatgatgctcaagcatcttttttttttttttttttttgagacagagtttttgagacagagttgctgaccttgggtcagcaatggcttcttcatatgacacaaaaatgcaagtgacaaaagagaaatacacaaaaattggactacgccaaaagtaaaaacttttgtggtttttgtttttttttttgagacggagtctcactcttttgcccaggctggagtgcagtggcacaatcttggctcactgcaacctctgcctcctgggttcatgccattctcctgcctcagcctcccgagtagctgggactacaggcacccaccaccacacctggctaattttttgtatttttagtagagacggggcttcaccatgttagccaggatggtcttgatctcctgacctcgtgatccaccctcctcagcctcccaaagtgctgggattacaggcgtgagccacctcgcccggcctaacttttgtgtttctaaggacaaaattaagaaattgaaatgaaagtctacagaatgagggaatatatttataaatcatgtatctgataagagacttgtatctagaatatataaagaactcttccaagttaacaatgaaaaaaagccaggcacagtggctcatgcctgtaatctcagcagaaagccaaggcaggaggatcacttgaggccagcagttcaagaccagctggggcaacatagtgagaccctgtctctacaaaaaatacaaaaatgtagtgttatacccaaaagtaagttatcctgtgcctgaccttgtccaaaagctaacagtaaaaaaagacaaaccaattgaaaacctcaacaaaggattgaatgaacatttctttaaagaaaatttagaatgtccaataagcacataaaaagatgcttgaggccaggtgtggtggcttaggcctgtaatctcagcacttggcaggccgaggcaggcagatcacttgagctcaggaatttgagcccagtctggccaacatggggagaccctgcctccactaaaaatacaacaaaaatagccaggcatagtggtgcgtgcctgtgatcccagctacttgggaggctgaagtgggaggatcacttgaacctcaggggggtggagagagtggggggagggggagggtttgcagtgagccaagttcacaccactgcactccagcctaggtgacaagagcgagaccctgtctaaaaagaaaaagattcggctgagcacagtggctcacgcctcttatcccagcactttgggaggccaaggcaggtggatcacctgaggtcaggagttcaagatcagcctggccaacatggtgaaaccccatctctactaaaaatacaaaaaatacaaagatttgcccctgtgttttctttaagagttttagttttgggccgggcgcggtggctcacgcttgtaatcccagcactttgggaggccgaggcgggtggatcatgaggtcaggagatcgagaccatcctggctaacacggtgaaaccctgtctctactgaaaatacaaaaataattagctgggtgtggtggtgggcgcctgtagtcccagctactcaggaggctgaggcaggagaatcgcgtgaacctgggaggcggagcttgcagtgagccaagattgcgccactggactccagcctgggccgacagagtgagactctgtctcaaaaaaaaaaaaagagttttagttttagctcttccatttaggcctatgatccattttgagttaatttttgtatatggtgtgaggtagggggtcaaacttcattcttttgcatgtagatatcttgttgtcccagtttcatttattgaaaagactacttttttcccactgtattgtattcacactcttgctgagaattaattgagcatcaatataaggatttatttctagacttagataacttttattggccacatttttgcttgaatttagcaacctgaatgacaaatgtaaggtatgatttggccttcattgtgtcatataaatgcctctaaaaattgtcaacttttaaagttctaatatgataaataggtgtcagagaaacacaaaatacagagtttgagttgaatcgtagaccttatttggtagtaatttatctttggatgtgagtccaagtcctgcagagtagtgaattttattctggtttatggtatgaacttgatgtatcgtgttcctgtagcaggagtctgagaggcaaagaatatgtgtacagcattcacacttaagctttcaaaaccctgctcgtggcctggatcagcatgtgctgacctgcagccacatgactgtgtcctggggagctgcagggcacagtggtttggagtggggttctggacattggctgcccaggctcacatcctcacttccccagaatctcattcccagatgtcaggcaagttattaaactttctgggtttcagtaaaatggagataaggagaaagtcctcagtatatgtgcctggcacatagcaggtgctcagcaaatgctagctgctgctgttgccgctctgtaagatttaataggcatatcgcaagaaaggcatccttaagccaccacggtatgggaaacaatggattagattggcttcttcaccatagtacttttcagagcttttaagtgcttgtgtgctttgtgacactgcattggggtagtaagggatgcagctttcttcaaaagtattctagcggccaggcacggtggctcacacctgtaatcccagcactttgggaggccaaggtgggcagatcacctgaggtcaggagttcgaggccagcctgaacaacatggagaaaccccgtctctactaaaaatacaaacaaattagccaggcatggtggtgcatgcctgtaatcccagctactcgggaggctgaggcaggagaattgcttgcacctgggaggtggaggctgcggtgagccaagattgcgccattgtactccagcctgggcaacaagagtgaaactccatctcaaaaaaaaaaaaaaaaaatgtattctagcctgggtggggtttggtagctcatgcctgtaatcccatcactttgggagactgaggcaggagaatcacctgagctcaggagtttgagaccagcctgggcaacacagcaagctcctgtctctactaaaaaaaaataataatagtaataaaaagaagccaggcatgctgacctgtccctatagtcctagctacttgggaagctgaggcaggaggatcacttgagcccaggagttcaaggctgcagtgagctatgatcacgccatgtactcctgcctgagcaacagagcaagaccccgtctcttaaaaaaagatattctaggccgggtgctggctcacacctgtaatcccagcactttgggaggctgaggcgggcggatcacctgaggtcaggagttcgagaccggcctgaccaacatggagaaaccctgtctctactaaaaataaaaaattagctgggtgtggtgggcgtggtggggcatgcctgtaatcccagctactcaggaggctgaggcaggagaatcgcttgaacccctggaggcagaggttgtggtgagctgagattgcgccattgcactccagcctgggtaaaaagagtgaaaatctgtctcaaaaaaaacaccaaaaaccaaaaaaggtattctagcctggaacattttttcatagcttctcgattaatacctttgcagaaattcccgtttgggaatgcaaatctagaccatacccagtggtcctttatctccatttggctcttaaattggtagaagattcctatggtcagtttgtgcccagtatctagacaaagcgaagggactcgtcagtaactgagtggataactgtgtatctggtgctgaagtgggcactgagtacaagagatgtgggcccagcagcagagaccaaggctgatcagtcaccctcatgactatttatccagcatctgctgcatgctcagcctcatcccaggggctgcggggacacaaataggtaagagagttcttaccttcaaagagttccctggtaaacagacattggaacatagatctcaaagtaatcgtggcgttggggctcaggcaggcaggcaggaactgctgctccccgggaggccacgccattgtgctgccatcttgaggaatgaaaaggaacctgccaggtagtgaagggcaaggggactccaggtaggaggggaacagttgagcagacgcccaggggactctcctgagatggcctttgtggcacgtcctgccctgttccagcagctctgcgcgtgagatagggcttccctgggcagagcctcaggttctgaggagcttggtttggaatatcttcaggggtgaccattctttttattgttcgggaatatatgaatatattctttttttttttgagatggagtcttgctctgtcgtccaggctggagtgcagtggtgcgatctcggctcactacaacctccgcctcccgggttcaagtgattctcctgcctcagcctctggagtacctgggattacgggcgcccgccaccacgcccggctaattttttgtatttttagtaaagacggggtttcaccacgttggtcaggctggtgtttaactcctgacctcaggtggtccacccacctcggcttcccaaagtgctaggattacaggcgtgagccatcgtgcccggccgaatatattcttataaaagactccaatagcatgagcgtgtgtgaaaatgtgtcagttgacctctctccctgcatatacccaccttggcccactcttcttgctctagttaagaatttggtgtgtatgcttccagaccttttgaagtgcacccccctacatatttaaatatagatttacaaattgatatgctccacccagcagtcagagtgatattttttaaaccaaattcagatgatgttagccccactgaaagccctctgctggcttcatcttgtggtaaaatcccgctgtcccttggccaggctgggaaggctgtctgccatctgaccctgccttcctttccaacctctgtcttcctctgctcctgtcacgctggcttctttcctgccccttggatgtgccacacgtgtttctggtcttaggacctttgttcttgttgcatcttcctggaatgtttctgccctagttctttacacagctagattgtttttctctttcaaactgagaaccgtgcatgttgcctcctcacagaggccttccctgaccactgcagctgaggtctctgccctcccctcctggtcgttctgtcccatgaccctgagtgtgtactctaagctgaaattgcatgtctgtgtctgtcccttcctcttttgagtgtcagctccctgaggtcagggattgtcttggttctggctctattcttagttcccagaatgatgcctggcacatcacacactcaaaatatttgccaaatgaataacttcatgtgcataatcccacagtaattgttgatttaaaaaaaaatttttttttaacaattttggaggaaaccactcatttagaaggataagaacttaaacctgattttaacatggtgctcactgtcgtgaagcctagagtaagaggcagtttattcatgggttcattaaacagatacattttacgacttaatatgcacccagtactgtgctagcactggggatatatatgtaaataacacacctaaggtctccagtttcagggcaggtctcacagcagggaagatgacaacatataaactaaaatgatttccaactgtgataagcttagtgaaggaactaaacaaggggctgtgctgcagaggaaacagggaaggggctgctttgggtagaatgggaagctggctctagggagctgagaattgacatcagacctgaagagtaagaatgaatgggccagtgaagagtcgggacaggccttgcaggccaggagaggagcaggtgccaatgcctgagccgggccaggcctttgtttgtctgagtaacataaaggaactggacagctggcactggaacttaggaagcatgttgggggtggcaggggtgggtggagggtgaagttgaagagagattgatgtgatctaacttagggtttttttgttttttttttttttttttttttgagacagcctcgctccatcacccaggctagagtgcagcggtgtgatcccagctcactgcaagctccgcctcccgggttcatgctgttctgcctcagcctcccaagtagctgggactacaggcatctgccaccacgcccggctaatttttttttgtattttttagtagagatggcgtttcactgtgttagccagaatggtctcgatctcctgaccttgtgatcagcccgccttggcctcccaaagtgctgggattacaggcatgagccaccatgcccggccttttttttttttttaaatgagacagaatctcactctgtcccccaggctgtagtgtagtggtgccatcttggctccctactacaacctgtatctcccgggtaaaagcaattatcctgtttcagcctcccaagtagctgggactacaggtgttcgccaacatgcctggctaatttctgtgtttttagtgaagacaggttttcaccatgttggccaggctggtcttaacctcttaaccgcttgacttcctgacaccttggcctcccaaagtgctggaattacatgcgtgagccaccgtgcccagctgtaacttaggtttttatttatttatttatttattcgagacagagtttcactcttgtcatccaggctggagtgcaatggcatgatcttggctcgctgcaacctttgcctcccgggttcaagtgattctcctgcctcagcctcctgagtagctgggattacaggcgcccgccaccacacctggctaatttttgtatttttattagagatggggtttcaccatgttggccaggctggtctggaactcctaaccttgggtgatcagccctcctcggcctcccgaagtgctgggattacagaagtgagccaccgtgcccagccataacttagggttttgttttttgttttgttttgttttgttttgtttttgtttttttttgagatggagtctcgctctgttgcccaggctggaatgcagtggcgcaatctcagctcactgcaacctctgcctcccgggttaagcgattctcctgcctcagcctccagagtagctgggactatcggcacatgctaccacgcctggctaattttttgtatttttagtagagacagcatttcaccctgttagcctggatggtctcgatctcctgacctcatgatccacccgcctcggcctcccaaagtgctgggattacaggcatgagccaccgtgcctggccataacttaggttttttgttttttgtttttgtttttgtttttgttttttttttttgagacagagtctcgctctgtcgcccaggctggagtgctgtggcatgatctcggctcactgcaagctctgcctcctgggttcatgccattctcctgcctcagcctcccgagtagctgagactacaggtgcctgccaccatgccccgctaattttttgtatttttagtagagacagggtttcaccgtattagccaggttagtctcgatctcctgacctggtgatctgcccacctcggcctcccaaagtgctgggattacaggcgtgagccactgctcccggccaatttaggtttttaaaatgtggatttggggcaatgaatttggatagacatttttccaatgaagatatacagatggccagtaactacctgaaaacatcatcagtcattagggaaatgcaagtcaaaaccacaaggaggagctgggtgagtggcgctcacctgtgctcccagctactcagaaggctgagaagggcaacagaaggccggaaggccagcctgggcaacatagagtgagacagtctctaaaaaaaccacaattcacattgtgggtgtgaatataaaacagtgcagccagtgtggaaaaacaccttgaaaaacatttcctccaaatgttaggccgggcatggtggctcacgcctgttatcccagcactttggaaggccatggagggcgaatcacctgaggtcaagagtttgagaccagcctggccaacatgatgaaatcctgtctactaaaaatacaaaaattagctaggcatggtggcaggcacctgtaatcccagctcttgggagactgaggcaggagaatcgcttgaacccaggaggtggaggttgcagtgagctgagatcatgccactggactccagcctaggtgacagagtgagactccatgatcaaaaaaaaaaaaaaaaaaaaagttagacatagactcactgtgagccagcaattcaactcataggtgtatatccacggaattgaaaacaggtattcaaacaaatactagtacccgaatgtcccagcaacactattcacagcaaccccaagtatccactaagtgatggatggatatttaaaatgtgacgtagccacacaatggaatatgtttcagctataaaaaggaatgactgccgggcatggtggctcatgcctgtaatcccagcactttgggaggctgagggggacagattgcctgagctcaggagtttgaaaccagccagtgccacacggcgaaaccccgtctctactaaaaatacaaaaagaattagccaggcttggtggcaggcacctgtaatcccagctacttgggaggctgacccaggagaatcacttgaactggggaaacgggaggttgcagtgagtctagatcgtgccactgaactccagcctgggtaacaaagcgagactctgtctcaaaaaaaaaaaaaaaaaaaaaaagtctgggcgcagtggctcaagtgtgtaatcccagcactttgggaggctgaggcgggcggatcatctgaggtccggagtttgagaccagccttaccaacatggagaaactctgtctctactaaaaatacaaaattagctggacgtggtggcacatacctgtaatcccagctcctcggaaggctgaggcaggagaatcccttgaacctggggagcggaggttgcagtgagccgagatcacgccattgcactccagcctgggcaacaagagcagaactccgtctcaaaaaaaaaaaaaaaaaaaaaaaaggaatgacctacccattcatgtggcaacatgaatgaaccttgaaaacatgatactgagtgaaagaagccagacacagaaggccacgtattgtaggattctatttatgtgaaatattatggggcgggcgtggtggctcacccctgtaatcccagtgctttgggaggccgaggcacgtggatcaccagaggtcaggagttcgagaccagcctgggcaacatggtgaaaccccacctctactaaaaatacaaaaattagctgagcgtgttggtgggtgcctgtaatcccagctgcttgcggggaggctgaggtagaagaattgcttgaacctgtgaggcagaggttgcagtgagctgagattgagctactgcactccagcctgggcaagagtgagacctcgtcttagaaaaaaaaaaaaaaaagtttctgaacaagaggcaaatccttagagctaggcagcccctggttccccgggctgtggggaggggctgtgggaatgactgcttaatgggaatggggcttctttttggggtgatggaagtgtctttaaattcgattgtggtgatggctgtaaaaccctgtaaatatactaacatttatttaattatacacttaaaataggtgaatattaggatatatgaattctatctcagtaaaacttttaagaaatgtttactcaaacatttaaaaatttaggacaaactattgatacatttatttaacaattaggacacactgttgatacatttatttaacactatgggcgaatatcagaatagttttgctggatgaaagaagccaggcaaaacagagtatagactatactttcttttatgtaacattctagaaaatactatccaatctgtactgatggaaagtagatgggtggttgcctagggccccaggggcagggagggacgggagggataacaaaggagaacctttgggggtggcaggcgtgtttatttcttgattgtggtgatctgggtttcccatgtgtgtcttttactttttttaaatatttctttctttctttattttgagacggagtctcgctctgtcgtcaggctggagtgcagtggtgtgatctcggctcactgcaacctccgcctttcggattcaagtgattcttctgcctcagcctcccgagtagctgggactacaggtgctcatcaccacgtccggctatttttctatttttagtatagacagggtttcaccatgttgaccaggctggtcttgaactcctgacctcaggtgatctgcttgccttggccactgaaagtgctgggattacaggcgtgagccaccacgcccagcctcccacgtatgtctttatgttcaaatttattgaattgtacccttttaatatgtgcagtttattgcatgttgattattatattatttatacctctgtaaagctgtttaaaaagagtgggtctggatgctgggtggaaatggcttggaggggtgagaactggaagttgaagagtcagtggaggtggttgcagccgctcagtgggagacgactcagtttgactagggtgaggtctgtggagagaggtgggtggatgacgtgtgctttggcgggacccataagacctggggatggatctgatattgggggtggaataaaggtaggaaaaataggtgatttttaggtgttttgcttgagcagagctctgtctttatcatctctgtttatctaaaatagactaggaactgagggaagactcggggagagacacgctttaggagtaggggatcacgtttcccacgttggaaatcctgtgtgaggtgtgtgaggcgtccaggtgggtggaaacttggtgctgggagaggttgggacgcatcagcatgcacatggtgtttaaagcaggagtgcaggctgagagcccccgagggcctagacccaacctggagcggtcaggagaggagtagacggggagtctgggctgggtggctggcgaggatcaggaggccaggagcgcaggctaggacccaggataggggagcccaggagagctggcgtggccagctgggctgagtacctgtgggtgaggatggtgagatgggcattggacagagggacactagggtctttggtgacaaggagcaatttctgtggagtgaaggggcaggcccagtctagagtggattgaagcaggagcaggaggcgagggagtggggtcggtaggtggaggcagcttgtcggggacattctgcttcgaagggagcagctggaatgtgggggtcaaggctgtgtgtgtatatatctaaggcgggaggtgccagcacacgtttgaatgaggagtcatggaggaggatagcaagcgggcattcgggaggtgccagcacgtgtttgaatgaggagtcatggagaaggatagcaagcgggcattcgggaggtgccagcatgcgtttgaatgaggttcatggaggaggatagcaagtgggcatttgggaggttccagcacacgtttgaataaggattgtggagaaggatagcaagcgggtattgcagggcatagtgtctgtgaagggcagagggggaggatccagggcacaggtggagcccaggagaagggagtggtgtggcttcctcctgtgcagcaggaagggaggaagaagtgagcccggcggcaggtgagtctccagatccatgatgaggtgggcttggagtctcacccacaagaaggttgaggaaatggggcgggtgtgtcctggctgtgcccagagcaccagagagggcattgaagagagctgccaggcagctgcaggccctggcttggtgtcaggaattgaaggtgaaacaagtccaactgatgatgtgaattttcttctccggcaacatttagttgcttgggtgcaggtgggagcagtgggatagctgggctccttcagggcctggccagacaggcctgggtggaggatgagaagcacaagcagaggatggcagcgaaggctgggccccagctggatgaaggcaggccgctaagctgggacaaggagggtgtctccacgaggctgaagagttgagtacagaatgagataatgcatttgctgaagcgtcgtgggtggtggccagggaggcaaagcctgagacgaggttttggggggaagtgattccaagctccgggggtgacactaggagaggtattggaggttgggtgtttggaggtggagaggaagttgtttggaggtggggagggttaggaactgagcgacaaggtgttggatctgtacctatgcacacacatatatgtggacatgtgtgtgtcaagtcactgaggatggtgatagagcaggaatggagaggatggcgagccagcgagtgaggtgcataagggacagtaactggcaatggtaggtgacagtgagtaggaagggctctaggggtgtgctgtcgagtgtgggcattggcatcagggatctggaaggagcagtggagaaggcagacgctgccctcacctgccatctctgaagtctgtgggggatgaggaagaggcagctgtcactcagaggcgagttggggaggtgctcccttcgtgtgaggccagttttggttggggcaggagtgaggatgctggggagaggctgagtctttaggagaggggattgcgtggttggtggaggtagtgccaagtatcaggtaatgagagggcacaccctgtgcccagggacccgggagtctaacctctgcctgttgagggacgcgtttgccagagagaaagcgtcagcaaagtgccatcttccagaggctcagcaagacgtgcaggaggcacaggctccagtagcgaacgccagcctcatgagggtgtttgggaccaggtggctccattagtgagggctggggccctgtgggcatgagggcagggcgcaggcacctgggaggccatttgggtcagctctcccgcggagctacgaccttggggatgtggcgctcctcacgcggagccaagccaagccaaggccaagcctgtgtttcagggactcgatcactgcagggcttagcctggcatggagtaggctccttctctgtgttctccaggccaggggacttgcatgccagaatccttcttcctcatagatttcttgacttaccactctgcattgcaggaggccctccagtcagatgtccagcccagagctggctgcctgtggctgggtagggtcatgtggctgcccagggccatgggataggccgacacctctggtgtggatatagtacaggggagtgggtctcccacagcaggggaagggttcagactcagagggtccagccctgtgaaggcagggcaggtggtgaaggcctcggggtggtgaagtcatggggctgcaggctcaacctcctttctcttgttgacagcactgacgtcttcatctgcacaagccccatcaagatgttcaagtactgtccctatgagaaggtaaggcgtgcgtctgctcagctgagcccttaccccatgcatcacaggtgaggggtacggggctcagcctgcctgtggaaaggggatggaccctcacagcactcccccacctctgtgacagcggctttctgctccccaaggacctctccagcctgaggctctagatggggcctcttatgatgcaggttctccaggaagggtgcctgtcactgtgtcaggttagcctggcccagagtaggcctttgaagggtgagaaccatgcctggggagggcctgaaggcacgtggatgcattaacatgaaaagtcttaaaaaggtgaggtgggtaaagttcattttgctgtatactcactttattatctttattgaaaagaattagagttgcatgaaattgagacctttctggaaattgggaacttgcagttgccaaacccagaggaaaggtctgtggccctggaggagagcactcatgccggaggggtcagggccggccctccctggggacgttggagcagctcttcccgagctgaggaaggcaagatcttcagtccagagcccctcctgctctgggggcgtcaaaccttcaggcatgagttctttcatgttcttcacatgacctttccgctctggattcccattttttttgagacagagttttgctcttgttgttgcacaggctggagtgcaatggcacgatcctggctcactgccaagatcactgggttcaagcaattctcctgtctcagcctcctgagtagctgggattacaagtgcctaccaccacatccaggtaattttttttgtatttttagtagagacggggttttgccatgttggccaggctggtctcgaactcctgagctcaggtgatgtgcctgcctcggcctcccaacgtgctgggattataggcgtgagccaccgtgcctggcctggattccatatttaaatgaaattcatggtcaggcgcggtggctcacgcctgtaatcccagaactctgggaggccgatgcaggtgggtcacctgaggctgggagttcaagaccagcctggccatcatggtgaaaccccatctctattaaaaatacgaaaatcagctgggtgtagtggttcatgcctgtagtcccagctacttgggaggctgaggcatgagaattgcttgaacctgggaggtggaggttgcagtgagccaagatcgtgccactgcactccagcctgggtgacagagcgagactgtccccccacaaaaaaacttaattaaaaaaaaaaaaaaagaaattcacacattcagccaacatagcgtgccctctgtgtgctcagtgggaatcacacttgctgaacagttgctctggcattatgtgggtgcttggtgcccactgtttcatcatgtcctcatgacaccttgttccctagttaccctgacatccctcatgtttttagagagtgggtcttgttctgtcacccaggctggagtgcagtggccactcacaggtgccatcccagctcactgcagcctcgaactcctgggctcaagtgatcctcccacctcagcctcttgagtagctgggaacacagctgcgcaccacgcaccaccatggccggccttcgctgacccccttttaacacgctaggagcacgagttcacttatacttaggagagaggagtatcttacctgcagccagtaaatgtggattcagagtgtgggccaggcccactgtttcaggtcgagcagtgatcccaaagtgagtcctgagaccagagtcagcatcccttggagactccttaggagtggacatttttcagccccaccctacaccttctgaatcagacactctgggagtagcaatgtgggtctgacgagcccgccaggtgattctcatacaccctcaagtttaaggattgcgggactggagtcactatttcagctggagtttcactgggtggccatggtggttgaccagcagttgtgggagtgagatgaacgacatggcctcattcatccgttcctggggatttagatactgtctttgtgccagctgtcccacctgcgttgcctcggcccgggactgccctctgagctccagacactcagacccgatgtatctgtccctggggtgctggtttccttgtgcatggcagtgctgtctggtggcctcaggtcggaaatcaggggccgtgctgatgtcttcctctaagccctcacttccagcctgttggtgagtcccatgtcccatgggaccgatttcgaaaacgcgcctggcacctgtctgcttctgtctcttctcattgccagcatcttggcatttactgccagtacagctgacagggcctcctaaactgcctgctcctttcagttccatgcaggctgacaaggccctcacagagcagatcatggcagctcctgacttgaaacctctgaatagtttccctttaaaaaccacatacaccctcctgagcatgacctgcagggcctgcctgcctctccacccactgtgcccccctctctgtgtgcttctccagcagcttttggcttggaatgttctcctcccacccctaggtctggtgccttcttgtccacgaggcctcggcccagaagtctccccacatttcgtgaccatcatattgaagtgtattctttctccatcttgttttttggatgacacttcccaccacttgaaatgggtttgtgttttcgtctgtggcttgttcttggtccatctcctgactgggctgggacctgtgcaggctgggctctcaccctcctgcccactgtcaagcccagcacccagcgcagggtggcacactgggaggactcagcgtttgttgttaaatgagtagattcatttgtccaacagagagttattaaacaccggcgagtacagtgcttgccattcatttgacacctttgatacgccaggcaatgtccctttattctcacttttgaggtttacaacagctgcctgtgaaacaagaaaactcttctgatttgacagatgaagaaactgaggctcagagggatgaggcagctcatttaccaggtctgacgcttggccagccagtgaggcctgctccgggtctgcctgtcaagagcctgtgcccaccgccagtgtgttcccctggaggtagcctgcattcactggagaggatttggaaaccgcgcatatttaagaggaaagggatgtcaggaccccagtcacagtaacatcaacaggctctggctcacttgaacaaaggcaggactgattagaaggatattgccttgctcagggaatcaaagggaagcccgaggaagcaggcctgaggccgtaggggcagagcccgcagaccgtctctccagcaaacagcccaagacgctgaagcgccctttctccatccttgggtttcattgcccaagattcctagtccccaggagagggaggcccatcagctgagcttgggtcccacacccagccctgggtgccctgatggactgtcctaaaaggctgcagttggtggcagaggcgtggcttcccagaggagttgagatgctgttgccagaagaagggtcacactcatagtggatgtcctgatcaaactaaacgaaagagcaaaggcaacaagaatccacatctacaatcccaccacctggagagagatgctgttagcactttgatctggttctttctagtttttttgtgggggagtaggggagacagggtctcactatgtcacccaggctggagtgcagtggtgcgatctcggcttactgcaacatccgcctcccaagttcaagtgattctcctgcctcagcctccttagtagttgggattacaggtgtgcgccaccacacccggctaatttttttttgtatttttagtagaaacagggtttcatcatgttggccaggctggtctctagctcctgacctcgtgatccacccatcttgtcctcccagagtgctaggattacaggtgagccaccacacccagccctcgtttttctttgatgcgtattaaatataatacatgtattttaacaaagctttcatccaacatagttatccttttctgcttattaatatatttttagccttttttctgtcatcaaacacttcagaaacatgatttttttttttttttgtgagacagggtccagctctgtggcccagactgaagtgcagtgacacgatcttggctcactgcaacctctgcctcctgagtttaagtgattctcatgcctcagcctcccaagcagctgggacaagtgtgtgtcaccatgcctggctaattttttatatttttgttctgttttgtttgagacagagtcctgctctgtcacccaagctggagtgcagtggtgcaatctcagctcacttcaacctccacctcctgggttcaagtgattatcctgccccagcctcctaagtagctgggattacaggtgcgtgccaccatgaccagctaatttttgtatttttagtagagacggggtttcgctatgttggtcaggctggtctcaaactcctgaccttgtgatccacctgcctcggtctcccaaatgctgggattacaggcgtgagccaccacgcccggccaatttttttgtatttttaatagagatggggtttcaccatgttggccaggctggtctcaaactcctagcctcaaagtagtctgcccatctcggtctcccgaagtgctgggattacaggtgtgagccaccatgcccagccagaaacatgattgttaatagctgaagacgtctagtgagtaagcctttgtatggtcatgttcttagggtgaattccaagaaatacaattcctgggtcacgcgaggaaaggtagggttcgggtatatatcacacagaaatttgtattcatttccactgtaccagccgtgggcagggtactttcctcctgccaggggctaggctggaccacatagggtcagtcaatagaggaagcaggccattgaacaaacacatgaagacaggaaagtgcacagcagatttgaggaattcagggtgaattttgttggccagtggctacaggggctgattgggagcggggttgggccaggtgaaatggattagtttatccaaatctcccagctgtcctcatggtttagccacaccaccacctttaaccctagaactaagacaaggggagaagtgcgggtgagaagtgagtaaggcgaaggttgcttccaagcaccccctcacccaccgtttgtgcccctcccaaccctatggactggtacttcttccctggctgagggcgggctggtattaatggttcctgtgttccatgcctgggggaggcaaggaagggctggagatgggtctcggggcacatctgcacaggacagaggtctcccacggtagccccggtctaggcttaagccccagagcactcacagttccttccccagctcctgtccactgagtaggttcagcctttgttgctagaagtggaaacttttctccttggttgattttctttcaagacccagtcagaggatgggaacctgactgctgtgaggtctctcactttatcaccacatggagggagtggaattgggttacattcaggttgccagaaccttctttctggctggaaagaaggtttcccaacattctaaacccagattgctcggtaatagttaacaatagccaagctggtagtatacgtctccaagggctttccctgtagtgatccatttagccttcatagtagccctacaaaataggtatttctattttttatttttattttttagacggagtctcgctctgtctcccaggctggagtgcagtggcgtgatcttggctcactgcaagctccccatcccgggttcatgccattctcctgcctcagcctcccgagtagctgggactacaggtgcctgctaccacgccgagctaatttttttgtatttttagtagagacggggtttcactgtgttagccaggatggtctcgatctcctgacctcgtgatctgcccgcctcggcctcccaaggtgctgggattacaggcgtgagccgcagcgcctggccttaaaataggtatctttattatccctgttctacagatgggcagactgaggcacagacagttgaagctgagggttagcggccagaaagtggggagtcagacttcagagcccatgctctgctcctcggcctcactgcctcttctcggactccttgacttgaaacttaagcagcatgacctgtaccttttcaccccctagagagatttgaaaatccgtgtcaggttcttcatgcacaggcatggcattttactctgagattttccagttcaacaaggggagtaatcacaagccaaattaagggaggggcttgggtgcgaaggggaatgtgctcttctgatttgaagtctggtttccagatgacatgtctgcctgattcgacgttgatttttagaataaatgtcaaaaattcccacttcaggccgggtacagtggctcatgcttgtaatcccaccactttgggaggctgaggcaggaggatcacttgaacccaggagtttgagacctgcctgggcaacatgatgagaccccatctgtactaaaaaaaaattagccaggcgtgctgatgtgtgcctgtagttgcagcatcttgggaagctgaggtgggaggattgcttgagcctgggaggtcaaggctgcagtgagctatgatcatgccactgcattacagccttagtgacagagtaattccctgtctcaaaaaaacaaaaacaaacaaaacaaaacaaaacaaaaacctactcctggctgggcgtggtggctcacgcctgtaatcccagcactttgggaggccgaggtgggcagatcatgaggtcaggagattgagaccatcttggctaacacggtgaaaccccgtctctactaaaaatacaaaaaattagccgagcgttgtggcgggcgcctgtagtcccagctacttgggaggctgaggcaggagaatggcgtgaacccgtgagacagaggttgcagtgagccgagatggtgccactgcactccagcctgagtgacagtcagactccgtctcaaaaaaaaaaaaacaaaaaaaaaacccactccttaattgagcctcttcctctaacctgaaataaaaacgtaaaaacgtagactttttttttttttttgacagagttttgctgttgttgcccaggctggaatgcaatggcgtgatctcagctcactgcaacgtctgcctcctgggtttaagtgattcccctgcctcaacctcctgactagctgggattacaggcatctgccaccatgcccggctaatttttgtattttttgtagagacaaggtttcaccacattggccaggctggtctcgaactcctgacctcaggtgatccatctgcctcagccccgcaaagtgctgggattacaggtgtgagccaccgcgcctggccaacatagaccattttttttttaacttaagataatgaattacatttctttgctttctttctttctttcttttttttttttttttttgagacggagtctcactttgtcacccaggctggaatgcagtggtgtgatctcagctcactgaaagctcagcctcccgggttcacgccattctcctgcctcagcctcccgagtagctgggactacaggcacatgctaccacacctgtctaattttttgtattttagtagagatggggtttcatcgtgttgcccaggctagtcttgaactcctgagctcaggcaatcgcctgcctcagcctcccaaagtgctaggattacaggcgtgagccactggacccggccttctttgcatattttacattaaatttccagttgctccagtacgttttccagttactccctgtaggacttaggctaaaagacttggcactttctcttggcatgtaaagaaaccctaggttcttttggggatggcacggccacactgccagcattcaggagcttcccctggagctcctgaaccccagtgtcacccctgccatctcagtggggctcatggtgtctttcttggcgtgtttctggcccataccgtgtttattttaaaaattgttcatgctaattggcatggggtttcttttaggggtgatggaaacattctggaatttagatagtggtagtggttgcataacattgttgatacactaaagaccattgaattgtacactttaaattggtaaattttatgatatgtgaattacatttccaaaaaataaaataaaattggctgttcagatggctaataattccaaagctaactcactccttctagttagatctggccatttcatcattgtaatagggattgtagacaaaagtgcatgatccctttatttatttatgtaattttttttttaaagacagagtctcgttctgttgcccaggtggattctagtggaacgatcatagctcactgcagcctctaactcccagaccatcgtgcctggtcataatacctttaaagtgtcctagatcaagccattcattttgaaaacctccagttttatggtattctttttctttttcttttctttttttttttgagatggagtctcgctgtgtcacctaagctggagtgcagttgcgcgatctctgctcactgcaagctccgcctcctgggttcacaccattctcctgccttggcctcccaagtagctgggactacaggcgcccaccaccatgcctggctaattttttgtatttttagtagaggcagggtttcagtgtgttggccaggatggtcttgatttcccgacctcatgatccacccgcctcggcctcccaaagtgctaggattacaggtgtgagccaccgcatccggcctatggtattatttttctagcagtgtcattcacccaactccacacctgcataccccaccctccttgatttaagacctgtcttgggatctgctcatctgagtggagcaggactctgtcccttccaacattttgcctgctagggactgtgtctagctcatagatctcttatttctgatgtgtccatttggtcatgggcctgtgagccacgcggagcaggaagggcagggaggtggggtcgagagctgccagccatctgcccctctgatcttttccagcactgtcctctgccagcatccccctttacttctgtgtcttcttggtaatcactgaactctttgctctcgaggtggttcatggacttcctgcctgcactcctaggtcttggagagagcgcctcccctgggagtcctgccagcaattctttagctacatgtagttttaggttccatggcaggcatttttcctgattctggtttagaacgacagcaccgctttatgcttggatacctttacattcatctgggctgaactattttctccccagagctttcaggaaccaaaatggtaatcaggtgatgagcagcccttctccttccaaacagctgctgataaacctaacagacccttgtcaggcaaatctgagctaaaggcacaatgcccccaccagtgtgcacattattatagctgttgaacctacgtcagtgcaccatggtcactcagagcccatagtttacatcagggttcactcccggtatcctgcgttctgtggtattggtaatcggggaggctgtgcgttgtgtgggagtggagggtatatgggaactctgtacctctgctcaattttgctgtaaacctaaacctgctctaaaaaataaagtctcttaaaaaaaatccacagtgaatgagagtccctcttgctccctatccttgtcagcatttggtattgtcagggctctggattttggctgttctcataggcagggagtggtgtctcattgttgttttgatttgcatttccttgattaatgacattggacatgtttttaagcaagtaaccctttgtatattttctgtaacgaaatgttcaagccttttgcctcgtttctcattgagttgtttgtgagttgtgagagttctttagatatgctagaaacaagttctttatcagataatgtgttttacaaatattttatcccagtctgtgatttgtattttaattttctttttcttttttttcttttttgagagacagagttttgctgtcactccagctgaagtacagtggcatgatcccgcctcactgcagctgtgaccccctgggctgaagtgatcctcccaccttagcctcctgagtagttgggactataggtgtgtgccgccatgccaagctaatttttaaaacactttttttttgtagagatggggtcttgctatgttgcccaagctggtcttgaacccctggactcaagcaatcctcctgccttggcctcccaaagtgctgaggttacaggtgagttttctcaacagagtctttagaagagcagaagttttatacttttagattttttatttaggttatgatccatttgtttttttgagacggagttttgctttgtctccctggctgtagtacaacagcgtgatctcggctcactgcaacctccgcctcccaggttcaagcgattctacctgcctcatcctccctagtagctgggattacaggcacctaccaccatgcccagctaatgtttttgtatttttttttttttttttgagatggagtctcactctgtcacccagtctggagtgcagtggcacaatctcggctcattgcaaactccacctcccgggttcatgccattctcctgcctcagcctcccgagtagctgggactacaggcacccaccaccacacctggctaattttttgtatttttagtagagacggggtttcatcgtgttagccaggatggtctcaatctcctgacctcatgatccgcccgcctcggcctcccaaagtgctgggattacaggtgtgagacaccgtgcctggtatgtttttgtattttagtagagatggggtttcaccatgttggccaggctggtgtcaaactcctgacgtcaagtgatccacctgtcttggcctcccaaagtattgggattacaagcgtgagccaccatgcctggctcgttttgagttaattatcatatattgtaggaggtaaaaatggagaggttttttttttttttgcatgtggatccagttgtgcctctgttggaaaggccaccctttctcactgaagtgtcatggtagcctggggtccatttctggaatgtatcctgcttctctgatctaagtgtcccacctaatgtaaataccacactgtctcagttactgtagtttttttttttttttttttgagatggagtcttgctctgtcgccaggctggagtgcagtggtgtgatctcggctcactgcaacctcctactgggttcaagtgattctcgtgcctcagcctcccgagtagctgggattacaggcacgcgccaccacacccagctaatttttgtatttttagttgagacggggtttcaccatgttggccaggatggtcttgatctcctgaccttgtgatccgcccactttggcctcccaaagtgctgggattacaggcgtgagccactgtgcctggccactgtagttttatagtaacttttgaaagcagtgtgagttttccaaaattattcttcattttaaaaattgttttggctattctgggtcctttatatttctatagaatgtttagaacaagctggtcagtttctacaaagaacctggtgagaatttgattgcaagtgcattgtagctataaagcttaacaatattgggtcttctgatccacaagcacatacacatcctcatttatgtaggccacctctaccttctctcagcaatgttttgtagctttcagtgtaccactcttgcacatattgtgttaaatttgtctctatttcatgtttttttttttggcatagagactatctttataaatatatttttaaatattttataatggtaaatacacatgataaaatttatcaagtgtacagttcagcttatttcgtttttaatgctattataaactttgtttaattgaaatttccaaatatatagaatacaagtgatttttttttttgagatggagtcttgctctgttgcccaggctggaatgcagtggtatgatctcggctcactgcaagctccgcctcctgggttcatgccattctcctgcctccacctcccaagtagctgggactataggcgcccgccaccatgcccagctaatttttggaatacaagtggttttttaattttaatttttaatttttgtgggtacatagtaggtgtgtatttatgaggtacattagatgttttgatacaggcatgcaatgtgtaacaaacacatcagggcagatggggtatccattatcaccttaaacattcaatcctttgtgttatagacaatccaattatattcttagttgttttaaaatgaacaatttttttttttgagatggagtcttgctctgtcactcaggctggagtgcagtggcgcgatctctgctcactacaacctctgcctcctgggttcaagcagttctcttgcctcagcctcccaagtagctggaactacaggcacgtgccaccatgtccggctaatttttgtatttttagtagagacggggttttgccatgttggccagctggtctctaactcctgacctcaagtaatccacctgccttggcctcccaaggtgctgggattacaggcatgagccaccacgcctggccatgaacaattaaattatttttgattatagtcaccctgttgtgctagcaaatactaggtcttattcattcttttttttttttttttttttgagatggagtctcgctctgtcacccaggctggagtgcagtggcgcgatcttagctcactgcaaactctgcctcctgggttcacaccattctcctgcctcagcctcctgagtggctgggactgcaggtgcccgccaccacgcccagctaattttttgtatttttagtagagacagggtttcaccgtgttagccaggatggtcttgatctcctgacctcgtgatccgcctgccttggcctcccaaagtgctgggattacaggcatgagccaccgcgcccagcctattcattctatttttttgtgcccattaactctcttcactttccttctagatactcctccactcccccttcccagcctctactaaccatcctcctactatctccatgagttcaattgttttaatttttagctcccataggtaagtgagaacatgtatagccctttctgtgcctggcttatatcacttaacataatgacctccagtgccatccatgttgttgacaatgacaggctctcattcttttttcttttcttttttttttttttttgacggagtcttactctgtcacccaggcttgagtgcagtggcgtgatctctactcactgcaacctccgcctcccgggttcaagtgattctcctgcctcagccacctgagtagctgggactacaggcatgcaccaccacacctggctaatttttgtatttttagtagaggtggggtttcatcatgttggtaaggctggttttgaactcctgacctcttgatccaccctcctcggccttccaaagtgctgggttgctctcattcttttttatggctgaatagtacttgattgtgtatatttaccacattttttaaatccagtcatcagttgatgtacactgaggttgcttccaaattttggctattgtgaatagtgctgcaataaacatgggagtgcgagtatcttttccatatactgatttccttttttttaggggtatatacctaggagtgggactgctggattttcagaggaactgccattatattcctaccaatagtgtacaagggttttattttcttcttgtcctctccagcatttgttattgcctgacttttggataaaagccattttgactggggtgagatgatatttccttgtagtttgatttgtatttctctgatgatcagcgatattgagcacctttttatatacctgtttgtcatttgtatgtcttttgttttgtgttgttgagacaggatctcgctctgtagctcaggctggagtgcagtggtgtgaaaatagctcactgtagcctcaacctcctggactgaagctatctttccacctcagcctcctgagtagctgggactatgggtgtgtgccaccaagcctaattttttttttttttctttagactgggttttgccctgtttctcagactggtgtacaagtggtttaatcatggctcactgcagccttgacttcccaggctcaatcaatcctcccaccttagcctcccaagtagctgagactacaagcgtgtgccaccatgcctggctaatttttgtatttcttgtagagacggggtcttactatgtagcccaggctggtcttgaactcctgcccacctcagcctcccaaagtgctgggattataggtgtgagccatcacacgcagccaccatatgtcttcttttgagaaatgtctatttagatcttttgcccattttaaaatcagattattagatttttttctatagagttgtttgactccttatgtattctggttattaatcccttgtcagatggatagtttgcaaatactttcttccattctgtggattgtctcttcactttgttgactgtatcctttgctgtgcagaagctttttaactggatgtgatcccatttgtccgtgtttgctttggttgcctgtgcttttggggtactattcaagaaatctttgtccagaccaatgtcctggagagtttccccaatgttttcttttagtagttcttgtatatggcaagagataggggtctagtttcattcttttgcatatggatatccagttttccagtgccatttattgaagagactgtcgtttccccaatatatgttcttggcacctttgtcaaaaatgagttcaaggtagatatatggatttatctgtgggttctgtgatctttttttttttttttgagacggagtcttactctgtcgcccaggcgggagtacaatggcaccatctcggctcactgcaatgtccgtctcccgggttcaagtgattctcctgcctcagcctctggagtagctgggactacaggcatgtgccaccatgcccagctaatttttgtatttttagtagagatggggtttcaccacgttagccaggctggtcttgaactcctgacctcacgctatccgcccgcctcggcctcccaaagtgctgggatttcaggcatgagccactgcgcctggcctggttctgtattcttatccactgatctgtgtgtctgtttttatgccagtaacatgccatttggactactgtagctttgtagtatcatttaaagtcagataatgtgatttttccagttttgttccttttgcttaggatagctctggctattctggaatttttgtggttctatgtaaatgttaagggttttttttttttttttttttttgtatttctgtgaagaatgtcattggtattttttttttttttttttgagatggagtcttactctgtcacccaagctggagtgcagtggcgcgatctcggctcactgcaagctccacctcccaggttcacaccgttctcctgcctcagcctcccaagtagctgggactacaggcgcccgccaccacgcccagctaattttttgtattttttagtagagacggggtttcactgtgttagccaggatggtctcgatttcctgacctcgtgatctgcctgcctcggcctcccgaagtgctaggattacaggcgtgagccaccgcacctggcctgtcattggtattttaatagggattgcattaaatctgtaaattgctttgggtagtatgaacattttaactatatttattcttctaatccatggacatggaatgagtatctttccactttttgtgtcttcaatttattctatcagtgttttatagtttacagtgtagagctctttcacttgggttaattcttaggtattttattttatttgtagctattttaaatgggattcctttcttaattttttttcagattgttcctgtttttttcaggattgttcctgtttttttcagattttgtatcctgcaactttgctgactttatcagttctagtagttttttggtggaatctttaggtttttccaaatataagatcatgtcatctgcaaacaaggataatttgacttctaatcctttctaatttggatgctctttctttctttctcttgtctgattgctctagcgaggacttccagtactatgttgaatcacagtggtgaaagtaggcattcttgtcatgttcccggtcttagaggaaaggctttcagtttttccccattcagtatgatactagccatatataggtctgtcatatatggcttttattatgttgaggtatgttccttccatacccagttttttgagggtttttatcatgaaaggatattgaattttatcaaataccttttcagcaccaattgaaataatcatatgttttttgtccttcattctgttgatatgatatatcacattaattgatttgcatttgctgaactatcctggaatccctgggataagtcccacttggtcatgctggatgatctttttaatgtgttgttgaattcaatttgctaatcttttgttgaggattttaggaatcaatatttatcaatgatattggcctatagttttcttttctttttttcaatgtgtttttgtctggttttggtatcacggtgatactggcttcatagaatgagtttggaagtattccttccttctgtatatttctgaatagtttaagtaggattggtattagttatttaagtgtttggtagaattcagcagtgaagctattgggtcccggccttttctttgctgggagactttttattatggcttcagttgttgttacttgttattggtctgtttgttttgaatttcttcatggttcaatcttggtagattgcatgtatctaggaatttgtccatttcctctagattttctaatgtattggcatgtagttgcccatagtagccaccgatgattgtttaaatttctgtaatatcagttgtagtgtttcctttgtcatctctgattttatttatttgggtcttctctctttttttcttagtctggctaaaggtttgtcattttgtttacctttccaaaaaaccaactttttgtttcttttcacaaaaccaatcttttgtattttttttatttcatattcatttatttctgctctgatttttgttatttcttttctttcctttcttttcttttttttttaattttgagatggagccttgctctgtcgcccaggctggagtgcagtggcacaatctcggctcactgcaacctctgcctcctgggttcaagcgattctcctgccttagcctctcgagtagctgggactacaggtaggtgccaccatgcccagcttatttttgtttttttagtagagatggggtttcaccatgttggccaggctggtcttgatctcctgaccttgtgatctgcccgccttggcctctcaaagtgctgggattacagtgtgagccaccgcgcccggcctgctcttgtttttctgtttctttaggatgcatcattaagttgtttacttgaagtttttcttcttctttttttattttttttaaattcaggcccccacagaagcattttcttcttttttgatgtggcacttatagctataaacttccctcttagtactgcttttgctgcatcccataggttttggtatgttgtacttccattatcatgtgtttcaataaatttttcaatttccttcatttcttcattgacccacttcattcaggagcatgttgtttaatgtctctgtgtttgtatagtttccagaattcctcattattgatttctagttttattccaaaaatacatgtgatttttttatattgaccttgtatcctgttagtttgccaaattaacagttctagttgctttatgtagatgatttggggctatgaaagtctagttataataattacatttatttagtacgtctgtatcaggcattactcaggtgtcctcacagttttttatttgatcataccagcaacactgtgaggaaactgacctcacagtggaagtcactggcttgcccaaggtccccagctcgtatgtatcagaaccagacttagggcctaattttgagggtaagacaaaaaggtagaatcctttttctgaagactttctgtgtgccaggtgcagtactgagactctgatgcataattttccactaaatccccgaaggcactcacgaggtagatgctgtccttatccctgtgtcaccacacagggaccagacaacctgctgagggatagagatactcacgtgagaagctggtggtatctatgcgcagtggccacataagtgctcatggctgggctccaggaggctcagggggaaccccatgccctcttctatttttacctcttaccatatataaaatttaaccctggctgggtgcagtgggtcatgcctgtaatcccagcactttgggaggccacggtgggcggatcacaaggtcaggagtttgagaccagcctggccaacgtggtgaaaccccgtttctactaaaaatacaaagaacttagccaggcatggtggcaggcgcctgtgatcccagctacttgggaagctggggcaggagaatcacttgaacctgggaggtggaggttgcagtgagccgagatcgtgccattgcactccagcctgggcgacagcaagactctgtctcaaaaaaaagaaaaaaaaaaattaaccccaaatgggttaaatacatataaatacatatatacatataaaagctaaaagtataaaacttctgctcttcaaaaggcactgttcagaaaatgaaaagacaaatcacagatcatgaaaaaatatttgcaaaatgcattgtctgataaaggactggtttctagaatacattaactactctcacaactcaatacaaacagcccactttgttttgccgtttatgtgacccctgataagtcacagaccctctctgagcctccatttcttcatctgtacgggatctcgtcaccactatcgtggcacatcattttcccacgcaaaccctttctgcagagcagctccgtattttgtctgcagagtggcgccggtccgagatgaaacacggaaactgggtgtgtgtgattggaaatgttcatggcagtttgtctgatgcagtgttcaggcacatgatttgatttcatatcttacaaaagcattggtcacaatgcagtggaaattaaaaaaacaaaacctgacccttctcttcccacactcccagatgttccatgttccagccacactccagggttttccccattcctcaaacacctgagcaccggcctgccttggaacatcagtgtttgtttttccctctgcctggaatgttcttgccgacctgtggagagccagccgccttgtcagtcgggtccagagaagatgccgcctttgcagtgaggcctctgtgtgaggttggagctctgtgctgactgcagagcccttgccccctggctatcgttgtctgtggcctgtgtgcctcctcctgctatgtgcactccatgggtctcctgttgaccatcgtctctctggttcctggaactgtacctcatgcaatattggctaaattactacacaagtcaggaaagtttggctacttggaatgttgccgtgaggcttagatacgatgacggacactgcatgcctgtggagtgggtctgctgaaaacattagccccaggctcttgccccccatccagcctgcaccagcgatttacagtcctgtggggaagatgcgaagtaagttatagagatgtgtagctccgactgtgacattgctagggaggacaattagactgggagagttcagggaaggcttaggaggtggcagctttagaaggataggtgctcactgggctaggagaagggccctgtgcatatgtgtgtgtgtgtgcatgtgtgtgtgcacacacgtgtccatgaaggaatgttccagtcagaggaaatggcacatgtgaggctctgagcaggaaaaagcataatacagtcaagcagtgagaggaggttgtcgtgggtgggcgtggcaagcgaggtggccacagggaaaggtggcgctgggacagcggtagggctggtctgctctgcagatccggcccttttcccacgtcccgtgtgctggccggttgcagagggtcatgtggtgtctgcctttgtgaagtgggactcctgaagcgacctccaactggaagaaagccaccctaaggcacccatgtcccatttccttgtcatacacagggaaaaacggagtccctgggagggcaaggacctgcccggctctgccccagggtggcagagccctgagctccctgtgcagcctgggccactcagtgtttctgtttgtttatgcaggaaccagaggagcttagggaaaaagtgcatccagtcctgcccctcctctgcttaaaatctgctgctggttaacctctgtagctgtaacagggtctgtgacttaagggttggttgccagtgtcagaaatcaacaagggtgttggaatctggatggctgtagagacagcctggagctgggcagggctcagttagggtgcctggggcccatgggccagagcaggtgccgtgcttaggctgcgcccacccctggctgcactggggtggtgagagcagccaggacctgctaccctataggaaaaagtcaatttccccagggaatcgaggcaaagggaaaggatgccgagagcccaccagtggcgagaggatgccggtggcttgccaggccccggtctgctccctgccccccggggagcaccagcaccccagtttgctatccatcggcccagacacaccctgccccatgtccgttagcacctggaatgcgctgtgtgctaggggtgcccctgtggtcagcttgcctgtcctgaagaaagccttccttgggcagcctgtggcttctttgtaggcctgtcccaggtgttatgtaaccattgtttaagagggccttgaccgctgtctcctcagctgtaagctccctgagggtaggaactgctttttgtcttggttttctttcttcagtgcctaacagtacgcactgcccacatgcatgtggggcaggaggtggcagtggcccagcaggtggcaggggtggcacacatggccgccctctgctccctgtgtttgggttatgctgtgcagtgttcgctgggtgtgaagaggggacagggctgggtttgtcgtgactctgctgctttctagctactggagtgtggaccagccatgtgcgctccctgagtgctggcgtcctgggctggactccctcccagcactgactgcctggcgctgggccttggtgtcaggcctccatccctccctgcctgttagctgaggtctaggctgacccctgccctcggctcttggttggctcccaggtctgatgtcactttcttctcaccacctgcccttgcctgtttgcgtccagtatgcctgggtggagaagtactttggccctgactttctggagcagattgtgctgaccagagacaagaccgtggtctctgctgaccttctcatagacgaccggccggacatcacaggcaagtggcctgcgacaggtgaggagcacgtggggagggccccagccttggcccccttctcctgggcagtgagcactcagttgcttcctgccccacttagtcaccagctgtttgccaggcactgagcccctccccttcgggaagacaaggccccctctgtatgggctgtggcctggtgctcctgggagctgggaggagtgggtgccagctctagggttagcttgaggggtggccttggggaagtcccttcagcttcaaagccttgtcttcctcatgtaacatggggactcaactctggtttccaaatgtttgtttttagcaacaaaacccattttttcccccaaaagcaatgtggactgatgcaatgaatgacaggagggcagagcagagctcctgcagggaaggtgggttgggacagaagacccccctccccaaaaccaaacaagccagtcaaccttgaactgccgtagaaaggagagggagatgggcgtggtgactcacgcctgtaatttgggaggctgatgtgggtggatggcttgagcccaggagtgtgaaaccagcctggccaacatagcgagactctctctacaaaaaatacaaaaattatctgggcatggtggtgcatgcctgtagtcccagctacttcaggggctgaagtggaaggattgtttgagcctaggagttggagaccagcctgggcaacatggtgagactccctgtctctacaaaaaaaaaaaaaaaaacacaaaaaaattagctgatcatcatggcgcatgcctgtggtccctgctactctggaggctgaggtgggaaaatcacctgagctggggaggtggaggctgcagcgagctgtgattgcaccactgcattccagtctgggtgacagagtaagaccctgtctccagaaaacaaaacaaaatacaacacagcacaggagaggggaagttttttggtttacctaactggaaaggggtgaggagggctttggccggccaaatctaggcgttgaaactgcccgtgagtgttgtttctttgcctcttggctctgccctggcctggtttttgacatcctcctcctggtagccgtcagtagtttcaggtcgagtcttttggacaccccagtgggaatatacattctatttttttccctgattgttttagaactggcttgggaaacatgcccacctccatcactgcgtccagagggtggactccacgagtgtacccaccccaccccaccctccccagcctcgtgggttcccgccagagtcagggcagacagtggtctgtggggtcccgtgaccttgagggcccaaaggctggcttggcctccatctccagccacaggttgttgggggcgggtgtataacccaaaggggtggcgtcaccagcagcaccagtgtggacacgagggaatgaggcctggagaggctgcaggggcctgtgatcagcggctggtgagctgcagagctggtgccacctggccttcccacaccaggccatcaggatggtggggcacagagagggaagttgggggaacaccgtgtggtgtaagccatcaggatggcagggcacggagagggaagtcgggggaacaccatgtggtgtaagccatcaggaggcggggcacatgtcccttgccagtgctggtggtgacagtgacccgcagtcagtccctgttgactgagcactggctgcgcgtgctgacggcctccttgccgcatctcgtgccatcctcacacccgctgcgaaggcgggtgtgcgtgcagtcacccctttacagaggaaacaagttttggcaaggccagatgcctgcctggatacccaggtttccaccctaggcggctgcgctccaggtctccactgctgagctgaatgccgctttcccacccacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtagctcaaggctgtggcctgccctaagatcctctagcgtctgcccccactggggacccagcttcaggtcttgtaagtgtctgggcagttccactgcattgaagacaggcggaggaaggcatgacttcagcccatgcctcgcagggtgggtcctagtggtggtctcctcgggccacccacccactctcgttggtgagacttaggaggtgggtcttagtggtggtctcctcgggccacccacccactctcattggtgaggtttaggagatgggctccagacactcggttgctctctcaagtgcctccttcccgcacctgccccagtgcttcagagcagggtcccccgtccccctctcctccgctcttctcccaaggccaagtttctgtgggatcgcaggagccctgtggggaaggctggtgttagagtctcagcttctgttccttttgacccgctgggaagtgacagcttgaaccagccacctccccactaacctttggagaggttttgggaccactttcttgtccttatgcccttcccgttactgctctggccgctctcccatcatggcccttgaagggaacatgggttgcccatgcccctaattcaccccagctctggggccctcctggcaggcctctctgccttatatgacagagatgctttgggctgccctggaggcagggtcagataggagagaagacaaggggaaggcacccatggcccaaggttggctgagctttttgatgttcctgttcttatagtctcaggagcttgggctccatcacccaccttagggagggaggacccctccaggctccatcaccccagcttagggagggaggacccctccaggctccatcaccccagctaagggaggaaggacccctccaggccccataaccccagcttagggaggaaggacccttccaggctccatcaccccagcttagggagggaggatccctccaggctccgtcacccaccttagggagggaggactcctccaggctccatcaccccagcttagggaggaagaactctaggcttggccaaaggcagatctccacggcacccccacccccttacccgctgaactgacatttttctttggggtgaaggggagaggctgaaccaggaatatatttggggttgcatcacatgatctgaaaccatctggtccaggcagggtggtggttggaagagtcctggctgtcttgccacatggctctggagggaagtctgaccctggggtgctggctgcccagctgctcctgagtccctctgcctcttcctgctgtctgaggtctcacctgtggggccctgaaagtccctcctcatgaagggccaggagaatgtgtgatgtgcaactcctttcttgtccccagcagggcctgtccacctgctccacgccctgtcctgagagggactgccccatcagaagactcgagtcacagggactctcctggggccagccacaccctgaaaacattgtgactatagcttggggtgcagaaaacaacttggcttgtttccatcctgggggtccttctgatgacagaaactcaatcctgtccagattttctcagccacatcctggtttctccctccctcctcctgcccagggagagccccgggcctgggggctgacttggtgcaggggtgtgggtcgggttgctgagagcagtgttcacggaccccgagggagctgtggaggggccctgaggccttctgtccacaaagaggggagcagggcctggtggggtaccactgggggacattccctcctgcctcttacaccagccagggaatctttgttgagtctagggcagggcagggctgggcagtctccgtcagctcctaaccaagcatccgcaggagtaacatgctctgaatccttcaggagacggactgttgcgaaaccttttagactgataattgccatcagttttaaaggtcagtttaggaactccatgctccaaattgccacatttgttctctgctgttat

SEQ ID NO: 15718 - DNA, 13883 bp, Human
gggtgcactcagtcggtgtgaatatggtgtttagagaccccagtctggtcaccaggggtggggcttgctcctgggattttgttactgctagggctttggaagagacagagccaggaaataagttttttttttttttttttgccaattttaaaaaaataaagtatgaggctgggcacggtggctcatgcctgtaatcccagcactttgggaggctgaggcgggcagatcacttgagctcaggagtttgagaccagcctggccaacatggtgaaacccagtctctactaaaaatacaaaaatcggctgggtgtgatggcgcacgcctgtaatcccagctacttcagaggctaaagcaggaggatccctcgaacccaggagttcaagactgcagtgagctatgattgtgccactgcactctagcctgggtgacagagaccctgtctcaaaaaaacaaacaaacaaaaaacctctgtggactccgggtgataatgacatgtcaatgtggattcatcaggtgttaacagctgtaccccctggtgggggatgttgataacgggggagactggagtggggcgaggacatacgggaaatctctgtaatcttcctctaattttgctgtgaacctaaagctgctctaaaaatgtacatagatataaactggggccttcctttccctctgccctgccccagccctcccccacctccttcctctccctgctgcctcccctctgccctcccctttcctccttagccactgtaaatgacactgcagcaaaggtctgaggcaaatgcctttgccctggggcgccccagccacctgcaggccccttatttcctgtggccgagctcctcctcccaccctccagtcctttccccagcctccctcgcccactaggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccactgagtgtctcggtgagggtgacctcacactggctgagcttaaaggccccatctgaagactttgttcgtggtgttctttcacttctcagagcctttcctggctccaggattaatacctgttcacagaaaatacgagtcgcctcctcctccacaacctcacacgaccttctcccttccctcccactggcctctttccctccccttctgtcactctgcctgggcatgccccagggcctcggctgggccctttgtttccacagggaaacctacatggttgggctagatgcctccgcacccccccacccacaccccctgagcctctagtcctccctcccaggacacatcaggctggatggtgacacttccacacccttgagtgggactgccttgtgctgctctgggattcgcacccagcttggactacccgctccacgggccccaggaaaagctcgtacagataaggtcagccacatgagtggagggcctgcagcatgctgccctttctgtcccagaagtcacgtgctcggtcccctctgaagcccctttggggacctaggggacaagcagggcatggagacatggagacaaagtatgcccttttctctgacagtgacaccaagccctgtgaacaaaccagaaggcagggcactgtgcaccctgcccggccccaccatcccccttaccacccgccaccttgccacctgcctctgctcccaggtaagtggtaacctgcacaggtgcactgtgggtttggggaaaactggatctccctgcacctgagggggtagaggggagggagtgcctgagagctcatgaacaagcatgtgaccttggatccagctccataaatacccgaggcccagggggagggccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctaccaacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggagaggtcaccttcttcttgggcgagctcttcttggggtgctgagaggccttcggcaggtcatcacgacccctccccatttccccaccctgaggccctctggccagtctcaattgcacagggatcacgccactggcacaaggagacacagatgcctcgcaggggatgcccacgatgcctgcatgtgttgcttctggttcctttcctccagttccaaccgccgcactctcccacaccagtgtgacagggggcccatcaccctagacttcagagggctgctgggaccctggctgggcctgggggtgtagggccaccctgcccttccccacctggaacctggcacaggtgacagccagcaagcaatgacctggtcccaccatgcaccacgggaagagggagctgctgcccaagatggacaggaggtggcactggggcagacagctgcttctcaacagggtgacttcaagcccaaaagctgcccagcctcagttccgtcagggacagagggtggatgagcaccaacctccaggcccctcgtgggggtggacagcttggtgcacagaggccattttcatggcacagggaagcgtggcgggggtgggaggtgtggtccctagggggttctttaccagcagggggctcaggaactgtggggacttgggcatggggccatcgactttgtgcccagccagctaggccctgtgcagggagatgggaggagggaaaagcaggccccacccctcagaaaggaggaaggttggtgtgaaacatcccgggtacactgagcattgggtacactcctcccgggagctggacaggcctcccatgtgatggcaaacaggccgacaggagacacggctgttgctcgtcttccacatggggaaactgaggatcggagtcaaagctgggcggccatagccagaacccaaacctccatcccacctcttggccggcttccctagtgggaacactggttgaaccagtttcctctaagattctgggagcaggacacccccagggataaggagaggaacaggaatcctaaagccctgagcattgcagggcagggggtgctgcctgggtctcctgtgcagagctgtcctgctttgaagctgtctttgcctctgggcacgcggagtcggcttgccttgccccctccggattcaggccgatggggcttgagcccccctgaccctgcccgtgtctccctcgcagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaaggtgggagtgggtggtgccggactggccctgcggcggggcgggtgagggcggctgccttcctcatgccaactcctgccacctgcagggaccctgaaggccaagaacttcaagaagagatgcctgcaggccaccatcacccaggacagcacctacggggatgaagactgcctgtacctcaacatttgggtgccccagggcaggaagcaaggtctgcctcccctctactccccaagggaccctcccatgcagccactgccccgggtctactcctggcttgagtctgggggctgcaaagctgaacttccatgaaatcccacagaggcggggaggggagcgcccactgccgttgcccagcctggggcagggcagcgccttggagcacctccctgtcttggccccaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtgcgtgggtgccttcggccctgaggtggggcgaccagcatgctgagcccagcagggagattttcctcagcacccctcaccccaaacaaccagtggcggttcacagaaagacccggaagctggagtagaatcatgagatgcaggaggcccttggtagctgtagtaaaataaaagatgctgcagaggccgggagagatggctcacgcctgtaatcccagcactttaggaggcccacacaggtgggtcacttgagcgcagaagttcaagaccagcctgaaaatcactgggagacccccatctctacacaaaaattaaaaattagctggggactgggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggactggggcaggggcaggagaggtgcatgggcctgaccatcctgcccccgacaaacaccaccccctccagcaccacaccaacccaacctcctggggacccaccccatacagcaccgcacccgactcagcctcctggggacccacccactccagcaaccaacgtgacctagtctcctggggacccaccccctccagcaccctacccgacccagcttcttagggacccaccatttgccaactggggctctgccatggccccaactctgttgagggcatttccaccccacctatgctgatctcccctcctggaggccaggcctgggccactggtctctagcaccccctcccctgccctgcccccaggtaactatggccttcgggatcagcacatggccattgcttgggtgaagaggaatatcgcggccttcgggggggaccccaacaacatcacgctcttcggggagtctgctggaggtgccagcgtctctctgcaggtctcgggatccctgtggggagggcctgccccacaggttgagaggaagctcaaacgggaaggggagggtgggaggaggagcgtggagctggggctgtggtgctggggtgtccttgtcccagcgtggggtgggcagagtggggagcggccttggtgacgggatttctgggtcccgtagaccctctccccctacaacaagggcctcatccggcgagccatcagccagagcggcgtggccctgagtccctgggtcatccagaaaaacccactcttctgggccaaaaaggtaaacggaggagggcagggctgggcggggtgggggctgtccacatttccgttctttatcctggaccccatccttgccttcaaatggttctgagccctgagctccggcctcacctacctgctggccttggttctgcccccaggtggctgagaaggtgggttgccctgtgggtgatgccgccaggatggcccagtgtctgaaggttactgatccccgagccctgacgctggcctataaggtgccgctggcaggcctggagtgtgagtagctgctcgggttggcccatggggtctcgaggtgggggttgaggggggtactgccagggagtactccggaggagagaggaaggtgccagagctgcggtcttgtcctgtcaccaactagctggtgtctcccctcgaaggccccagctgtaagggagagggggtgccgtttcttctttttttttgagatggagtctcactgttgcccaggctggagtgcagtgtcacgatctcagctcactgcaacctccacctcctgggttcaagtgattctctgactcaacctcccatgtagctgggactacaggcacatgccaccatgcccagataatttttctgtgtgtttagtagggatggagtttcatcgtgttagctaggatgatctcggtcttgggacctcatgatctgcccacctcggcctcccaaagtgctggaattacaggcgtgagccactgtgcccggccccttctttattcttatctcccatgagttacagactcccctttgagaagctgatgaacatttggggccccctcccccacctcatgcattcatatgcagtcatttgcatataattttagggagactcatagacctcagaccaagagcctttgtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaaacctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcagggaaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaaattatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgtcggtgtctttctttgctcccaaggctaagctgcaggatctgcctggcaattgcaggcttgctttttcatgcccagctcatcttatctttggccagaggcggcctcaggttgacctctgtagtcctttgactcaacccttgggtcttgggcaccttccttacttgcagccaccatgatggtgcaggctccagcccctccctggcatttcctgccatggacccggcccaaccatctccgcagggtgcactccttcgtcggtgtgaatatggtgtttagagaccccaatctggtcaccaggggtggtgcttgctcctgggatttcgttactgctagggctttggaagagacagagccaggaaataagtatttttttttaaccagtaaaaaaaaaaaaaagtatgaggccgggcacagtggctcacacctgtagtcccagcactttgggaggctgaggcaggaggatcacttgaggtcaggagttggagactagcctggccaacatggtgaaaccccatctgtactaaaaatacaaaaaattagccaggtgtggtagtgcgcacctgaggtcccagctgaggcaggagaatcacttgagctcgggaggtagaggctgcagtgagccgagatcgcaccactgcacttgagcctgggcaacagagcaaggcaccatctcaaataataataaaagtatgaattcatacaggtatttcccagttgtaagactgtcaggttttacttctctcattttacacttgtttctttctccgcctatgctgaaagtctgggttcgacagcaccaacataattgtttatgttctttttcctataacatacatatgctagttttgaaatataagatataggccgggtgcagtggctcacgcctgtaatcccagcgctttgggaggccaaggcaggcggatcacgaggtcaggagatcgagaccatcctggctaacacgatgaaaccccgtctctactaaaaaaatacaaaaaaagttagccaggcacggtggcgggcacctgtagtcccagctactcgggaggctgaggcaggagaatggtgggaacctgggaggcagagcttgcagtgagctgagatcacgccactgcactccaggctgggcgacagagcgagactccgtctcaaaaaaaaaaaaagaaatataagatattgcaataaatcatatgagttacatttaaagtacatgaatttaaataaattataaattatataaagtaatatatgataaaatattaagactactaaggatcatttaagatcgttttgctcattctccttaaattatcccacagaataaacaattgtgcctctaggtcccttaagtaactctgtggttacttaattggtagattaagccatctaccgatacacagttagaagtttggggtttttttaatcatgcagatgtagacactgaccaaagacttcttgttttttcctttgagactgagtttcgctcttatcacccaggctagggtgcaatggcatgatcttagctcactgcaacctctgcctcctgggttcaagctattctcctgcctcaggttcctgagtagctgggcctacaggcgtgcgccactacgttcggctgattttttttgacttttagtagagacagagtttcaccattttggccaggctgatcttgaactcttgacctcaggtgatctgcccgcctcagcctcccaatgtgctgggattacaggcatgagccactgtgctcagcccctacctaggacttttaagcggatgtttctctgcctgaaaacaaagtttaagtgttccttttagagcaacctgtaaacagtaactgtagaccctgatatttattgtgccatgaacttctcatccatagttttgctgagtgaaggtattgatgggaaatgtgaaattcagagaggcaggcacgggcccaggccacacagctggggagcggcagcattggttgggacctgtgttggatttgcaattc

SEQ ID NO: 15719 - DNA, 8372 bp, Human
gtggttggattgggatccccgtttagcagatatgagcactgaggctcagtgatgagccttacagcaggcaagggctgggcctgagcttggccccctgtgcagagcccccagtccaaactcttgatgcccccaggctctgggccagggggaagcaggcctgggcatagtcgggtccctcttctgcctggctgtggttcatctccttggggaaggggtgagtccctggcccttttccaagctgcattctctaatctcccacctcccaccctgctcctgggccaaggccttatcacccaggccctcactgctgttctgaagcagctgtgatccctctcccgccttctccggaccctatcacccctgcagccttgcatggcggctggcccaaggggtgggggggtgggactcctctgacgcctcaggcatgggcctggtgtcggcctgggtgcagcgtgggggcagaaaggatagaggaccaccagaagatgctctccagagtgcccgggggaacctcacaggctgagtgcagggatgtgaaccattctgggggccaggcagggctctcagctccagagggctctgcaggggaagccaggagtcctggggtggtcaagttggtccagccctgtcactccctgactctgcctgggatggtcccttgactgatgtggtccttggtttcttctcccactccctgactggtggggttggtagtgatgctgggctgcccacggaagctgggggctgttcgcctcttctcctgtgtccatgaaacctcaggcctccaggtgcagtggagttgggggtcctctcaggtcttgagtccccacaccccactcctcagagagagaaagcccctgtctctctagggaacagactctgggccagggctgtggacaaggcgcagccgtgctctggcggctgtggcttgcggcttgcaggagcacgtggattggcaatgtcccctcgtttgctgcagcttctctgccagagcccccagtgatagacactgaacacctgtgatgcacctgtcagcactgcaagcctggacatccccacttacagcaaaggggataggcccagagaggttaagtgtgtgtcccaaattgcacagcaagtgaactgagattctaacccacgaaccactgattccaaaacctaagctcagaccacccgtttctatggcctctgaaggtgaatctcactggtacccaaatgtagctttctagaattggggtccactgtgtgtcacagagggagaccccagtccctgcctttccttttctgctccattgcagcccaggtcatgccaatgggagcaggcttgtctgagcgttttctagggggcgatgcattcatttcctggtgaaggagcagtgagggaagttaggatttgtagctgccgtaacaaaatagcacaaacaggtggcttaaaaccaacagaaatttattctttcatggttctgggatctagaaatccaaaatcgaggtgtccgcaaagtgggttctttctgcagacgccaggggagagggtttcatgcccctctctgagttctggcggctgtcggcactgcctggcattctctggctgatagaagctccgagttctggcggctgtcggcactgcctggcattctctggctgatagaagtgtcactctctgctctgttgtcggcacacggcgttctccctgggtgtctgtgtctctgggtccaaatttccatcttcttataaggacacgagtcatcttggattgagggcccatcctaacccggaatgacctcatcataacttgattacatctgcaaaaacaccctattgctaataaggtcacattcacaggttctgggtggacatgaactttgggggccactgttcaacccagtatagctggtgttttatctcaggaggaggttctgagatatggaggggtattgttctcttgtccttcctaaccgctcccatccctcccccttgcaggtgtggggtgcacactgaaaatgccacgctccttcctggtgaagagcaagaaggctcacacctaccaccagccccgtgtgcaggaagatgaaccgctctggcctcctgcccttaccccgggtgagtcagagcccgggctggcgcctgctgcacccacggggggctctctgctctgcgtgatgagggtgcagcagcgtccctcctgcagcagcctcttcttccaagtctggaaacaggagtgcagtaactgtgggttgcagatgaaaggagtagacaaatgagtgatgccctcatcccttctgccctgttagggagacgagagtgtcaggttggagccagtacttagttactggcatgtggggcctcactggaggcccagtctagggctggagttgggttgctcagaaaaacagactggtccaaagtcttccccggggtctcctcctggcctcttcttgccgccgcctgctctgggcagagcccgggagtgtgagccgccagaagcagcggcacgtggctgtctctctgggcctcctcctcctaggaagggcgtgccctccttgctccctctgggcttcccagaaactgtggctattgatgctgatggtcctatctccccacagtgcccagagaccaggctccaagcaacagccctgtccttagcactctattcccaaaccagtgcctggactggaccaacctcaaacgagagccggagctggagcaggaccagaacttggccaggatggccccggcaccaggtaccccgctgtgacccactgtcattccccagggagtgccaaggggaggaaggatgaagggactcttgcagcagggccccttggggccctggagtcaggaaggacccacgaagtcactggatgcagcccgggctctgtggcttctgcttgggcctctcagacagggagctaattccccgacgtgggctaggtgggagaagaggccagaagcagcagctgggccggtccgtgcagggagtgaggtgggcactgtggagtgaggctgggggtgtctctgggctggaaaagctgaggagccacagtgaggacccagacattcctggcagtaagtatctgggttgacaccctgaaaccctccacatgaggtgatgaaggtagtggtgtgtggtagagggtggtgggaagggggtgccctgtgtttattttatttcattttattttttgagacagtgtctcactctgttgcccaggctggagtgcagtggcacgatctcaactcactgcaacctctgcctcccaggttcaagcaattctcctgcctcagcctccctagtagctgggattataggcgtgagccaccacgcctggctaatttttgtattttttggtagagacagagtttcaccacgttggtccgcctggtcttgaactcccgacctcaagtgacccacttgcctcagcctcccaaagtgctggaattgcaggcatgagccacgccactgtgcccaaccccctgtgtttaaatgagtaaccaggcctgtgtcgttatctccacagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtgggcagcggggggtgtggtgggcacctgggccctcctctccgcactccctctcaactcactggcagctctgggcgttctctgtgctgtgaatgttggggctctggtgggattaaggattcaaaacgttcatcctcatcaccattcattgagctctgaccacgtgcctggccctgtgctaagcaattgacaggcatgagtgccagagtcagatgaaaggttaaggttcagagaggttaagtcacttttccaggatcagacagcaagtagatatcagaaccagcattcaaacccagcttcggccaactcccagctcttaaccactgggctattcagcctctagatgaggcaaggaggggcctccagatcccctctctcacatccaactttgtagaagggagactgagccacagagaggcaaacggacctccctgggacacacagcaagcaagcagcagaactggcaatccagtgccccttactctgtgtacccagccttggccagagctgggcatggaagagaccatgggaccccaggcctgtccctgtcaccgcagcccccagtggcctcacatgctgcccctgctcccaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggtgggcacctggcccagcgcaggactcccagccccactccttctctgtgcttccccagggagcctgggggctgtggctgggtccctccccctgcccctgggggtgacacagattgggaggggtcccctagtacccacctccctgggtctgggtctccaacacctgcccttaacaaacttcagactcttaactaaaccaccgtgcagaccacaaccatccctgcctcaaggaactcactctaggttaatggtcatgaaatgtgaacccctaaagaacctctgagatcagtcagtccatcagtcaatcaacgaacatttattgaggtttattttgagcgggataccgtgaagattacaaggaaaaatcccacaggagaccaatgagactccaagccccagtttcacctcagaggcagagatgaggggtcccccggtcctgctcctccaggccgccccaatggagtgtcctgttccgcaggggatcccggccgggtccagtcctgagcctgcacctgaccccccggggcctcatttcctccggcaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagtgagtctcacctgcctgtgccccctgggcagagcacccccacctttccctgagagatgcatcagaggcccccagcgtgaggctgggggcggggtctagttacaaagtcaaaggccactgctgatggagggctgggcacctgtgctacttaagtgcacttaatgcatggaaaaaaatacagggaggaaacagcaaaatctcaacactgttgatctcatggcagacatgagactagcaggcgaactgctcattcatttgttcactcattcactcactcacttgctcattcatttgttcactcatttgctcatttattcacacattcgctcactcatttgctcattcatttgttcactcattcattcatttgctcattcatttgttcactcattcatttgctcattcatttgttcagtcattcattcatttgttcactcatttgctcattcatttgttcactcattcattcatttgttcactcatttgctcattcatttgttcactcattcattcatttgttgattcatttgttcactcattcactcatttgctcatttattcacacattcgctcactcatttgctcattcatttgttcactcattcatttgcttattcattcattcactcattcattcacttgcttattcattgcctccttgctattagctgagtgcctcttttgtgccaggtataccaggcttggagatgtattgataaacaagatgactcggcagctgcccctaaccaccctataatccagtaggggtggaggagggtccaagttgtatctttgcttctctctcttttctaattattttctaaagtgaatgtgagttggccatgagagaaaacacaggaaggtattggaaaatgaacccgggggcagggcaggggagcagcaggcctggtgaggaggccctgaccccgcccttgctgtgctgcgctgccctccctgcaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacagatttgctgccatgtgaccagcatttattaagtgcctatgaggtccagggtactgcacgaggctttggggagtgatgcggggaggcttgaggagcagagaaagccatggaggtgctcataggcaagttgtggagaagtgtactcagcccccacgtgcacagacccgctgacgagccaggagcaagcagaaggggcccgtgcgacaagaccacaggggtgggcaaggctagtgcagctggggcggtatccgtttcctgtggctgctgtgacaaatgaccacaaacttagtggcttaaaacaacacacatttattctcttaaattctagaggccagaaactcaaaatgagtctcatggggctaacatcaaggtgttagcaggactgcattcctgcagcaggctcccaggagagtctgttttcctgtctctcaccttcccaaggccgtctgtgcctctgatcttggccccttcctctgccttcaaagcacataacttggatctctgcttctgcctccatctctgtcttctgctttcaaccttcttgcctctctcttataaagacccttctgattacactgagctcaggtataaatcatcccatctcaagatcctgaacgtaatcaccgtgattggctgaataatggccccaaagatgatatccacatcctaaccctggaacctatgagtgtgacgctatagggtaaaagggactttgcaggtgtgatgaagctgagcctggtgccacacctgtctagctgtgtgacttcaggtgagttcctgaacctctctggggctcagcttcctcctctgtaaaatggtaaacacagcagtcccttccaccgattcgctgagaccattcttacaaagtggcatacaggtccagcccagcacgtagtaagtgctgccgagttgtgaacattcctttttgaagtcctgtccatcctacaaggcccacttagccatctcctccatgaagcctccctgggtcatccagccagaaggtcttctctctcctctgataccgagcaactcagtctctttgcttacagcttaggagccattgaatgtggaatgcagttatgtgtggataacttcaggaggtcttctgtctgagctccagccgcaccccaccccccatcccacaccaatcctgtgcctggcccacagccatggacacctctgaatgaacttgcaggtactgagctaagccaagggtttccatacattgtctctaacccacacaaccttctgcaatggaatgccattctcccattttacagatggggcaactgaggcccagagaggtcagacataaaaaaaaaacacagatatgggccaggcgctcacgcctgtaatcccagcactt

SEQ ID NO: 15720 - DNA, 12840 bp, Human
aaagtgtggccagtcccatttcacagaagagaacacggaggctccgggtaattctgggagccactcacttgtgtcccctcgctgggtaggggcgcctggctcagaggcccccagcaaaggaggacagatcctaaaccggacagcaagctgcgtccagctggttctccctttccgtgactgcttcaaagctcttataaacaaggtaaggttttccccacaaatcgcttcatttctccacccgcaccctaccatggccccggacctgcggttctcggccccccgagctgggcctgctgcatcctaggcagagttctaggcggctagcggaagccaggcccaggggtcagctcaggcgctcggtcccccgggatcctgctcccaggccgcagggaaggggctctgggaccgcaggggcggggcctgcggtaggtgggcggggctgcggcgccctctttcccgtctggcttctcttttctgtcctctttcctgtctgtcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtaagtctgcaccccgtagggacagtcgcgctcccttggccccacccagtccctgccacgcaaggggccaaggaggagggccctgagcccaggaggtgcgcatctcggacccagggtcccgggtcccgaccacggactggggccggcggcgctcggggctgggctctgcgttcgcgggaggcgggggcgagacggggcttggaggcccgagtggggaaactgaggccccagaggaagagagagggagagggcttgccggacactcccgagtggcagcggcctaatccccaggaccccggctctccgctcactgtggcccgggctgcgcccagcgttttacagccgttcccgcgtgtcctccccccgggcgccgcgtgccgccccccatccactgaggccgggagcaggggatgactggcccaaggtcaacgagccagcgagttgaggcgcgttcccatcgttccgtggagaacccgggccctgcctcccggagaggtggacagcggccacctcgctcccctcggggaatcctgggcgccccttcccgcgcatcctgcgctgggactgcatgtgtcctcgctgtgcctcggtgcttgatttccagcggacggtggactggcccatgcacccctcccggcggcctcggctcacctctgacaatggacctagtacggagacgcgggagccaaggcagggatccgccttcgcggcctctgcgaagtcggtcccagcccctctcccaaaggacagctggaagcaacagctgagcaccgagccactgccaccgtgcgcctcccagagctgccagagctgagcccggggtccagcgggacctagagtccacatgaccgcagtgggtgaccgagggagggcagggctgcagggctggggtcaccgtctccccataaagagcattcctggcccggtgcagtggctcaagcctgtcatcccagcactttgggaggccgaggcgggtggatcacctgaggtcaggacaccagcctgaccaacatggagaaacctcttctctactaaaaatacaaaaattagctgggcatggtggcttgtgcctgtaatcccagctactcaggaggctgagacaagagaatcgcttgaacccaagagaagaggttgcagtgaatggagattgcgccactgcactccagcccagttgacaagagtgaaactctatctcaaaacaacaaaagtgttcctttgcaggtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtggtgagtctgccccacggagctccccctgtctctatccccacccaggactccccctgtctctatccccacccaggactccccctgtctctatccccacccaggactccccctgtctctatccccacccaggactccccctgtctctatccccacccaggactccccctgtctctatccccacccaggacttcccctgtctctatccccacccaggactctccctgtctctatccccacccaggactccccctgtctctgcagatcaaccccaaaaccttgatctcctcataggattccagatcccaccaacccctcctgactcacctgttctccaaccccagccccaacaagacccaactagtgtctccggcttctgaattctgccttgtactggcctcctggcctttgacttgctcttttctctgcctggatcatccttcaaccaatgttgatggggaatccccgttcacgctcccaaattcaccctctgtttctgtccttccatgaagctcctggggctgcccctcaccctgctgtttgtgtggggggcctggcatcaagaatatacactccctaggaatgaatgactctatgggtgaatgaatgactgcatggcaggccctgtgacacatgccaggaataccagcaggctttgtcctccaaggtcagccagacctacagaatgacaggggacctggcctcctaatgcactgtgggagacctgcactcccaatgacgtgcatgaggtgcgttttcagcctctggtgcagagtggatcaacagattttttttcttttttttattcacagggtgtatcttgagaactggctgccagtctcctatgtcccctattatctcccctgcccagagatcttgtaagtatgggtgtggctaggagaactgggggccctgagggctgctcacagttggggagacaggagagtatttaagttcacttcatctgccggttcctgattcctaagttcatgtttctgataaatgcaatagtatttatgtaatttaagggctgtgacaagcgtgaagtgaaattcccatttcggtcttccagcatccttgcagccccctgcatggtctgaccgtccacatgttgcacagctgtgagccttgcttgctgtgtctggccactgagaacacagagtgcaaagatgcccataaacagcctgctgttgctcccggtgaccagcaggggttgtgttcagtgcttttaggacttgaccttgttgctcaattttgtgttccatggattcaaggaacaaatgaacatgtgaccaaagtcctcctcaactaaggagtcttttttttttttttcttgagtcagagtctcactctgtcgccctggctggagtgcagtggcgtgatcttggctcacagcaacctccacctccccagttcaagagattgtcctgtctcagcctcccaagtagctgggattacaggcacccgccaccatacctggctaatttttgtatttttatttgagatggcgtttcaccatgttggccaggctggtctcaaactcctgacctcaagtgttccacctgcctcagcctcccaaagtgctgagattacaggcatgagctactgcatcggtccggtcaccatcatcttattccacccagggactgacacataatttttgagcctctctctctttcccaccaccaattgctctcgggatttaggttgctcccaatttcccagggctctcagttagtttgtgatgagcagcataaccctttctccatttcaaagatcattttgttcagatatgttcccttagtggccggaggatgtggataggttctgatccaactcattgggttatttccagaaggaccacagcacatcagtcactcattcatgtgccctgcccaagcagtacccagcaaagccaccgtgtagtacacctgggctactgctgggaataccagaggttatgaaaacaaaaatgaacctaccttgctgattgggagagggaaaatgctatcctctttggtataaattttatttattattattattattattattattattattatattgagacagagtctcgctttgccacccaggctggagtaccgtggcgtgatctcagctcattgcaacctccacctcccgggttcaagcaattgtcatgcctcagccacctgaatagctgggattacaggcacacacgctaatttttgtatttttagtagaaacagcatttcatcatgttggccaggttggtctttgcccccttcggccaggcttcgccccctcatcggcctcccaaagtgctgggattaaaggcgtgaaccaccacccctggccttaatttttttttttttttattattactagtgagactctcatttccctacgtcttcccgttaattgaaatttttcttgtgtgaagtgcttcttccccaccttctctgtttggtccgtttgtgggttctctatcatcactcttggctaagtatacctacaacttttttttttctttccagtttgtctatcttgtgtgtgtgcgtggcggagggagataaggtctggctctgttgcccaggctggagtgcagtggcacgatcacagctcactacagccttgacctcctgggctcaagtgatcctcacactttagcctcctgagtagctaggaccacagatactcaccaccacacctcctagctaatttttttttatttgtttgtagagacagggtctcactatgttgcccaggctggtctggaactcctggcctcaaggggtcgtcccaactcgcccctgccgggattgcgggcatgagccaccacaccggcctgcttttgtattcttgtatgtaactcttcactgcagctggagtgtgtctgggcttgtggagagaaaagaggagctcgctgccagggaggcacagaatgctgggctgtttggtaccccttctaactcctgaccgcttcttggaatcccagggctttctgagcagggccctgaaacatgctttcttgtaggaaactagggcagagggccaatttgacgaactgactttaaaaaattgttgattcaagagtagcaacttggctgggtgtagcggcttatgcctgtaatcccagcactttgggaggccgaggctggtggatcacttgagctcaggagttcaagaccagcctggccaacatgatgaaaccccatctctaataaaaatacaaaaattggcggggtgtggtggcacacacctgtagtcccagctacttgggaggctgaggcaggagaatcacttgatcccaggaggctaaggttacagtgagccaagatcacaccactgcactccagctgggatgacaaggttactgagactccatctaaaaaaagaaaaaaaaaagtagctactaatcacaaaaggacaaaaactttattattccacttataggaagtactttccatactcaagttcatagaggcagaagtagaattatggttcccaggggctgggggcggggcaacggcaagctgttgtttaatgaggaccgagcttccttttgggatgatgaaaaagttctggacacaaatgttggatggttgcatgacaatgtgaatgtacctaatgccactgaattgtacacttaaagatggctaaagtagtaaatcttgtgttttgtatactttaccacaaataaaagagcatagcctagaggtggaagagttcaaggaggcttcagccaccccatcatacatgatgtattgaaactcacaggggaccaggcaaggcagctcatgcctgtaatcccagcactttgggaagccaagacaggcagatcacttgagctcaggagttcaagaccagcctgggcaacatggtgaaacccagtctgtacaaaaaatattaatacaaaaacagctgggtgtggtggtgggcacctgtggtctcagctcctcagggtgctggtgtgggaggaccgcttgagctcaggcagtcaagactgcagttagccgagattgtgccactgcactccagcctgggcaacacagatagaccccacctcaaaaaagaaaagaaagaaagaaaagaaacttacaaggacctggcagactactgtgtcatcagtgggtgggatccttatgagcttctgcctggggacagtcggcctcgggccttttgttgctgctgctggctgggtggcctttcccttttttttgagatgcagtcttgctctgtcgccaggctggagtgcagtggcgggatctcggctcactgcaccctcagcctcccgggttcaagcgattctcctccctcagcctcccaagtagctgggactacaggtgcccaccaccacgcccagctaatttttgtatttttagtagaaatggggtttcaccatgttgcccaggatggtctcgatctctcgaccttgtgatctgcccgctttggcctcccaaagtgctgggattacaggcatgagccaccacgcccggccggtctttcccttctctgcacctcgcttccacctgctggaaacactctaagtggatggttttattgtccccattttgtggatgaggaaactaaagttcacagggtcaactgtctggctccaggtccctgggccagttagtggcagagccagaggtgagcccaggggtctgaccctacagccctggcacctccttcatggacccccttctttcttctccaaccagtttgaccttgaaactgaccatggaggctgcctgccaagacttgcccaggatccctcaccttactgagcacttgctccatgctggacatggtcaagagcccctcacacaccttgtgtaactctcaccacatcgctaaggctaaggatggttttgcccattttgcagatgcagagaaatggcagtcagtgttccactagagaaacagaaccagtaagaggtaggaaggtagacagatggccaacatacctaggaaaattgacttatgtgatggtgaggctggctaagcagctgaaactcagataggagcagacaccacagcccacaggtgaagttcttttttttttttttttttttgagacagggtctcactttgtgggtggcccaggctggagtgcagtagtgtgattacagctcactacagcctccacctcctgggctcaagccatcctcctgcttcagcctcccaagtagccaggaccacaggtgcacaccaccatacccagctaatttttgttgtttttgtagagatgaggtcttgccatgttgcccaggctggtcttgaactactgggctcaagcgctttgcccgcgttgggcccccaaagtgctgggactacaggtgtgagccacctgggctggccaccagttctgttcttaaggcctttcaaccaattggatcggtcccacccaggttgtctaggatactctcttttatgtaaaatcaactgatatagaatgttaatcacatctacaaaatactttcacagaccagcctgggcgacatagtaagaccccatctctacaaaattttaaaaaatcagccgggggtggtaatgagtgcctggcaggtccagctactcaggaggctaaggcaggaggattgcctacaactgaccattacagtgggctcaggttaattagctcttagctcacccgaggtcccagtcaccaggcctttgcagcttttcttcctttttttttttgagatggaatcttgctctgtcacacaggctgtagtgcaatggtgcgatctcggctcactgcaacctctgcctcctgggttcaagcaattctcctgcctcagcctcccgagtagctgggattacaggcgcccgccaccatgcccagctaatttttgtatttttagtagagacgaggtttcaccatcttggccaggctggtcttgaactcctggccttgtgatccacccgcctccgcctcccaaagtgctgggattacaggcgtgagccaccgcgcctggccctttgcaggttttcacatcttctttccgacaacgagagcgacatggttggaaaagcatcagccttgggagcaagcggcactgggttcgaatcactgccctgccacttactctctcagtgaccctggacagatcacttctgtaggggtccccagctcctctgtagagtcgggtggggctgtgggggaaggtcagagggagcctgcatggaccctgggtgcccacccgcaggggcctctgactcctccttcttcctgtgctgagtgtctctgtccccagacccatgatgatggctctttcttgcctctgccaccagcaacatgaagctgcactacaagagggagaagccactccagcccgtggtatggtaaggagactggcatttcctcttttgtggccgtgagggtggtggctctcctccatcactggtccttcttggttgcaggtcacagtaccctcagcccaagctgctggagcacaggtaggtgtcatggagaggcctgatgggggcgggggaaaaggacaaaagagctctgatttataaggtggggtagtggaggtgctaacatcagggtggccttggggcccagagagttagggactgtggaaagacacagggctgggagtcagggacctgggctgtgtgaccctgggcagcgtacccaactgctctgagctttttctgtgcaggtggatagtagtgcctagctcactggagtttggaggagcagatgagaggtattgtaacatctgcaccgtgcttgcactcaggaggtgctcaggccattgttcataacaacgtggtcttgccctttttaatgaccctcatttattaggggcttggcacatatgaataatgccaggcttctccttggtgtgcgttaactcctggtactcccaaccctgctgggaggtggctatcattatccccactttccatatgaggaaagggaggcccagagatggggacgaagctgccccgggtcacacagtgtgagagccagggctgggatgagacttaggctttcacaggggagggtctcagtgcccacggcccccctgctgccaggcccacacagctgctgacactcacaccctggttggcgcccatcgtctccgagggaaccttcaacccagagcttctgcagcacatctaccagccactgaacctgaccattggggtcacggtgtttgccgtggggaagtgagtagtgggctggggaaggggagggaggtctccctgagccacaggagtttatagttgggaagagaccagaccagacgtgcacacaggaccctgctgggcacccaggaggctcggaaccaggtgccaagcagatagaaagtacagtgtagggtgtgatagtgggatgggagcttcctggagtaggggatctggctctagcatagacaggatgcagagtccaggtgaggggacagcaggagcctttgtcaggaggcccccttgcccctccctgtttcatctagacccctcctctgcccttgtctctcccatgaccccacctggccttcctttaggagctgccgcttggcagccttcctctgggcctctgggactccttcctggaacttcctggggccctaaagcatgaccagatgatgaatggtccacctagggtcaggtgacccccttgtccaatgagttttggcctgggggcagggctgtgtcaaccacacccccctccatgcccccagcatctagctcaacttgccttcccttgattcgtccacttacctgcttcttcactactttcttctctgtgatcctcaatgttcctgcctgtaaaatgggcatgcttatgcagatcaaagatcataagaattcttagaacgtcgctgggcacttagaaattgctcagtaaaagttcacctggcctaggagcataagaatctctaccaggaacatgcttacaacagccgtaagaggctggtactagcattttgggaattggacaaatgaggacccagagggccagagcagagtgacatcttgagatggggagctggtaagtggaccccagcctggctgaccccagcacacagtggggaccctggcaggctgctggtgtagcagtgggtgaccgggtgatcatcactaggtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaaccctagctagggtgattttttttgttttgtttttgttttttttgagaccgagtttcgctcttgtcacccaggctggagttcagtggcgtgatcttggctcactgcaacctctggctcccaggttcaagcgattctcctgcctcagactcccaagtagctgggattacaggtgcccgccacacccagttaatttttgtatttttagtagagacggggtttcaccgtgttggccaggcttgtctcaaactcctggcctcaagtgatccacctgcctcgacctcccaaagtgctgggattacaggtgtgagccactgtgcccggccactaaggtggtttttacctgcacatccagcctgcctgtgtccccagtgtctgttccatcaggcagtggggacacaggcagactggaagtcaaacacaatcgaatagggatatagttactccagaaaatctgagctaaagctagaggctacaacggacaggatttcattccagttctccagggagactgggtgaagtggagcatgctggcagagccaccacactcccaactgtgtagaggggtatggagcccagcagccggacaaccctgggagctcccgtatccagggtcactgcagccctgtgaggtcaccagtgggcgtgggactctgagccaatggtgcaggccaggattagagggcatgggaagatgacctctccagtctggatccagaaggacttcagaggcctacagtgtggttctgtctgcctggccacgcagagatggggtggggtatgggttcagggcttggcggcctggtgctcaccgccctggagacagcagcatctttttcatggaaggagaagacagaaaggagggtggggtagactctggtcatactggaacgggcaggcacccacccacttggtcacccgtggaaaagctggggccagccctgagttcattcttccttcacctgtggtttggctggcgagcagggacagacccgaagagcgtggacagatggagtgaccagttggaggagacagactgggctggagaggcctggagtcttgaaggggcactgagtgcctcctgggcagaggggcaggaatggaaccatggcctctgtgtccctcatagggagcacctgctccaggggaggggttctgtgctgaaggagtaggccctgcctccgaggagcttctgttgaaagcacagagagggccatggagcgctggactcagctgggtggatggctgggagatgggggacctgaggtgacagcagactctgaggcctgggcagctccacctagcaggggagaagtcccccatacccccctcaccccacttacacccagctttacccctggcacaccctcccgggtggga

SEQ ID NO: 15721 - DNA, 49487 bp, Human
  misc_feature (1)...(49487): n = A,T,C or G
tgttaggtggtgacgagcaaagctaactcttagtggagggacaccgagtaccagagaaattctcccagcctagaaggcgggaagagcacactacacaccatttctctaaattctctgaacactcaagccccaagcagcatatgtacaatacctttaacacatctcttggctgacttcttgctggtggcttctaactcgatgccaatttcatcaggatcttgcccctcttctttaaccgcctattagggagagatgagttttacaacatcattaagagctgcagggcacacactgttccttacaagtaacaacctcccatgaaacaaaggcaaacccgtccttgcaaagagcaactccgggtcagctatctgggccgcaagcccaaaaggcggaggaggaaccccgcacaacttgggtctctctgggtccaaatgacaaaggagagggaggctgtgagcaggagctccagaattggggtcaaggaccagttccaaaatggcaactcaactcgacaatgccaaaccttcgactttaaagttatatgatgggacaaattagaacagagaggctgcacttggcccggcctcggtgaagggctggccaccgctggtgaggaggaacagcagccagcctggggagattcaacaggtccctcagtgcctgccacctgccgggtccaggactgggtacccacaagctccctccctatgctcaagttgtttgttccagttgcggaaacagacaattcccaaccccttaatattttgcatttagcccctgctttcagcgaggtgcgacacaaacgcaggatgagctggcaaggaggtggggcagcgcattaggaagggcgctcaggaaggtgatgtctcaggcagacccaaaatgacaacaaggggccggccacgagaagatctgggggacccgggtggacagcttcgtaaaggccaaagccctggggcaagaacaagcaccgccccctttcctgtaaatgctctggagtccgccagacacccattctccggaggaggaaactgaggcacagagagaaaggcacctgcccaaggtcacagagccaaggctcgatcgggagccccaggaggggtcccggggccaccctggtagcggagaagaccgcacgctgagcgcgcttgaggagaaaaggtggaaagaggataggaagggaggcacagagaggagcggtgacgggccaaggtcacacagccggccccctgggtgcccgacacctcgaaccggggtcggccaagacgcggggcgaacccagggcgccccgggtccgggagccgcggtgacaggtgcaggcgggggcgtgcccgggcctcctgcgccacccccgagccccgcgccgcctcaccttcttgagccgctccatcaggacgctcttgttgccgcccgtgtccaggttccgcttcttcagctccgcccgcagatcgatcacccgcagctcgctgagccgcctcgtcccagtctccgcaacgcccgggccgagagaagccgtgccagggcccgagtcgcccgacccgggcagagtctccgccatcgtcgcgttcccgtcttcgccaccgactcagtcgcacaccgccggcagctatagcggctctgaacacaaaatggcgccgcctaagaggaaaacgcactcgtttcctcccgccccgctttgcggccgcgcacgcgcacgcgcaccgcccccactagcgtacttagcagcaaggacgctcgcgcgtccaccaaccgcgggttccccggcacaacgcgcaagcgctgaatctgcagctcgcatgcgtcccggcagttcccggcgggaggctgacgagacgcaacgcgtctgcgcacatccccgcgttgttctcactgcgcatgtgcagttgcaaccgggatactagaacctacgcttggtgcgcctgcgcagaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggtggatttggggccccgagggcgggcacagggtgggtctggggtcctcttggccgcgacggtggctcgcgggccctggcgtccgcccccggccgcgttcgcggcctcgccggacctggcgctctcgcgtcccccggctcctccgaggccccggagagagttccttggccggctgggcctgggttcaaatcctaacgccgcaatggggccaggagaaccacaaaaacggcacgcgtgcaggagaaacggtgacgggtgacatcgtccactgagaggagggttctcccctcgtctcgtcccctcctccgtacctggaggggagaccctgaaaccctcacttcccaggcgaggggaagggactcggccaaggtcacacggccgaggacgggcagcgtcgggatttgaacccaggccctgggattcctgattcggctgcttggtttccccagggaagatgctttgtgacccacaggggaccgaccagcctgaatcggggctgatttacaaaggaaacacccgtaggacatactcaaagggaaaaatagaaaaaaacccaccacaatccagttttcacggtttgccggtactcgctcggtgaagtaacgtggcaggaaggaaaagtggtgttgacggtagtgatcagaaatgtgaaatgaggggagaccccgggtggactttaaaaccagcctcagaactgcccgggaggcgggcagagcctgggctcccccagctccgtcagtctctctggacttggggaccctgccagctctcggtggcctgatcttgggcataggagaccttgaaccccttctgagtcctcttttctattctttttttttttttttctcctgtaagaagcaaaaaagcaataggactttgatttggtgattaaataagtttgcgtggagcaggcttggcgtgctgcctggcgcatgtaaacactcggtgtgtggttgccatcacgattcgcttttcctctctgtgccaccacgagtcctcatttgcagatcgggggctctaacgcctcccttgggggattcaaagggatccctaggaaaagcagagaggcaagtaaaggttagccacctgcggtttccttattcctgtagctttttttctctgccttttttccacctggctactctgggacctctcccctgtagttgctccgcctggccgcccaccccccagcccctgcaggcagtggggctgttgacacatcccaccatcctgactccggaactacggagatcacagggctttattattaattggtgatgagaagaagtagggatttttttttttttttttttcctgatgagaaaccctgggctcaagggtggatagttgtctcggccagagtcacatgggccttttaaaagctcaagcttgtgtttcttttcactatggattctctttactcagataaggcaggaagcccactgatctacatatttacccagagaaaatgcagagagtggagattggcggctggtcaggtgtggtgccccgccaccagggcctcccatcagctaagccaaattaagaggctttatcctttttttctccctggacggtccataggcctgaaaagctgctgtgatcttcctgtcaagctggtgactgagacttcccatcactcgctgtcatctctgagagcacagatttgttccttcttccttctccttttcattttcttcaagatgtggtcccaaaacacgaataccgccagcccatatccctgtctgccactcacccaagccagtctggagttcctgatctcattctcttcccgtttctgtcatcctgttggtgtccctttcttggtttatttttccaggaagggcaaaagaacaaaaaggggaaacaggacacctgcctagggcattgcttctcttctcctggtggtgtttcagaattgcctgtccccgggaaaagggtgagggacttggtgattgtacttttccttgatcccaggaaagaacttcagtcccttttctggcttctgagaggagagatttttgttgctgctggtaaagatgagatgtggaacccccaggccctatctcaattcagacttacccacctgggaaacttggaggcttccaaacctctgcagataaaacatagtacatgaaatgatgtaaacaaaacttgtgctcatgggactggagagtaaagactggaaaagttatcagtaaaacttgacctgaagctaagtttctagggacgtcatcgtgattgacgtgttcggtactgatggcttagttgatgccaggcactgtgctgaggatgggcatagttgaagtgagtgacagagtcctggggtgggaggctgggcgtgccaagaaattcttataattcaatatccgatgaggcacaatcacctagtggttgagaatgaggtactggagtcggttgtgaatgtacatgatggggatcggatgaggtcatgcatgtcgtgacgggtctcgtgcgtaacacatagtaggatcccagtcagcgagcattagtattctgtccacacagtactgagtacaggcacggcgtggagggagtccctggagggttaaagagtattttgtgagtaaagtcaggggaaatggagagtgtgcctttccctttttgagttcttctgggcttaggaaggagatgaaccagataagcctactgtttgttgagtgcttccttttcatggctagtagagtcctcacaacagccttccagggtaagtactgtattattattagccgcatgttccagaggaagaagcaaaaactgagcacctaagtaaacctgcctgggaccacccagctaagaactggtggcgtcagtcggtctccagtgtagagcgagataacagatgagtggatgggccacaggtcctgggtggtgagggcggcagcagctttttgatcttaaaaatacagtttccttgtcacctgagagctctctgaaagcagtgtgtgagctgactttttggatcaactttacttttcccttctttttaggcaattgaagatgaaggtggtaatcctgacgaaattgaaattacctccgagggaaacaagaaaacatcaaagaggtctagcaaaggtatggaggatttcataagcaagtttcatgttaagtgctttcttcaaaacgaatacattgctaatgtgcctcgtttacttgtctgtgtgttggacttgtgaaccactctgaactgggagccttcagcgaagctttgcattttctttcaagatctctctactgtgttttgttttcttggtatctgggaattccaatggaggatggaaggagtatttgtcctttattcattttcctctgtagattgtcagcggtccttaaataaggagtcttttgggagtcagtcacagtggcgtgtgcctgtaattccaggcgactcggggctgtggtaggaggatcacatgagcctgggagttcaagaccagcctgggcaacatagcaaaacccagctctacaaaaaaacttttaaaggcccggtgtggtggcatgcatctgtggtcccagctgcttgggaggctgaaccggaaggattacttgaccccaggaggttgagatcagcttgggcaacatagggagacccccatccccaccaaaaagaaattagccaggcatgatggcatgcacctgtgatcccagctacttgggagttttaggagggggatcacttgagcccaggagctcaagcctgcaatgacctaatgattgcaccactgcactccagcctgggtgacagagcaagacccagtctctcttaaaaaaaaggggggtgggggcggggcacagtgtctctcacctgtaatcccaacactttgggaacccaaggcaggagaatggtttcagtctaggagtttgagaccagcctgggctgcctctatccactgccaaaaaaaaaaagtacctaggcgtcgaggcacgcctgttttcctagctacttgggaggctaaggcgggaggatcatttgaacccaggagttcagggttgcactgagctatcatggcaccactgaactccaacatggagtccaaaaagtaggactgcctgagcctcctattgcttggacttggagaaaataacatcccttataaacagcacttggcaaaaacagaattgtcactttaacatttcttttaaaagcagcttatacagtaaaagtcacattccacatgacatgactctcaccatcttaccgaaatctctcttgcccatcccccacaccctgtgctttagtcaggccccaaacacgtgatttactctcctggttctctgtgacttcgctccgcccacccttccccatctgtctgccttagagacctagttcctcaaaagacaactgatccatcccaccaatagcaactcgtctccttgggtcctctgtcctcccgtggcatagttccttaccccttggtttaatatttatgtcatcttgccttctgtcaagagcagattgatgaggactagggctgtgtcttgtttatctttctttccccttcaatggtttaacttggtaacactcaactattggcttaagaaagaatcagctgaggcagggcgccgtggctcacacctgtaatgccagcactttgggaggttgaggcggactggtcacctgaggtcaggagttcgagaccagcctggccaacatgatgaaaccccgtctctactaaaaatataaaaattagccaggtgtggtggcgggctcctgtaatcccagctactcaggaggctgaggcaggagaattgcctgaacccaggaggtggaggttgcactgagcccagatcgcaccactgcactccagcctgggcgaccgcaagactccatccccctaaaaaaaagaatcagctgaagctgggcttgtagaccgaatgttctcttggttcatgtagagttttccctatctgaaatgcttgggaccagaagggtttcattttttggattttgtgcggtattttcgtacgcataatgagataatcttgggattggggcccaaatctaaacaagaaatttgtttcttatacacctgaagataatttaataccatattttttataattttgtgcatgaaacaaaactttcactaattccacacatcaggtgtggaattttctacttgtggcaatatgtcagtgctcagaaggtttcagtttcagatagggttgcccaacctgtaattgaaggcctggttctcagggcccaaaactaaatgagataataactaatacttggtggtgaagtactgggtttaaatatctgagagtcaggccccagtgtcagccacagtgtttggggtaagtgctgggagaacagcagaatgaagtcacttctgtggctcatgatacattgcgtgtttttgcctttactcaagtatacttctgccaaggcaaagagtcctggaaaatcaatggagaaagaaataataaaagcaaaaaacagagcctgtggatctccttttttgttttcctttttcttctgataaaagcaaatacttgtactacaggcttttgttgctgtttttgttttgtttttgaggtgggttctcactctgtcactcagatggagggtagtcgcgcagtcatagttcgctgcagccttgaactcctggcctcaagcagtgctttcacctcagccccacaaaacgtttagatttcagttgtgagccactgcgcccggcaggttttaaaatacgtgcatgggagtaaaaagcagaagttgttcacagtcgggacagcccactactaaaagttaggcatacttctccagactgtgtgtgtatgtacaatgtttaaaagtaaacttaggcctgggttacagagcaagaccctgtgtctagaaaaacaaaaagttaaataaaagtcaatgagctgggcatggtggcacacacctgtagtcccagctactagggaggccaaggtaggaggattgcttaagcccaagaggtcaaggctgcggtgagccatgagtgtgcttctacactccagcttgggcacagagtgagagggggaaaaaagtaaatatataggtatgtgcacacacctgtatgcatatttttttcattaaaaaaacccgtgatcttgctatacaaaatctcactgttttttaacaggctaataatcttctgtatgaataaatacacaatttagcccatcagtctttttattactagacgtttggagatttttatttccaattatcactcggtacttccaacattcagtgtttgcacgaaccagagataaatacctttgtgtggtcaaagtaatataatttttgataacttagtgaaaggagaattctagactccaaggatatggccctttattttcacatagctagtttacaaatagctgtcccggccaagttcagtggctcacgcctgtaatcctagcactttgggaggctgaggtgggcggatcaaaagatcagcctggccaacatggcaaaaccccacgtctactaaaaatacagaaatttgccaggtgtggtggtgggcgcctgtaatccaagctactcaggtggctaaggcaagaagatagcttgaacctgggagactgaggttgcattgagccaagatagtgccactgcactccagccttggcgacagagtgaggctgtctcaaaaacaaaaacaaaaacaaaaagctgtcccaggttgtaccctaccaacaatgggtgacggtgcctatttcactaaactcaacatcaaacttaccttgtttgcctgttaccttgttgcctgttatatagaagaaaagtatttcattgtatttatctgcatttttctgcaggtgagattttcgtttgcatttcttcacagattatactcttctgataattggacatttgtgtcgtctgaatggccttttcatgccctttgccgatttctgtgctgggttgtttgtcttattgagttataaagactcatataaaatgtttctattgttttaatctgtcattcaatttaatctgattcgacttgtggtattttgatcactaggcttctagattttatgttacgctttaaaaggacttctttgcttttaaattattaaaaatatgactgtaaggccaggtgcggtggcacacgtccgtaatcccacgatgcaggtggatcacctgaggtcaggagttcaacaccagcctggccaacatggtgaaaccctgtctctactaaaaatacaaaaattatctgggtgtggtggcaagcgcctgtaatcctagctacttgagaggctgaggcaggaaaatcgcttgaacccgggaagcagaggttgcagtgagccgagatcacgccactgcactccagcctgggcgacgagtgaagcttcgtctcaaaaaaaaaaaaaactatatgtataactctgttatatatagaaagaataatatttatggttttatttttacattttacatttggaggtttaattaatttagaatgtattttgcatgtggtgtgaggtaggtagggatgaaaacatgaaacatttaggctgggcgtggtggctcatgcctgtaatcccagcactttgggaggctgaggcgggcagatcacctgaggtcaggagttcgagaccagcctggccaacatggtgaaaccccgtctactaaaaatacaaaaattagctgggcatggtggcggatgcctgtaatcccagctactcgggagactgaggcaggagaatcacttgagcctgggaggcggaggttgcagtgagctgagatcatgctgctgcactccagcctgggcaacagtgcaagactgtgtctcaaaaaaaaagaaaagaaacatttgtcatcagaaagatcacttctgcccctcccagtgcgtctcccctcccagcccctgcaaaaataaaagtcgctgttgtgattacttcaccagatattagttttacccattctagaacttcatgtaaaatggagccatgcaatactagctcttttgtgtctcatttgttgttttgttttgcttcttgtaatcagttttattctagaaatttacagtacattttgatatctgatagggcaggtcggtaagttttcttgaattattttcaactactttatcagtgggttttatcaagattttaactgaaaatagagggactgctgtaatgtgtgaattcaaaatgctttaaaattccagaaagcatatctcatgtaatctcagttctcctcctattgcttggacttggagaaaatgacatcccttttaaacagcacttggccaaaacagaattgtcactttaacattttttttaaaaactgcttatacagcaaaagtcacattccacatgacgtgactctcaccatcttagcagactctcaaaataattatcaggggctgtgcgagatggctctcgtctgtaagcccaacagtttgggacaccgacgcggaaggatgacttgagcccaggagttggagagcagcctgggtgacatagtgagaccccatctctccaaaaaattagaaaaattagtcagatgtgatggcgtgcatctgtagtcccagctactcaggagactgaggtgggaggatcacgtgagtccaggaatttgaggttgcagtgaaccatgattgggctgtgattgctctccaacctggtaacagggcaagactctgtctcgaaaaaataaaataattaccaggaaactaaatttatttgtagtgtcatcacaaagtacaaattaataggatgttttatggtgtttgagaatgttttgtaactggagatgcaaagttggcctgtttgcttggttaagtattacccaatcctttgctgctggcttgttttgttcagtttttgttcattttggcaatttcatacttaagttgcaagaataatgcaaggaattcccatataccctttacccagagtccccaaatattgccatctgactacatttgccttgtccttttctctccttgtatgtatgtttttactagaccgcatggtaagttgcaaggcgcatatgcccctttgccctacgtactgcagtaaagtaaggatattacctaactgtagatgtccagatcaggaaattaacattgatacaatactgccacctcgtcttagtcctcatttagattcagtagtttgttccaataatattctctataactcagacaaaaaatgtccagagtcatgcattgcatcaggttgtcatgtttccttagttttctttaatcttgaacacttacacttattttgtagtttatttttctatttgaattgttttgggttctccccgccccataataaggatcaagttatacgcttgtcagaaatacaccagacatgttgtattcctgttttttgttttgttttggtttgaaaccgggtcttgccctgttacccaggccagagtgcaatggtgcaattgtaggtcactgcaaccctgaattgctgtgctcaagcgatcctcccaccttggcctcccaaagagttgggattacagacatgagccaccacgcccagcctatattgtcatcagagtatactatccagaggcacatgctgtcagtttgagccattattggccatgttagctgacttcaaatgctattggccaggtttctccactggaaagttactgtcttccttttcacagttacatttgtggggaagatactctgagactttgtaaatatcctgctcatcgtccattagttttagcaaccaccagttcctgtctattcatttattctggtagttgccaaatggtgattttttaattttgttattgtttgtttattacttggtttactgacataaggaatagcttgccctttgccctcatttatctgtgtgaacttagattattttattccataggttgaaagcctttatgcttatttactacaatgtgcaaaacgttccattgggaaccctgtcagacaggctcccctgtcatttccacatgttcatgccattcttgggatacttttttaccttctggaatggcagggtacgtgagtctcatcttatgcttttcctgccctttccccggaatcagccatttcttccaggtgccctgggcccttttgaggagagctattagaaaccagggtctgcagccaggcgcggtggctcacgcctgtaatcccagcactttgggaggccgaggcaggcggatcatgaggtcgggagatcgagaccatcctggctaacacggtgaaaccccatctctactaaaaatacaaaaaattaggcaggcgtggtggcgggcgcctgtagtcccagctactcgggaggctgaggcaggagaatggcgtgaacccgggaggtggagcttgcagtgagccgagattgcgccactgcactccagcctgggcgacagagcgagactccgtctcaaaaaaaaaaaaagaaaaaagaaaccagggtcttggaacttagatgtacttctgtaactaggatgtcaactcctgggccagtacttggtttgtgagagctactgggctgattgtacctcaggaaattaagtactgttaaagcaatccgaagcaagccaaagacagcttaagaaaggtgacaaagccctcatgaacagtttggcaaacttgctagctggttaaaattgttaatcacttctccaggattttttaggtgacagttatatcattagtgaatcaaagaattaagcatgttgccagattgacattgaaatgtacataacattcttaaatagtaaatagaattaacaggaaattttcaagtcctgcgaaatcactaattagagaaaaatttcctagatgtgatgactttttagcagagaaaattttcctagatatgatgactttttatcagaaaattgtcacttttctccacagtaacctaaaaggaaattttataatgtgttccataatagtctaaaaagaaaatgcacaagaataactaaaattctgggcgggggggaatacagggatttcctctaattttgatgataggatattgcaaacaacagaaagtttgagggtttgttcatttgatggtgggggaaagctctaatcttatctcttcttgtgtaaaatagaaattccagctagtttaatactttttataatatagtaataagaaagacctgaagtaagaataaaactgagaaacaacaaagaaagagaaatttggctacataaaagttttaactctctgttaagaaaggtatgcaacagtctgggagaaaatattatagcacagaataaggaagaaactcatatccagaaagcattgaatgttctgacaaatcagtaaggaaaacaggcaacccagtcaacaaggagcagagactatgaacaggcaatttacaaataaatgaaaaagcagatgtggcctagagaccaaaagattcccttgctggtagttgcagaatagcaaattttgaaatgacataagatttttgcctatcaaactggtaaaaatttacacagttccgcaaggtgcggtgactcaaacctgtaatcctagcactttgggaggctgaggtgggcgggtcactctaggtaaagagtttgagaccagcctggccaacatggagaaaccttgtctctacaaaaaaatacaaaattaaccgggtgtggtggcacgtgccggtaatcccagctactcgggaggctgaggcaggagaatcacttgaacccaggaggcggaggttccggtgagccgagatcacgccattgcactccagcctgggcaacaagagcgaaactccatctcaaaaaaaaattttttttacacagttcctgttctcctacattggcaagggtattggggaaggtgtaggtgttggagacaataaattgctacagcctttttgagaaggcagctaacgtggggaactgccgtagcatggagtcaaagatggaggtggatcaatacgcagtacataaaaatgtccaaggcctgttagtagtttctgtaacttgtgtcattgctcactaacaataagatttcatctcatcacaagcttatttccatatgtatcatataatgtatgtagatgcaagatgatgtcctgaggcaccaccaagctgggaacgttggtaacctcttaagaggacagtagggaaaagggaaggtattatagctttatacttcctatacttaggaggatgaatcttctgttactgcagtaaagtttaatacgtatatttgcataattagggaagtgtgtttgtgtaatcaaatcagaaagtaatgaaccacccacatgcagccctgggtactatgggagcatcccagcagaagtccagggcagcagagtcagcagtgagattggacagtctctgaggcagaagcttaacagaaggcaagagatggaatcccaggcagggagctacgagcaggcgatagaggcgatgacggtcatgcccatagctgagaccacaaactagggtgaagagctgaggtagaaggattcaaggggcacattggccttgatactaaagacaaatcaatggctcttcagtttttgccagagagttatacttttcccatttgcattcatttttggtttttttagacgtttttcttctctggagaatactgtctttcctcaagtcgtgatgattaataaacattccagtcagggatgtgctttatacgttgaagattaaacattttgaagattgcatgttctctcgacatttccagtcacattttacctcgggggagctttcccctgagaaggatttggctgcagtgtacctgtacatactgcttgggagaaaagtggtcatagaagtggaaaaccctgattctgtttgatgaaaatctagtacccctcctgaggaagagagaacaccgtatggagggcagcaagtttctgataagttagtagatttttcctattatctggaataggattggacagaaaccaacgtacgtatcatagaattgtagcaactttatcaaatgtaatcattctgtggcaatgctctggtatctcttcccagcatgtttacagagaccactgggttgagttccagctgttttttagacctcgaggcatgttttgccaaagaaataatggtataaaatggggatggatttcccagccaactgaccaaaatatcatgtattgaattctgttatcagtttgatagtcccctatctttgtaaataaggtaattctaaaaatatgaatgaaattagaatatttaaacgtcaattacagtacaaataattaggtttggaatttttgtctttggcttttctttttttctccccccaggatgttacatatttatccagttacaagaatagtttccagtatagacaaattaattgtcttttcttttttctttgagacagggtctgactctgtcacccaggctgagtgcagtggcacaatctcagctcaccgcaacctccacctcctgggttcaagtgattttcctgtctcagcctcccgagtagctgggattacaggtgcctgacaccacacctggctaatttttatatttttagtagagacagggtctcaccgtgttgaccaggctggtctcaaactcctgacctcaagtgatccacccacctcggcctcccaaagtgctgggattataggtgtgagccacagtgtcagaccttgtttccttaatactgcttgaaacaacacttagccttaaaacaattgattttcggccgggcgtggtggctcacgcctgtaatcctagcacttcgggaggccgaggcgggtggatcacgaggtcaggagatcgagaccatcctggctaacacggtgaaaccccgtctctactaaaaatacaaaaaataagccgggcgtgatggcgggtgcctgtagtcccagctactcgggaggctgaggcaggagaatggcgtgaacccgggaggtggagcttgcagtgagccaagatcgtgccactgctctccagcctgggctacagagccagactccatctcaaaaaaaaaaaaaaaaaattgattttcaggctggatgtggtgactcgtgcctgtaatcccagcactttgagaggcccaagcaggagactcacttgagagcctaggagttcaagaccagcctgggcaacatagtgagaccccactgctacataaaatacaaaaattagccaagcatggtggcacgtgcctgtagttccagctactcgggagactgaggtgggaggatcccttgaggatcccttgatgctgggaggcagaggctgcagtgagccaagacatgccactgcactccagccttggtgacggggtcagaccctgtctccaaaaaaaaatagactattcttcacactgggaaagaggcctggcaggaagtagttttcccaaagttgtgtgtttgatcagcttttctcccatgttcttcaaaaagctgagcaccgccttctataaggaatgctaggaagctgtgctggcagtagctctaaaacatgaaatgatgctacattatgccttgcctttgagatgtggtcttccagagtctatttcatggatttcatgcatgtgattttattcttcacatggaagacagtcaaagagtttaatttgagcatgcctattcctgacaccagaaatttcatttttgccatgcctaatgacttccatttttgcttcagttctgttatttctggtatcatcgtttacatttttctattctctactcattttatcatttgtatgaaaaagcaaatgactatataaatactgctgtttggatgaaggtgccagcatgcctgcccttgtgaactgttgcaaatgttataaatcatcaattagtaagaaaaattgggaggttgcacaaggggagttggggaaatgacttccctgttcttagcattgttggctgacaggagaagtatgaacctaagaaggtatgcagcctcttgatgtttttcacattttttaaaattactaaactctttttattttatttattttgagatggagtctgtctctgtcacccacaccagagtgcagtggctcaatctcatctcactgcaacctctgcctcctgggttcaagcgattctcctgcgtcaacccccccaccgagtagctgggattacaggcacctgccaccatgtccttctaatttttgtatttttagtagagctggggtttcaccatgttggccaggctggtctcaaactcctgacctcaggtgacccacccacctcgacctcccaaagtgctgagattacaggtgtgagccaccacgcccagcctaaaattactaaactcttgaagaaaaacctggagttaagccataccttccaatcgttttttagtttctttttttttatacttaatcttagtcttttttttttttttttttttttaaagacagtctgtcttgctctgtcacccaggctggagtgcagtagtgtgttctcgcctcattgcaatctccacttcccgggttcaagcgattctcctgcctcatcctccccaagctgggattacaggcgcctgccaccacgcctggctaatttttttgtatttttagtagagacgcggttttgccatgttggccaggctgttctcaaactcttctcttgacctcagatgatccacccgccttggcctcccaaagtggtgggattataggcatgagccaccacgcccggcaagtattttctatttagaaaaacatggtaatgccacatatctaaaactggaacaaaaataacagatcagtggaagagaatggaaacaagtaatcccagacataaatacaaatataatattgcggaagccaacatttcaaattggtcgggggcaagtactatttagtcagtggtgctgggaaatcagtttccaaatgggacaactattgggaaaatagtctcactcaacatgaaactgagagaataaatgtttaaaacttcaaaagaactaaatacaggtgtatattatttagccttcagtatggaggaggacatccaagcatgaaggtataaaccacttacattttaaaaacaattaatagcttggccacataagagtgaaatgggccagggcgcggtggctcatgtctgtaatcccagcactttgggaggctgaggcaggtggatcacctgaggtcaggagtttgagaccagcctggccaacatggtgaaaccccatctctactaaaaatacaaaaattaactgggtgtagtggcaggcgcctgtaatcccagctactcaggcggctgaggcaggagaatcacttgaacccaggaggcagaggttgcagtgagctgagatcaggccactgcactccagcctgggtgacagagcaagactccgtcccaaaaaaaaaaaaaaagaacagtgaagtgtactcaaaacctgtaaacaaaatttaaaaactggtaaagaactgggaaaatatgttttgtacatatgatatataaacttcaaatgatgggggatggagccgaagtgttttgtttgtttgttttgttttgtttttgagatggagttttgcttttgttgcccaggctggagtgcaacggcaggatctcggctcaccgcaacctccaccccctgggttcaagcgattctcctgcctcagcctcccaagtagctgggattacagtcatgccccaccacacctggctaattttgttttttgtttttttggttttttttagtagagacagggtttctccatgtcagtcaggctagtcccgaaatcctgacctcaggtgatccgcctgcctcggcctcccaagtgctgggattacaggcgtgagccaccgcgcctggctggagccgaagtttttaaatagtggggtgtaaatcagaaatttttagaaaagtacaggtgatcaacaacaaaaagcaaatgattcaaagcaatttgagtagtcaggagataaattcgtgttaaaacagtattccttttcttacctagcatattggcaaagataaagaaaaatagcaaatttttaacagagattcaagaaagattggctttttttttttttttttttttttctggagatggagtctcgctctgttgccagactggagtgcagtggtgtgatctcggctaactgcaacctctgcctcccggattcaagcgattctcctgcctcagcctcccgagtggctgggactacaagtgcacgagattggcactttttaattcgctgttgatggaaatgtataagttaaaaaaaaaccttcctctgcaatttttgttttgttttgttttgtttttgagacagagtcttgctctgtcatccaggctggagtgcagcggcacgatctcagctcactgcaacctaaacctccagagttcaagcgattttcctgcctccgcctcctgagtagctgagattactggcaaccgccaccacaaccagctagttttttgtatttttagttgagacagggtttcgtcaggttggccaggctggtgtcaaactcctgacctcaagtgatccacctgtctcggcctcctaatgtgctggacttaacaggcatgagccaccgtgcccagcccctctggagtatcttgatagtatgtgggttttttgtttttctttttttttttttttaaccgagtttcgctcttgttgcccaggctggagtgcagtggcgcagtctcggctcagtgcaacctccgcctcctgggttcaagtgattgtcctgtatttttagtagagacggggtttcaccatgttttccaggctggtctcgaactcctgacctcaggtgatccgcccgcctaggcctcccaaagtgctgggattacaggcgtaagccatcgcatccggcccttcttttttctttttaagcattaaaaatgtgcatactcgggcatgcgcagtttctgtgggaaaacatgttccttaactaaaaggcagcacatttgcaacaaataatttttccctcaaacaaggacacttgggataggaagaagggcagagctgaggacaggtctgatcctgttcaactttactaagaacctgttttctgcacttctacttccacagctcagacaagaacagaacctcttctgcttgggggtggggcagggctgtcttgtgcggaatggcctcattcctggattaggaagtgttcctaagtagtgaggtgtctcagatgtttataaagtgaccacttgtgtagtgctcagggcattgttgcttctgtaaagtgcgtatcatttgatctcatgctgtaaatgattctgtcttcagggcgcaaaccagaagaagagggtgtggaagataacgggctggaggaaaactctggggatggacaggtatgtgcagccttgcgagtgagtagcgtggtggatggaccagtggcggtcacatgatggttcggtctggttgtgtcacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctgtaggtaaccggcaatgtctctagaatgtgccctgaatgtatcagttccacaattaaaataggtgatcagtttcatattgggaagtaagttgttctgtaatgccagttcagtagaataagggtcagttggttcagatgattctgaaccaatttgttttgttgaaaggtgatgtcttataacatttcatatgtacttgctatccatttgcggcatacagtatgagacattttgaggacaaccattcagactcttcctgttgccggacttgatctgtggtgttatggcctaggtaccttgaaagcattgaactaggaagaggttagaagttggtgttttcctgttaagaagcaattgttgagctgggtgccttgatgcactcatgtaatccggtaactcagaaagctgaggtggaaggagcagcccaggagttcaaggctgtactaagctatgattgtgcaattgaagtccagcctgggtggcagagtctgacagaaccctatctcttgtttaaaacaaacaaacaaaaaaaaaaacacagccagttgatacctatcttaagagttaacctcaagtattaacctggatgttgtttttaaacctaaatttttttcctgttagaaacatatcaaatggatagtaagattatagtgggtagtatttcctgaatactacctaccaggcattggcattatgcccttcctttctttttttttttttttttttttttttctgagacagagttttgctgttgttgcccaggctggagtgcagtggcgcgatctcagctcactgcaacctctgccccctgggttcaagtgatctcctccctcagcctcccaagtgagtagctgggattataggcgcccaccaccaagcccgactaattttcttgtatctttagtagagacggttttcaccatgttggccaggctggttttgaactcttgacctcaggtgatccgcctgcctcagactcccaaagtgctgagattacaggtgtgagccaccgcgcccagcatgtgccctttaattcttctaatagcaacatgaggtgctgttgtccccattttcagttgaggaaattgggaaggcaagaactaaaaaacatctccagatgacacacagctcataacagaataagaactaagatcaggctaattccagaggccatgtacttaacttatgtacgatgttgtcttggtgccattaatttgatattaatttcatttacctgatgattaatgtttgtcagacagaaaaagtgatgcatatgagaagctgtggggccctttctgtgttggctcgtggggggccctgttcttgtcctggtccttaggtcttccgcagtgagtgcttctcaagcagtcttggtggacagaaaccttgttgtatgccagtcaatccgcttctgcatttcttcagaatatttttgcatttcctcttggaactgattccaagtatccttagaggtagcagattgtcatatttgaatggaggatttgagtctgagaagtggctgagagttattctgatacaaatagggtgtgcaatttttggtgagtcccattcatcagcttctaaaaaggagtagcagaaacacttgcacagcagcaggagttacttacccttcctgaatggctgcatcttcttaaggctgtttttttccctcctaagcagaaaatcatacattctgcaacaaaagctggaaacatcctaaatgcctggaagcagtttagttttaagggttgaggccaggtgcggtggcttggctgggcacagtggctcacacctgtaatcccagctactcaggaggctgaggcaggagaatcacttggaccagggaggtggaggttgcagtgagccaggattgtgccactgcactccagcctgggcggcagagtgagactctcaaaaaaaaaaaaaaagagttcagaggtagattctggagatggatcaatttctgtgtgtccctggacaaactccttaacctctgctcctcacttgcaagaggttttcggaagattcaatggatggatgtttattatacacttaaagcagaagtcatcaagttggctgtcacctgggttgtttttgttttgttttgtttttgttttggggtttttttgtttttgctttgttttgctttttttcaagacagggtctcatggtgtaaatgaagttttctgagaacacaaccacacctattgatactgttgtctatggctgcttttgtgctttagtgtcagagaggagtcctgactcatctgttctacaattcctgaagaatttactaggcagctccaacaaagtgtttcccagcctagttcaatgcctagcatctagaaagcaccgtagagttatgaaatgtaccaccacgaatacagtttttactgcagtgtaaccatcaaaatgaactaagcacatctgtgtgaactcaaacaatctccaaaagagaagtgacacttggggagggttcagaatgatgtgctgcccctggtgcagatgtctaaggggagatggtctttggcacttaaacacgtgtgtagcatatgcgatgaccactgcatggcaggaagaaaggagtagtggagagtggttttcagtgaatgggcttttgtaccttttgagtcttctgatcgtgtgcgtgtctttcctagtgaaatatagtgataaaaatacatgctggttataaaatatctgaaaacgtctccccctaagtatatctcaaatttcagggctttagagcagatggccaaaattggtttcagtcacaaattatctgaaccccctttctttgtttggggaatcctttgccttattgggcagagcctacttcttagaataaaagctattcttcccctgcaagtagggcataggatattgccagtctcgagctcctgtcctcaccctcatgctgggagatgctgttccattgagggaggtacctaccccaggggcagcaggtcccacatcctcagcatccaggctgggcgagcagcggtggctgaaggctccacttcagcaggactctagccattgctcctggaagaacagccctcaccctgtgctcagatccacttagaggctgtgcactcattttcatctcttttctgtttgacttagactttttttctttcttttgcatcttaaaacctacatagctaccatattagtagatttcctagtctatgtgcaggtggacatttacatacaacttttttttcagtttagctgcaattatactataatagtgttttgatttctgccctgggtttaaaattttgttgtgaattattttcatagctgttcacttttcattgtacagatgtaccattatgttacgttattgttggtgtgatgaactgtattttctccatttattttacagatagaggacaaagaaactataaacaatttagatacttcatcatctgacttcactatattacaggtaaactgttgtatgtctcagtacttttagaatgaaaggtcagaccacaatttctggaatccatttcagacaccatatgccagttccagctaataatcaccacaagggttgtttcctttgtcaggatcgttaatgggtgtttgctttctgctttcctccaaatataatgtacgcattgccagggacttaactctaggcttcgacgagtggcctccaagcgctgtggcttaccagcagtcattagagtcatgttttgtggcattcttaatttcattgcttgtggcaggggaaggcagcctgtctcatctaccctgggtggcatcccctgcagaaagatgatttgatgagacagcaagagggcatggctacctgggaaagatgagtagggcccagatggggattgagggttgacagagccctgttggggaaggtggggtctcaggggttctggtcttgtctttgggaagttttttttgttttgttttgttttgtttttgttttgttttttctgaaattgcccagatttcatttaatgactgtatcatcctacctgtttcattggcatctctgtaaatattaaatcttagatgagaacagatgagttgagaatttccaggtatgatttttatatttgtgggtcttgagtttcctttttttttccagcctacatagatacaaattgttagaacacacttacctaggtagctggctaattcttaggagaactttttgtggagaaatgaagatcgagccagcttttgcccagcctttttatttatttattttttttcccgtcttctttttaaatgtcatctatgttattgtaattagaaatccccttttggaaaagatctccatttgcttctgccatgcaagggcaagggagatactggaaagccagagctccaaccttgaggagggcacaaatctcaagaaaacgtggtgaaacccagttcgcttttagagctgccgtctctccacctgcaaattgacacggccattcccgactcagaaaggagaggaggagccggatcttgtcactttcccctggctctttcttggtcacagtctcccatgttaaaatgggaaacctacagtctctcctaaacaaataggaatgtatttgcttctctttagagaaaatgaggaagaattattctgccaacattgatgatttgcttcagtcctatggtcagaattcccagcatggggtagggtacatggggaaaaaactgattaaaaataagtgaaagcatgaggaaagtgtacagtttcatagagcatcctggaatggcagggcagttcccaggggaagttataattcagtcacacctacttattgggtatatgtgaatcccctgtgatgtgtcaggtgtggcattaactaccagcattacatagatgaatgagaaggaagggtggtccccatgctcgtggggcctggcctgatggttaacagtgcagactcacactcatacacggcctttgctcagagcctgtctctgcttcccacctgctgtgtgtccttgggcaagttactcagtctgtctggtcacagtctgttactctgtaaaaagaagggtgctaccattaggaccaacctcctgcaaccgatgacgagtctgtgtgtatgtaaggtgcttacatttgtgcctggaacctagtcagtgcccatcagttgactggaattccagaggagtgtaccttgtgtgcacaggaaacataaaggctgggggatcacatcatgtggaaaaagctcctttgcttagtggggcacagctggagttgggttagagggaaatagggaaagccttcctgaaaggagatgccactgagctggatactgagggatgtggatgacttggctggacggggcaggggagggctgggcctgtcagggagggaggtggcatagggatccattggctgaaggctgaaggccacagagggacatgagcttactgtggacacaaggtgcagagagatgggatggggataatacaaccagatgccacagtaggcaaggatggcaccagcctgagtggacagggcttcctgggaagagtctgaatgacttctagaactggcctggtgggaacactgattggaagaggagatgaaggagggagggtatttacaaagtttttcatgctggcaccaccatgccaagtaagagcaggagtcataccacctgggcccatattccctcagtctttcgaatatcagaaagttgtcgtagcttcattgagtgaaaaagtgactgttaatgtgccatgcattcctctagatgctaacagtagaaaaatgaaaacactgctctccttgaatttgagagttcaatctagagggtcaggcgtgcttatgatgagtgcctcaccatgaagtgagaccagttccaggctcctgcaggggagactgaatggagggtgggctgagtgaagtggatgccagtcttatggagccattcctagaacaagcaggttctccacctcttgagtttgtgagtttccctccctggatttttaaaattccctctttagttattctgggttttcatttaaataaactgtaggtgtcattcatctggcacagtcttatttacgttttttcttgcaggaaattgaagagccatccctggagccaggtactgttaaatgaaaaacttaccagcgggggtttggaaccattctagttttccaccttctctaatttgaattctttgatttttaaaagttaccttactatagtatacattgttctaaaggtttacaatccaaaacctaccaggatcatagagattggaaacccagccatatcaccagatctgtgaaagtggctcacttctcattttacaaaatgtattggtgagatgaaagtatctcatgcctttttgaatatcaacagcattgaatcatacatagagaaagagttccagatgcctctcttgagagctaatacctctgcacccacaaaacagatcttgtgatattgggcagtagcttaattttgttgtttttaattgaggcagctcaggtagtggtagggagatacattttaaaacataaatttgagacataactggattccagaagaggaaagagtgtcttcatgagaattccaaacactgttcactttctggactgcaaatatctcagagcacggatggaagagattctggttttcatgttggactgttctgttaaaagaaattcaaagaaatttggaaattgagctgttcagtgaatggtgatacattcagttaagcaacttggactttggaagctaaatttggaagagtcatatctaaacgacgacagaatgaagactgtcaagaatcagccagaaggttttgggggttaaatctctgggatgcttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatggttgtgttcttaaattcttcctaattacctttagcccagcagaattaattaactcctgtgggtctgaaatcttatggttaggtcagattttcaatacaagtttgtcggggtatcattttttcagaactaaatttcgggtaggtatgcaacctcagcacgaattttatggttttgagtttgtttcctccatgctgcttccttgtggagtgacattgtcttttgtctctagttctcccgaagatgactcggatacaaaaaggctttccaaagaggaaaagggtaggtcacctcggcgacaccagtcccttggagcatgtatggcctgggcagtggcgggtatttgattctggttcatcgcgtgctatgctccttacccaggagactcctgagacgtttgtgcagtctttctccttctctgctgttaccgctacaggttctgggttgtaggaagcataccaggtcctaagagttaacaggctgatttggtgcagatccttgtgttgggagcacattcatcctgtaacccttcattaaatgcattaactgagaaataattttaccctaccaaattccttcttaatcagtgttctaaaggagtaaaaacatgggatagatacagagctatacgtggaaagagaaacagtgcattgttgacaccaaggttgactgttctgctacatggccgttgcacactgcacttcctcctgtaattaagcgatcgctaactttttttgagacagagtcttgttctgttgcccaggctggagtgcagtggcgcgatctcagctcactgcaacctctgactcccgggttctagagattctcctgcctcagcctcctgagtagctgggattataagcgcccgccaccacacccagctgattttttgtatttttagtagacatggggtttcaccatgttggccaggctggtctcgaactcttgacctcgtgattcgcccacctcagcctcccaaagtgctgggattacaggcgtgagccaccacacccggcccgcaattgctaactttcttaggaaacctcacattgtcccaatagccccactcagtattgtgacgggccctgtggtagtgctgctgggcctggtgttgcactggaggctcttggtgaggatagtggtcaggcccacagccccatttggcttttagtgctgccactgcctcaggaaaaatgggaaccatgtctcttttggaaaggttgtctctaagactcaagatcttgtgggtatttgggtttttactagaattttcttttgaaataggtcgcagcagttgtggtagaaatttctgggttagtggactctcttctacaaccagagctacagatttgaagaatcttttcagcaaatatgggaaggtaagtgccagagcttttctggagaagatactttgaaaccagcgttgtgtggcctttacatggaggtcctctcccctcagtgagttctttgagagataccaaggagcttacacttgctaatggctggggagggtctgcccgtccacaggtagaggtgagagtggtgtggaagcttccagagcccacatcaccactgtatttccctcccttctctgcgagcttgcccccttccctgtgatggctcgtggatccatttctgtgtcctcaggacgtcgcactcaggctgggctgccagggttggctggtggggtgctggtcagcatgtctgggagacagcagtgttcttagaacagtgttcgtgatgctggaactcagaactcagaacagggaccctggagtctgatgataggggtcctcaccacgggtgtcttgggtccattgactgaacctcacctcagcagctgggggctctcaaagttgctgcctcagttcaccactgggggcagttctagtggcctcttgtctgcagcacctgcctttcctgagcccgtgaaggtggggctggtgtcaccaaccccnnnnnnnnnnnnnnnnnnnnnnnnnnnnnnnnnnnnnnnnnnnnnnnnnnnnnnnnnnnnnnnnnnnnnnnnnnnnntagaatccccccctaactgcagtgcccagcgcagccgcctggccctcctccctgtgctttctcactcccttcctccctggtgtttcccagacttgcctcccaaacagcctcctgcattcagggctcctcgtctctctcagagtcggtttcggggactaccaaaggaaggagtccaatcctttgtgttacacagtgagggttcaacacattgcaatatagaaaaccaagtgttttccctgatactgacttcgaagaacttaaaagaggataaaacaggctgggtgtggtggctcacgcctgtaattccagcactttgggaggccgaggtgggtggatcacgaggtcaggagtttgagaccagcttggccagtatggtgaagcctgtctctgctaaaagtacagaaattagccgggcgtggtggcgcatgcctgtaatcccaggtacttgggacgctaaggcaggataacaacttgaacccaggaggtggaggttgcagtgacccgagaccgtgccactgcactccagcctgggacagagcaagactccatcttaaaaaaagaaaaaaaaaaaggataaaactaattatgtcattattacggacataactaagggcttcttgagcctcagtgatacaaggtgtgtggctggcaacacctgcgccaagtctcccctactagaccccctttcctgactccatggcgtcccccagcgggtgggtgtgctcagtggggaagtgttgccctggagactgtagtgtcttgagcgcagcaggcctgatgtgggttaattagaggaccgggcctctctgagaatgtcctctgggactaggattccatgtggcatgatgagcatgattaccagcctcggccactggctgctgcagggcttttcctgagccatggtgtcttctgccgtcaaagggcgaccctaactgcatcctgctggagtcgagaaaaccaggtagactggaaaggatgtgtctacagtaactgaaacacatcactgcgttttgttacagtcaatgatagggcagatctgagttccagagcacggctcacagacctttccttgcatcagtctgtgccgaagtcttttttttttcttttttctttttttgcccacattacatcacttcataatttaccacctacgtagcatgactgtatatttggaatcatttcttcacaagttttagaccatattaaaggaacactggcagaaccctgtttgatttccctttcgtctgttcccctacattgccctcctggcccccttgaggaactagatgagcgattagaactggccagaggtccttggaggaacaacagcgaaacagaagcattagtagcattgtcctccccagtctaacacttgtcggacccctgatgagcagacttccctgtggggtgttcatatccccatgccccgctcagtgggcttcatgtctgagtcatatttgcctgctttcctttgaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagtgagtggccgttttcttcccaggatatagcccacattaggaaatgggggtaatacttgattctctttttcaggccaaaaatgaacctgtgggaaagaaaacctctgacaaaagagacagtgacgggaaaaaggagaagtcgagcaacagtgacaggtacccctccttcctggctaaattaaaggggcagggtgttttttgttgttgttgttttgtttttgagatggagtcgcgctctgtcgcccagactggagtgcagtggtgtgatctcggctcacctcaactccacctcctgggttcaagcaattctcctgcctcagcctcctgagtatctgggactaaggtgtgcaccaccacacccggctaatttttgtattttcagtagagatggggtttcaccatattggccaggctggtcttgaactcctgaccttgtgatccgcctgcctcggcctcccaaagtgctcggattacaggcgtgagccaccatgcctggccggggcagggtgttttaaacagaatctcactctgttgcccaggctggtgtgcagtggcaagatctcttttcattgaacctccacctccctggctcaaccaattctcatgcctcagcctcccgatttgcttggattatagccatgcccatttgtggttttagtagagatggggtttcaccatgttggccaggctggtctcgaactcccggtctcatgtgatccgcccgcctcatccccccaaagtgctgggaatacaggcatgagccaccacgcccagccaacatgtctgttttttatagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggtgggcagctcatgagcccaggagattctgtcttgtttctgtgcctagtggagtttgttagtttgctgtgattagctggcaacggaaactggattcatgttgcagagggtttttctcatctgggtattcttggttttccacttacactttccccgtcttttctgtaggaagtcgagggaccgaacggactgtagtaatggataaatccaaaggggtgcctgtgattagtgtaaaaacgtccgggtccaaagagagagtgagtattaattttctaactagggtattttgctcttcttttcagtttgtatttctgtgtgcgtcttagggaattactaagcttcatttgaaaaaagcttttgtcggccgtttcgaaaatgtagaaatctcaaactattttttttgagacaggttctcactctgttgcccagactagagtgcagtggtgcgatcttggctcactccaacctccgcctcccaggctcaagcgattctcctgcctcagcctcccgagtagctgggattacaggcgcacaccattatctttttagtagaaacaaggtttcaccatgttggccaggctggcctcgaactcctcacctcaggtgatccgcccgcctcggcctcccaaaagtgctgggattacaggcatgagccactgcgcccagcctcaaattattttaagaaatgcagaaagctttcctttatccttacttttgctctgataactgttaacttattttctaaagctaactttaaaatttacatatgggactgttggcttttccctgagtcggtgtgtggcagtccacgttccctgtctaccctgaaagtgtcagcacctccccgtgatgcattcctacacccagcagtgtggagcatgccatggtgacctggcccatctcgccagcctccctctagcctgctctccaccttgaccccttcctgtactcttatcttcttgctgggctgcagtgtgagctgagcatggtggctcatgcctgtaatcccagcagtttggtatgctgagctgggaggatacttgagcccaggagatggataccaccttgggcaacatagtaagaccccatcttcacaagaaatttaaaaattaggcaggctcggtggtatgcatctgtggtcccagctactcaaaaggctgaggtgggagaatgccacttaaacctgggaggtcaagactgtagtgagccacgttcattgcactgcactctagcctgggagagagagtgagaccccatctcaaaaaaaaaaaaaaaaaaaaacacacacctattatttgcatggtctgtgcacaccgagccacccttactggttaactgtcaactggggacactctgagagccaacttcccagttgccagccaaggaccaatcttggcagcagcccctccttaaggaaggagagggaccttggacccgcctggtcaaccctcagctgcacggaggaggaaccatttcacttggtgaatggagcggattgcttaggagctttcagtctctgtgtgccagtattataatatgtcatagccttttacccttgttctataaaacacctttggaaaacggaaaaaggaaagtgtgggttctagggataaaatgagaaggtctcttaacaatgtcattggcacaaataaggtacttgtcaagtgtaccggaagtgcttcatttgggaactcattgtgtgtttaattattgaaggaaaaaggaaaattaagaaatttatttttgaagcaaaagacataaaaaattggtgttttgatcttatatgaagttttcgggggcaatactcatttccattttttctctattaaatgtactgttagatcatattttagcattaaatgttgatgaaattctgtgtctttcaattatgataagcaaaatgtaaggcttgtttggattaaacagctcatctgtttttcactaaaagttattcatcacataggacctccacatctgatggttaggcatggatatatatacctgattcttcctgttcccctatcacacctacttttaacttttttcatttttttattttattatttattttttatttgttattattattttttagacagtctgactctgtggcccaggctggaatacagtggcacaatctcagctcactgcaacctccacctcccgggggtttttaagtgattctcctgcctcaccctcttgagtagctgggattacaggcacctgccactatgcccggctaatttttgtacttctagtagagacaggatttctccatgttggtcaggctggtctcaaactcctgacttcaagtgatccacccgtcccggcctcccaaagtggtaggattataggcgtgagccactgcgccagcaattttttttttttttttttttttgtcagagtatcgctctgtcgcccacactggagtgtagtggcgcgtcctcggttcactgcaactactgcctcccaggttcaagggatcctcccacctcatcctccaaagtaactgagattacaagcatgcgccaccatgcccagctaatttttattttttatttatttatttatttttatttatttattttttgagacggagtctcagtcagtcactcaggctggagtcgagtggctcgatcttggctcactgcaagctctgcctcccgggttcacgccattctcctgcttcagcctcccaagtagctgggactacaagctcccaccactatgcccggctaatttttttgtatttttagtagagacggggtttcaccgtgttagccaagatggtctcaatctcctgacctcgtgatctgtccgtctcagcctcccaaagtgttgggattacaggtgtgagccactgcgcccggcaatttttatatttttagtagagtcaaggtttcaccatgttggccaggctggtctcaaattcccaatctcaagtgatccacccgccctgaactttgaaagtgcttggattacaggcataagcctccgtgcctggcctctgctttaactttttaatgttctttggtgaactaggcttccaaaagccaggatcgcaaatcagccagcagagagaagcggtccgtcgtgtcctttgataaggtcaaggagcctcggaagtcaagagactcagagtcccataggtgagtagggatccaggaacggtttggtgtttttcctagaatgtggtcatgactgtcttctggaaggatgtttgcagagttccctggggtgggatagagctgtgaacctttttgctccttcagctttcagttcatagacttgttatgttttaactttcatcctacggctcttttcttttcttttcttttttctttttggagacagagtcttgctgtgtcgcgcccaggctggagagtgcagtggcgtgacctcggctcactgcaacctccgcctccaagcaattctccagcctcagcctcctgagtagctgggactataggcgtgcgccaccacacctggctaatttttgtatttttagtagagacggggtttcaccatgttggctaggctggtctgaaactcctgacctcaggtgatccacctgccttggcctcccaaagtgccaggattacagacgtgagccactgcacccggcctacttacagctcttttcaaataagtctcttcccaaagattgtagaaggtaacaaaggcagggagatggaatgccttccagcgtcagtagtgctcgtcaacaaaaaataccaaatttgctccagaagatgtgaaagcaggaagagagacagtgaggtagacccagcgagggcactgagagggcttcctttttttttgagatggagtctgtgtcgcccagggtggagtgcagtggcatgatctcagctcaccgcagcctccacctcccctgttcaagcagttctcctgcctcagcctcccaagtagctgggactacaggcgcaagccaccacacccggctcatttttgtatttttagtagagatggggtttggccatgttggccaggctggtttcaaactcctgacctcaagtgatctgcctgcctcggcctcccaaagtgcagggattacaggcatgagccactgctccaaggactgacagggcctcattcttaaataagtcaagaagtaaacacaaacgttattggcgaattacagctaatttattttttctatgaaatacttcgttaactttagttttaaaagtaaggacccccctgggcgcagtgtctcacatctcagcacttcgggaggccgaggctggtggatcacctgaggtcaggagttcgagaccagcctgaccaacatagtgaaacgcagtctctactaaaaatacaaaattagctgggcatgtaggccaggcgcggtggctcaagcctgtaatcccagcactgtgggaggccgaccgaggctggcggatcacgaggtcaggagatcgagaccatcctggctaacacggtgaaaccctgtctctactaaaaatacaaaaaatgaactgggcgtggtggcgggcgcctgtagtcccagctactcggtaggctgaggcaggagaatggcgtgaacccgggaggcagagcttgtggtgagccaagatcgcgccactgcactccagcctgggcgacagagcaagactccatctcaaaaaaaaagggggggtcgggggggcccgggcgcggtggctcacgcctgtaatcccagcactttgggaggccgaggtgggcggatcacaaggtcaggagttcaagaccagcctggccaacgtggtgaaaccccatctctactaaaaatacaaaaattagccaggtatggtggtgcgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagattccaccattgcactccagcctgggcaacaagagcaaaacgctgtctcaaataagaaataaggacaattagtttaaaaggagggggagagggcactgctctgcctataaagttatcacccttttattcccttttttttttccgagacggaatcttgctctgtctcccaggctggagtacagtggcacgatctcagctcactgcaagctccgtcccctgggttcacaccattctcctgcctcagcctccctagtaactgggactacaggcgcctgccatcatgcccagctaattttttgtatttttagtagagacggggtttcaccgtgttagccaggatggtctcgatctcctgacctcgtgatccacccgcatcggcctcccaaagtgctggaattacaggcgtgagccactgcgcccagcctattcctttaaaaagaaaaaaaaaaaaaacaaagtctcccatagtcctgtgagtgcaggcattggcaggtggcatttctgctgggggagtaatgaacacgggcagcctggggggcccccacaggagcctgccgtgctaaacactagagtgttccagaccctaggcccctctccatatctggcgtagaggaacctatgaacaaggaagtgtgggcttgggtatcccgtcaggttgtgagcatttggacacaactgaaaagttcccataaaccgcagccctttcatactaggggctcctccggaaggtgctgagatccacagaggcaggtgtgggcggatccaagacatgttgggtgaactaaggaggttgcagtcatttgagtccagaacactatgaggcaagattatacatttctgctgggacagaaacacacagttgtcccagaaacgactggcctcagtacccttgtggataccaaaatttgcagaggatcaagtttctgatataaaactgtgtggtatttctgcatataacccatgtacatcctcctgtacactttaaatcacttctagataacttctaatacaatgaaaatgctgtgtcagtagttggtatactgcactgaggtgctttttttttttaagtagctccctgcacacaccttttttttttttttttttttttttttttggagacagggtctcactctttcacccaggctggagttaagtggtgcaatcatagttcactgcagcctctacctcctggtttcaagtgattgatcctcccacctctgcctcccaagtagctaccacgcctggctaatattattttttctggagacggggtctcactatattgtccaggctgtatatctataactgtgtaggtaaaggatcgaaagaagaaaatctgagcctgggcacagtggttcatgcctataatcccagcactttgggaggtggaggcgggcagattgttttgagctcaggagttcgagaacagcctgggcaaccatctctaccaaaaaaaaaaaaaaaaaaaaaagacagcctggctcctgtctgttctgttttatatacaaagactggagaaatgcactaaaatgtcatctgtatccaaaagatacagctgctaatgtccttacacttggggggcctgctagccccacctcacaaagactcatttcatcctgtggtctagggagtgaaggttccaattcacactcactcgctatgaagcatatactctgtggctttttttttttttttttttttttttctgttgccgggctggagtgcagtggctcactgcaacctctgcctcacgggctccagtgattttcctgcctcagcctccggagtagctgggactacaggtgcgtgcgtgccaccatgcccagctaatttttgtatttttagtagagacaagagtttcaccatgttggccaggctggtctcgatctcttgacctcatgatccacccacctcagcctcccaaagtgctggcattacagatgtgagccaccgcgcccggcctgttgcttatttttgactggctgtttcctgaaatcacttgtcaagctccaggaaatgttggagaaaggaggcccagttctgatcacacacacacagcctgggcctcactcctgagatcttcctgggctgctcctgtgggcccgagaagccttcttcccgctggagtgtacggttctgcagaccacgtagtggacgcacagccctggagtctgtgcgacccagcgtcttacttaaagtcagccctgggacctggctgggggtgtctaggtccccttctgcagctctactgttgtgcagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggtaagcagatccatgctgcccttagcacgtggcgttcagaatcgtgttagggacctcacagtccagttagcttgagattttttttttttttttttgagacggagtcttgctttgtcgcggaggctggagtgcagtgacccgatcttggctcactgcaagctctgcctcccgggttcacaccattctcctgcctcagcctcccgagtagctgggactacaggcgtttgccacctctcccggctaatttttttgtattttcagtagagacggggtttcactgtgttagccaggatggtctctatctcctgacctcgtgatccacctgcctcggcctcccaaaatgctgggattacagctgtgagccaccgcgaccggccagcttgagatctttcattcaaaggaagcataggccgggtgcgctagttcacgcctgtaatcctaacattttgggaggccagggtgggcggattgccttagctcaggagttgaagaccagcctggccaacatggcagaaccccgtctctactaaaatacaaaaaattggtcgtggtgacaggcgcctgtaatcccagctactggggaggttgaggcaggaaaatcgcgtgtacccaggaggcagaggttgcagtgagccaagatcgtgccactgcactccagcctgggcaatagagtgagactcggtctcaaaaaaaaaaaattagagacaggaggctggataaagtagtgctggttaactaaccaggttcaagggtggcacagacctcctgaggagggaagctcaggcacgtagagagcgccacacgtgccctactgcacctcctttaaggccctttcctttttttttttttttgagatagagtctcgctctgttgcccaggctggagtgcaatggcgcgatcgctgctcactgcaacctccacctcctgggttcaagcgattctcctgcctcagcctccctagtattcgagattacaggcacccaccaccacacccggctaatttttgttttttttagtagagatggggttttgccatgttggtcaggctgatctcaaactcctgacctcaggtgatccacccacctcagactcccaaagtgctgggattacaggcgtaagccaccacccccggccttgtcctggctttttaaatccattgtaatttgtttttgcttattctagaaataaagaattaaaaaaaaatttttttttgagacggagttttgctttcgttgcccaggctggagtgcaatggcgtgatctcagctcactgcagcttccgcctcctgggttcaagcaattctcctgcttcactctcccaagtagctaggattataggcatgtgctaccacacccggctaattttttgcatttttagtagataccgggtttcaccatgttggccaggctgtcaaactcctgacctcaggtgatccacccaccttggcctcccaaagtgctgggattacaggcatgagccactacgcccggcagtaagattaattttaatttctcaaacatactgaagaggaggtatgaacacaaaatgctgagcatggctgctgtgaggagtcaggtgtgtaattccagcagtgattgtgtcaggctttacacgtgcactgcaacctggcaaaaattgctgtttgttgtttctttctattgcatgggttgaagaggagcccaggtcatatatacaatgcaacttctataaagggccttgtaaactgttctaggatctattatgctttggtacgaaatccttctgatgacagttcattatggtcatctgtgtattgcagcagtacatggccagggctgctggcagggcaggaggtcagctttggggcgagagagatggcaggtgcacttgacagagcccctcggggtggaggctcacgtggtcttcctgagcggaggtggctgtgtagggctccagaagccatctgcaggcagcccataggactgactgcttaactaatggctccctctttggaaaaccgaggccgcttttcatcaggggaggtgggtgcatgggacaaaacaaaacaactgtgcagtcactggggtcaaatcagaccttgcctcctataggagagaacactcttggtgaaagtcatcctggttctgtgaagtgctaggggccagctcccacaaaggtgatagatacatttggggtgggggatccctctatctctgtctcatgtcccctcacaggcgagatgatgcctattggccggaagccaagcgggccgccctggatgagcgctaccattctgactttaaccgccaggaccgcttccacgactttgaccacagggaccgcggccgctaccccgaccactcggtggacaggtcagttgggcccctgctgggcgtgcgggttttctttttcctggctcattctgactgagaacaaggactcctgggctctctgaacccactccgttcatcagatgtatgctgagtcagacccgcaggtctcctgccttcagttagggaaattatgcttttcattgggggcctgatggtcctctctttgtgaacaagcctcttcttccccttacggtttgatttaaattgccttttcaggagagaaggttcaaggtcaatgatgggagaacgagaaggacaggtaagtctgaagctacagtggtagccacagaatttcccatagaatgggttcttttcccttcagcgtgccttcttcctgccctttctttgagcaagaggcaaaatgaggaaagagaaaagtaaagcactagaaaagtctaggtttgtggaatggaaatttgggattatttggggttagtcttggctgtcagtccaaacagttactctgaagctgtttttagccttgaccctggggttctgtgtgccacactcaccacacatgtgcaacagtgccagggaaccttgggatgtgacctggctctgctgggaagtgtctagtgagccgcacagctgactcagacaggtgcatctggggaggctgtggttactgtgtctgtcctcgagtgcctgccctcttttgaaagtaaggacatccttcatcaccccagggcccagcttagccttggaaaacaactagatctgtggtctgtgctcattctcttcgggggctagcacattagaacaataagctccattttctccttccatcttacattgagactgagacttcccaggagagccttggacctctagtggctttccctataaacttgggggcagcacattgctgtgtggaagatgcctcctctctgaggactccactcatgagcccttcctcctcctgccagcattttctggactccaccataagcttcccgcttctgtcccccttggttccttaatgtggctgagcatagccaagtactcagctctgtctcgggatcctcaggaattccatcagcctcgtggggttcctttttccctgctcctggaggcaaattatatgcagcaaaacgtagaactagtcttgtggattttctttggtggaggagcatacaccaatggttccatgtaaaggctccagaatcagaactggcgtcacaccttggtgtcaccccttcctgctgagcctgtctccccaggagtgaaatgagggtaatattcctcctacaaagggtgcggtggtgggggtttacatgaggtgggcgcatctgtacaaacgtgtttatcattgccagctacttttttttttttttaatagagacgggatctcactatgttgcccaggccagttttgaactcctgagctcaagtgatcctcctacctcggcctcccaaagtgctaggattacagatgtgagccagcacacctggccaccagctgctttcatgaaggtgttagatatgctctcctaacagtggaacgcggtttgatcccttctcctcacatacacagtcataaatgagtcgtcagagttaccccaaagggaaatggtaacatctccctacagagaaaactagcacagaacttatgggcctcattgaacagttacgtgggttggttggacagaaaaatgttggttcaattttcaaatactaaggagagcttatttcaggagtcccttttcttactttgttgaggggaggcatcagagcacatgctgggaggataggccaggaagcaggcagtggtaacgtgggacatcgtgcacgtggtggagcatgccgccatctctcccttcaccctggcagagctctccgttgaacggggaggtgaacttggacatggacaacaaccagcctgtgtcaagggggtttccttaccaggactcctttctagtttcctttcacctacaatgtggtcatggggcaaaaaccccagagaccacatatgtattggtggaaagagaaaaaacaggactgtggagccaaagctacctcactagcttttgtgaaagtcaggctggaaagtgcttccagccacagaaataggctgtgggtgtaaatattaaccttggccatcaaataagtaggcatagagtgtgactcgccctctcttggtcttccctgaaacagcagggtcaagaactcctggtctgtgttagccacgtggcttacaaaaacaatgacacagaagagggaaaggtgggactagccaagtggaaggccagccgtttatctctcagtgtcctgtgtcttatatcctgagcagagcaaggtgcaagaccctggactgggcatccagcagaaacttccgagaaacttgactgtgaggaaggatgcttgcctagcaattggtcggatgaagggctccatttgatacttccttcactgtggaaggaagaaatttgtaaaaattatttccagaatatgcacacattaaaggtttataaacctgacctttctttagtagaagacagtaagagaatactgttggctctgggaactaaccatttgagctgtgggacccagggaatctctcttgtaagcatcatctttagtgggtgactcctggtggccctcccagctctggtggtgctgtggggacctgccttggagatgccttggtactagtaccttttttgtaccaggccatgagcctagggcacagggcctctggcctgcagatttcaggaaggcagctgtgttgtgtgaaccgatacagcctgccagcacttctgtcccgagtgactgtcgttgtcatcgttagcatgttgcctgaaaagccttggggtctgggcgctgacactgaagcttttttttcccttctggctctgtgatgtccagcattacccagaacgccatggaggaccagagcgccacggccgggactcccgcgatggctgggggggctatggctctgacaagaggatgagcgagggccgggggctgcctcctccccccaggtttgtgtcccacacccgacagtacctgaccccccccccgcccacaagggggcccgcaagtcgctgggatgtgggcacagggtgggaaacacagagggattcactctccagaagccgccacagttattagcacaagagccagagatgggggcaatccaaatcagagatgtctctctttcaaggggcagacgtgactggggggaccatggccgaagagaggatgaccggtcatggcagggcacggccgacgggggcatgatggacagggatcacaagaggtggcaaggtgaggagcagctctgggctgggaccaggatgtgctggggagtgatggaaagatggaggccgcgccttctctccttgggggagcacaggaggtgctctgctctcagtgctggaatgaggaatgaagagcactccagacaccgcctgctttgtgtgggtctggcccagaagtggacagtgggcgttcccgagttctctctgctgggaggaagctggacttctatggtccctgtgcccaggtgtcttcctgggacccgctagttgtgggtacctgggggcctcaccaaagggagtggagtgggctaaatgtgccgtgggttccacgccgtgtgcgcaagttccctgtgtgaaagcacgtctgtcttccaggtggcgagagaagcatgtccggtcactccgggcctggccacatgatgaaccgaggaggaatgtcagggtaaggcatgctgggggcggcgccccttccccctgctttgcatattggcctaccttgctggaggcttaacaaccaagtccttccagctagtgcccctccccccaagggtgacgtgaggccaggcatggggtactgtggaggctgctgccactcaggaggggagggcattaggaaggggccctgcctgcaggcaacactcagggaagctgtgcaggctgggatgggccggggagcaggaggacttcgcagtcaaaccaatgtgaatttgttcctaggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttatttaaagtgtcatttctttatttctgcctctttaaatgaaacgaaattagacttttagttgtattgatatacactgattgttcctttttttaattattattattatttttttttttttttgagatggagtctcgctccgccacccaggcctgagagtgcagtggcgcgatcttggctcactgcagcctccacctccagggttcaagtgattcttctgcctcagcctcccgagtagctgggactacaggcgcctgccaccacacccggctaatttttatatttttagtagagacggggtttcgccatattcgtcaggctggtcttgaactcctgacctcatgatctgcccgccttggcctcccaaagtggtaggattacaggcgtgaaccaccacgccaggccgactctgtttatttttaaatatgtgtgaaacctctgggaaggcatccgggtgtggaagaggctttccagtgagacagtgattggttttcgcataatgggcctgtgcggtgcaggttttgcctgacttctcaagtcaccgagttctcctttaatgttagcacagaccgggctgctttgctcttgggtactgggtggcatccctgtcagggtgtgggggtctcaaaccctgttgatggacactggcggatgcttcccctgcggatcacactcgaaccaagcctgcgaagatttccagctgccactctccacactgacttgccaaagcccaggcaccatcatcatgtggatgcttccgcattacctttttactcagaggacaaactattttcacggcagagtcgggtggaagcagtgaaggctgaaggtcatcagcagcatctcaggcccgaggcgtgcttgtgcacaggctcagccccctcgtgccaggatggggctctgaccagcccagggctggcctctgtgtcagccggaagggacgagcccaacgccaaccctccacacaccagcagcaagctggagccacggcatctgggatccagcacctgtcctaatccaggaagccaggccagacttgggacatacctcaaactgtgaagcaagtgcctcccccattttgtaagcctcactgtagtggagagcggggaggaagcagtgtccagcagagaggaagacggcggagccccagtaacgctctagggtcccttcagctgcaaaggacagatgaccccaccaataccagtggtggcttagatggtaaaggggggccctttcctgccttaacgggaagtttgtaggtaggcagttcccggggctcactgcagcccacctcaggctctgtttctctgaggattttgggactctcatggatgatggatggctgaaacagctccaaaaatcctatccacccacagtgtgggcatcatcggggctatccagcaggagaaggaagggcaggaacggggacttgaactcacaggcctcttggcaaacttacccctgaggctccttagccagaactcggtcctgtgctcgcctttcttgcaacccgtccctggcgaagacggaatgtttctcttcagaagggatgtgacatccgggaaggaacccagtggtaacccccagcaaccacgttctcagccttcccctcgtacctttttttttttttttaaattcaagctgttcacattctctgtactttttttttttttttgagacagagtctccctctgtctcccaggctggagagtgcagtggtgcgatctcagctcactgcagcctctctctcctgggttcaaacaattctgctacctcagcctcctgagtagctgggactacaggcgcccaccaccatgcccagctaatttttgcatttttagtagagacgggttttcaccacattgggcaggctggtctcaagctcctgacctcaggtgatctgcctgccttgacctcccaaagtgctgggattacaggtgtgagccactgcactcggccccattttttttttgagccatatgcagttgtgcatgccagtaatcaatccc

SEQ ID NO: 15722 - DNA, 21105 bp, Human
  misc_feature (1)...(21105): n = A,T,C or G
cagttgagctgtggcccaggggcctcaggggcccccaaactcctggctccatcagggcttaactagggatgagaacttcggaggggaataggagaaggaaaaggagagggaccctggaggcttggagctcagacttttagggcctgcgaagacactgggctaaagagtttgagggtgctgggtgtatgggtggtgccatggtgaggggcaggggatgcttcattcataagggctgagtgaaatgtgatggcgttggggtctgggttcttgtaacctccatgacagtttaccctcaagggcttgaaggccaaggtagaggagagaaagaaaaacaagcaaaaacaaaaataaaaaccagaggtataaagactgagagctatacatcctagaagcaaatactgatggaaagaaaggcagatatacccatcccctacctctgggcctgcccaccccatggtctctctgcattttagtctcttggcccttctctgcccttcatagcagtctgttatggctctgactggtggagatacccaggctggggtgacttttcctccctagcccactaactgcctagagaggtgagaagttctggggctcctaggaaagccaaacttttcctttgtcaggggatgaagataggaaccacctacttagcactaggattcccatctcctctctctacctccttctcctccccttcccctgggctcaggtttaaactcttagagggaagcctacttttgggggaggagaggttgcagggagaacttcctagaaacagggagcccagggataagaaagaaaaggaggcagaatgcccgggcgtgtcgctcacgcctgtaatcccagcactttgagaggccaaggtgggcggatcatctgaggtttgggagttcgagaccagcctgaccaacctggagaaaccccatctctactaaaaatataaacattagctgtctcaacaaaacaaaacaaaaaaagagagagagagagagaaaaaaggaggcagagaagtaaagtcagctgaccaagaagcagctccttggcatcatacacttggcacaagtgggggctccatcaacatccttagatttgaagcagtgggtacaagagggcttacagggtgaggaaaaattggagacaggaagaattgggagaggaaactggaagagggagtgttgaggaaaacagagagggaagtgcttactgaagcagagtatggaggaaaataaggtacaaagagaactaatatgagacatttacatcacatttcctatgtgccctacattatgccagacacttgacattggttaatttatttagtcctcacaataaccatatgaggtaggccctattattagtcccaagtgacgcatgaagaaactgaggcacagagagattaagtgacatgcctgaagtcccacagctagcaagtggtggggtacagtccaggtagtctggctctagagtctgtccccctaacctttgccttgtactcctctccagagagctgtagggctcccaggttataacagagttatgtttgccttctccaggatggtaaagagtttgaatctgggctcccccacttgcagccatgtgaccttaagccagtcacttcacctcagtttcctcatatgtgaaatgagaatcataactcccagttcacaggactgatgtgaggtttaggtcaaatgcttagcccagttgtggtgattcatgatcacttcccaatctaggagttctctccaccagaagtccttagaccatcattcaccttgggacctcagtttaacctttcctggagctcctctggagagtttctcagagcctgcataaccccctgccgtgccctctctaccacactgcaagggccctgagccagggcaggataaactgtagcagcacagagggagaagactgcaactgagagagggtcacagggcttggaacctcagagtggtcattctctcatctctcctttctctctctttctccctaggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtgtgagtctcagggatcttggggaatgaaggcaaatgttaacaagaaggcatcaggagggtggatggtaaaagagttggcaccccagttaggaaggcaggcaggggacaggggtttggcctaatggagtagtagtgaataatggagggtggtagtggtggtgaggaaggagtttggatgtggactcaatggaagtgtttgcaaatgagagttctcctgtcaaataggatagggaggtagcaggcctaaaacttggggggtgggtatctaaaactgcctcctgggtcagtcaactagtagaggggaatacctttgtgtgggcagctgggggtgggtctggtgcagcgtgaatctgctgcttgcttgcagtggggagttggagggagccaaactgggaagcagaggagtctgggaggccagtcacctggctctgtgatcaagaggtgaaattgggttgggtgcagtggctaacgcctgtaatcccagcactttgggaggccgaggtgggtgggtcacttgaggccaggagttcgagaccagcctggccaacatggtgaaactccccctctgttaaaaatgcaaaaattagctgggcgtagtggcgcacacttgtagtcccagctacttgggaggctgaggcacgagaattgcttgaacacaggaagcagaggttgcagtgagccaagatcttgccactgcaccccagtctgggcgatagagtgagaatctgtctaaaaaaaaaaaaagaaaaaggctcacgcctgtaatcccagcactttgggaggccaaggagggcagatcacctgaggtcaggagttcgagaccagcctgaccaacatagtgaaaccccgtctttaaaattacaaaaattagccgggtatggtggcgtgtgcctgtaatcccagctacttgggaggctgaggcaggagaatcgcttgaacctgggaggcagaggttgcggtgagctgagatcgtgccactgcactccagcctgggtgacagagcaagactccatctcaaaaagataaaaaataaaaaaagaaaccccatcattactaaaaatacaaaaattagtgggcgtggtggcgcatgcatgtaatcccagctactcaggaggctgagggaggagaagcacttgaacccagaagcgaaggttgcagtgagccaagatcgcgccactgcactctagcctgggcgacagagcaagattctgtctgagagagagagaaaaaaaggtgaaattgctttgaattacatggaggctgcaaaaaggggaaagaaatcctgtgccaggtccccaaagatgtgtggggtcaggagactgtgcttcttggttctggggaggatggaaatgactgcaaaggaggtagcttttgtaccataagtaatccagagaggcagagggggtgttccagaagcatcctctcctccagcgatgtggatctgggctcctcctctccctgcaggtctggcatagagcctgcatgctgtgcagatccctacttgttccccaggcctgccctctttgggttaagcctttgagtgctgacagcagccaaggcttgggcctctcctctcctcctccctctgggacccctctcctcccagttggtagtcattcctcctggccaggccattacaggtgggggttccaagctggttaagagaaggcttcaactggggccaagagaaggtgattgaagggcgggggaaagagcaatttcagagacagagttggagagaaaaagacaaaaagataaacgcacatccttcatggctccacgagcgcagagacagaggtagaagagaaggcgccctgcttccaggagggggcacgcagagggttgtgtgtctgtatgtgaaaggggtgactaggctgggctggcagctccactggaaagagtgtgttcatcggagaaggggtgagtgtgtggtgcctccagacttgatgcagttgtgtgtgcccagcatctccctgggcctctgctcatgtacagaattccagtgtgtgcaacaaagagtcagtgtgaggagtgaggagggattttgtagtgctgctgacgctgtggctggcgtttggtgaagcctgctggtggcatgtctgtagtccaacaggggttatttgagtggcatgtaggtgaacaagacagcacaaagtaccctttttggaaactacagctgggcttccccagacttcattttcaccccatgaatctgtcctagggacctggggaagtgggaaggaaccaccctccccacatgaatgtacttctggcagagaaccctacaactcagcctcttgggacttgattttctcaggttctgggagaggcaagtaaaggagatggagtggagagggagaggagagagaatggtagtggggataatgctagagctagtacccagtccccagtgacgtcccccttgcgcccctgtgccatggacacactgagatcaaggtcagggttcaaagtgagattaaggtagggaagtggtcaggccgggctccatcttcgaaggccatgctgaaggagggggctgaaaggagaaatccaagggaggagccagagccagggcaggtagctggggagggtgcggctagcctggaaggacaggcctgggcagggaagtggcaggaggagggaggaggggaaggcttgggggtgggttgctatgcggctttaatgggggtggggcatgcagcacctagtggtagcagagaggaagacataggggagacgaagagatccaggagtctgggaaaccttccagagtgggagagtagcagaaggatgagagagtgtcctctctcatttctccgacctgctgtccctttttggctgggagcatctagtggagagggtttagaggcttaaatctgatgccaaaggcatactcacattgagtttgtgcatctcatcaccctctcccttattctatggatgacacacacacattctctctcacacatagactaagagaggtggcccttgaagaggtctggcacttctccctggggctggctcttggatcttattgctgggtccctggcaccttggggacatccttgttgagaagtgaagtcttgctctacttcctggggctgtctcggggtctgaaggggggtgagacaggcatctcagaactgtctggtggtggaggggaggctcagggagcacgtgctgctgaggcaagcacaggcctgtgctcatggaaagcagaggggtgtgtgtacgtgtgtgtgcgtgcgtgtgtgttcatgcatgtgcatgaaacctcaggtgtctgtgtccctatgtatctctatgtttgtgaatcttagtgtgttctagatttgctttctatagggaacagagtgtgatgaaagagaagggaagccttgccgtcctcccacccctgagcagatagctgtggtcctgatgacctagcccaatttgtcctctgaacctggtgatgctgccctggccatggggccactgtccctggggcaaggagcccagatttcaccacactaagtcaccacacatggagaaactgaggacaggttggcacagagaaagtcttgcttaaaagaaactgaaaaagagagactcacagacaagacaagggacagctacccaggcccaaaggtgcagacacagagaagccaggcactgggagaagcaaggagaacaagcaggcgggtaagggcagtaggcctcctccaggaaaaaaccccagtcgactgcctcttttcccctcccctccccggtctctcctcctccggcacaggctccagctccaggccgacacaaacggggctttgattgcaacaggaaacctcttgggcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattcagagccagttatcctcaagccccatccagaaggtggcaaggagggaaaggcagggtgcatgaggagttagctgtccctgccctgcctcgtcctggccaaactcatccttgccagggtggcagggactctaaggggtgaccccgaaagaatctgagtgctaatggctttgttagttgggaaggggtactctcctctttgcctctagggctatgcctttgtggggctctagctgggaggggggtatgccctggtggtggggatcatagggaagggggtgagtcaggcagcagccccccttcatactcccaccaggatggtggagaacatctggttcccatgaaatgctagaaggctaatgggtctaattgctgcaataagggctggggaaactttggggaaaagagggggcactagatcccccaccctcttaccttctccccaaggctgtactaagtctgtctagaatgggggggtcagggttgatggggagggcgggcctgacaccgtaatgcctggtcctaaggaccccctccatgcaatgcctgggatgcacacacagatggggtgatgagtggggtgcatctggtgaagagaaacgggggctattgaggactcatggcttcctggagccctcccccaactcctcctgtgccctcctcccaacccccctccctgtggcctggccacttctggttctaattaccaaccaggcaggcctgacttaattgggacctttcagatttctgagggggaaggggggtactgacagcttgaagttgactaatcaaggctctttccctcttgttttcggggtactccctattttgcacttaactgtttttgttgttgtttgctgctggtcagattctgattcagaaagttctttctttctctctctctctctctctttctttctcctcctttctctttcttcctttttctttcttctttctttctctttcttttctttctctctctttctttcttttttttgtggggttcgggtgactggattcagaaatgggtatttggggttgggggaggagaagggagtttacactgggttggaaagagcagtgcattccctctccatccctgcttcaagccccctagtcagccttgccaccccgaggtttcctcgccatccacaagtcaggccttttcccagccccggcagacccccgcccctcccccgcgcccgccatccctcgcctactctggcaccccttcctgccctttattcttccaacaggcgccccactcctgcagcaccccagtgcgccccccacccggtacaacagattcttagaaaagcgcgccccgccctggcccagccacagccgcctggcgggggaagggccgggccgggcgccgctcccgctccgcggcgctgcccgtgtgagcggcgctgacagagccggctgggcaggcaggccgggcggcccggcggctgagggcggggcgcgggggagggggggatttccgggagtcgccgctgctggcgctgtccggggccagggtccccccattcggccctgccgggccagggcaaacttctgacgtggccagccccccgcccacctcacccccttctccgccgggcgagggcgctcagtgccggaaggggcaacccagggaacagtgttgcggccttggagagctgaggggcactaaccgaagggagggcagttatgcctaggctagagggtatttaaagaccctgagaacagtcagtgaccagaagcgcccctattgccgagggagcccttggcagtgagaaactggaggaggggagttggccatcaggggcagattcatcgaggcgcagttggcacggcaggcacagcttatggggtagttttgtgctctaaaagtgaagttatgttcgaagaaggagcatcgagagagacggtcgaggcgcttagggggcgtcagttgcgggataaggcttcggggactcggagggaggcggcccgggccgcggcggagggcggactgctcgggctaggaggggtagactctggctgcgctggagggggcggggggactccgcggcagcgctgaagacggcctgggcggggtggggcggggccgggtcaggaggaggtgagcgcgctcggccacccgccccgaggggggttcccagagagttcacggcgggagcgcgctccggccctaggaccgcgggtggggagacgggaaggaaggaggaggcagcgcgcgccgagccgcaggaatgcacttttcggccctgaagcgggcgcgcggagggcgagggcggagccaggcctgggaatgagaggggtggaggtagtgcaggtcccgagcctcaggagagcagctgcgcgcggggacctccacgttcccctctccccagtcatccttaacacccctgtattgactagtgtgaaaaagggagagtttggggagagggaaaactctgaaaggaaatgcttatgcttggttcctcctctccttcttccaaccccgacctgggcacgcgcctcagtgcaaatgcatgcaaagcctatgagctgtggagagtatgcctgcaagcattctcccgagcaaggtgtgtttgcacaaacgtgtgtgcacctatgattttatatgcgtgctcacatgtatgttcactcttgcatatttgcaaattcttggtgcctgataagataaatgcatgcacggatgtgtgtctaagcaagcgcgcgcgccgcggagcgagtgtacgtatgtgtatgtgtgcgctccactctcagctttgctcatctcggtgcccggcccccttcgctctccaagccccaccccccacccctccaggcttcgcttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatgtaggtaccggagtccggggctggggtgtagggtgcaggagagggtgggatttactctttccgtgtgtaaagagtggaactgaggtgcaaggaggagcttctggccctttctatgtaaggtactggccctttaaacgtgggggcctcagcgtctcctttgcgtgtgtgcagtagtgtttggagtgtgtgtggtttttatggtgggtgtttagctcgaacctgtggttgatgccactccagagttcctggggatagggagagaccgaggtgtgtgggtagtttgcgccttcacgtccgtggccctggaaggatatgacactcaggaccgtgggtggcgtttgtaaagcccatgtgggaagctggcagtgttaaaaatatcgtttgcagagcgtgtgaatccctggagtgtgcagcgccttgcctaggtggtgtgggtgtgggagcaagggtctctccaccagtgtcgcctgcgacagctgccaggtccacatggcctgtgaggggatgtttgtggcgtgaggccgggagggcgtgtgcccctgcgtggctgcgggggcggttttggaaagtgctgtgttcgagagtgcatcctgtgtgttctcatgccgggtggaaaaggttgtgcacacaagagggagaaggctgagttttgtacgccacccccatataaaaaaagaaatgtttggaaacgtgtatgcggttatatgcagagattactttttcctatggctccaacacacaacaacttcagcaggaagcgaaaagtttaaagcaaagtctgtgtgtgtggtggggggtggcctgaagttgacagcggcagggcgagcaccattactgggtccccaaatatctatcttccccctccgtgaaatgggagatgccaggcctggggccctggaacccctttccagagcagtaataaaaagctggggactgagaggcagtaaaaatgaagtccagatgagaggcggctttgaagcttgggccgcagtgcctggcgggggtggggtgtggggaggggccaggagcgcagcctggaacaccccccaaatttaccctgggctgggatgtgctcgctgcctgggtgcggacggcccggggatgaggggcttgggggcacgctgggaagggtgggaaggggcgggcagcgggcggggcggcgggcgctgggggggtgcgcacgccaggtcaccaagcccccgccaacgcgcctcgctccttggcaccaagcagtgctgtttacaagttcggattttttttttttggttccagagcagagctgctcaaatttaacaactgggaagctggaagagggagatggcaaaccaggagaccggacttgactttacttttgggtggggtgggggaagaatttaaaagtgtgtcatttaaagaaccgagaaagcatggaactattgctttgcaccaaatccctgtgaattcttaactttcctctcattgcccaataggatggggagttggggtatgttatatgttgtgggggtgctgagatggaaagaatctttcaggaagggcttctgggggctgggcagagaccctgtcttttttcaggcctatggaagaagccctttgggcttgactggccctaggtttttgagttttaattgggaccaataattttggcctctgggatcctggtggacacacaaagccagcttcaggcctgcccgcacacactttcagagggaagggtgcttggggggtggaggtgggctggatgtgtgtgtgtgtgtgcctgtttggaggctttggtgtcctggtgctgcgttggcaggctggggtgtttgtctggtggtagggctgttcccttgtgtggccaagtgctggctgttgtgtgtcagccttgtgactggtacatctacctccacggtgtagctggagtgagtgtgtctctattctggctgtgtgtctgtgccagaatccagtgagggttctaggatcccattgtaatatgcctgctttggtgccttatgtgttgttaacctgtgagtgtgtgtgtctccaaggaggtgtgtgctagattgtgagtccaggctgctcagctctgagcctcgcagctgggagcgtttacagccggttataaagagtttgtttgaagctccgcgcagcctggtcaggaatttcctcaatttcagcaatttgggctttaaaaggagaaaaccccagagcccacccccatcctccccagcaggggcccctgcctaacccaggagctgcatcccaatggtggggtctaagcccgagtctggggaggggatctgattggagtagacccagttagctttctggggccttgacctcacagattgacctcggagccactaggctgcactttagggttcagggggtggggatgtgacagtatcacttagacaggaaaagttgcccccgggcctgtctccctaaggcccccagtcttataattggctggcactgccccatgccagtctgaccgcacccaggcccttgcgcaagagaggaaatgaggcagcgctctgcgggcagggagggcgtcagtgccagagtgagcaccaccccacgcacaggccttgggcagaacacgtgcccttggaggacacagtggtgggtctgaggagtgaggagaggttgggaaaggcgttccagccctcctcacatctctcagcaccagcccctcctggagcccccatccctagtcttgaatagactccaggcacccttctttcccccctctcctctctcctttttctttgggtaatctcactctggcaggattcttatgctaattgattgtatgtgtgttgggggtgggtagggcttccctcctgtggggtgggtggagctagcgtggaaccctggcatcctgggcattccttccgcccttctggctgcgttggggcgggcttctgaccaggtgggctgcagagggttagaagggagaaggtgttcatgaggtgggtgcgtgggacacaccttagggagggtcttaggaatttttttgcattaacttgggccctccaggtttgggcaacaggtcctacaggttgaataatttacaaattttccgagcctctgaagaccaaccacacgcgcgcgcgcgcgcgcgcacacacacacacacacacacacttacccagcagccttttgaacagagcagagcatgtcctccccatactgtggggctgagaccccttttgagctgcaattgggtattttcagagtgaagacataagctcagagagggtccagaaacaggttccctcccccatcagtcctgtttacctactgtcacctgacttctccagtttgctacacctccaacggcttccagacctgagaaactgagcaaacacctcagcctctgcttccccagcttctctgactcacagccacttggatctgctggtggtgtggcactgagctggtcacttcccctctcgtggcctcagtttcttcaggcgtgaaccaaggctgtggtgcatcctctcactcactcccctgagacctttgccccatttgctccactgtctctgatggttattcaggggtagtgtgagagagataagcctgaggagttatcccccctgtactactggaaaggaaatgaggtcctggtttacctgctaagcatcccagcaggtcatttggccagtagcagctacaggaagcctgtcattgcctacctgcccccagagttattgccccacagggaggacagtgggaagtagactacctgacaaagatataccaaagagacagagagtgactagagagctcagagctgcagggctttaactcttctacccacctcctggatagttagggaaacaggcccagagaagtcaatttccggaatggccttggtctggaatttggaggattaaacatgtcatataggatgagggctggcattcttgtgaacaagttggttagactgtggagggtagagggtgaactagggtcacaacaagctgtggtaatagtggtcattaagaggattctgacagtgcttactgctggaactagtgcactgtggtagtgatggctgtcaccagtgggccaaggaacaaatgcacatggggtgtgtgtgatgaggaagcctggaggtctgtggggtccttctcccctgaccctcacatcactgcttccctcccagcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaaggtgtgtacgtggtgggagtgggcagacgggggatccagttaccctagtaagatgagagaccaggcacacagatgctgtgtctgagcagcactgctttgcacataggtggttaatagattaggtcaggcttggggcaacctgcaaggccagtgagaggctggtactcccagcattgtgcttcagaggccctctctctttccctcaactccagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaaggtaggctgccatccttggcttgggcaggagcacttcggtcctaccctatggctgtggccctctttcctctggccactcccacttccctgacctctgagacttggcctgccctggggtgctgccttctcccaggccagtcttatttgattagctccattcaaccaggaggccccaccatttcccattctccctctcagggagcttgactcttcctctgaatgggtgaataagtagggtctcacattccccctgtttcatgggggaaatgaagccagtgggcttgccagtccctttccctcccctggactgagccagagatggatatggggtggctcctcctctccacccccccctcgcccccattgtgctgccaaggctataagtggatatcctgccgcctgcatatcctgccccccctcccccagctcctgcagggtgacaggaaggacaggatggagccgaatggcctggggaaggagcaggggctgcaggccctgggtggggctggggagaaccagcctgggaataggagctattataggtgatagggaaactgaggcagtaattacagtgccagagaatagatattcatgataaggactgagcatattaaattagggtgagagaggacacccaaagggaggctctgagggtcctgaccctctccttgcgcctccacccacaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacggtgaggaatgggcagagcccagtgagggcagggcactcttcactttggggaatggggctgggttgtgttggaggctatcatcgactggtgctgaggacaaggagggcatcagaatgcagaggagagagcttgggatattggtagagagaagacagcccccagaggtgggccttagcttgccttccaaccttctacccctcccctctgcagaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctggtaagttaggccctgtgggtcctgccacagcccgacccacatatgggaccctcaacaattccttgatccatgcaaagatttccttaccctgcaccccctgccacacatgtgggactcctcagctctcttttcgtcttagcctctgcccctatgacctgatcctagacttttggatgccctgtctcctcctgacttcccgggactacccctgccaagcctcagatcctccacctctgccttctccatgcctgcttcaggttgcactcactggggacctaacctcctcactttccactcattccctcttttccccatcccccagaaacagcactaaccctcctccaccccccacctccagatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggaggtgcgggggcgccccctggcgtctgctcagtgctcagtctcctttcccaccactccatgcggaatctgtctgggagggggcgtggaggacccagtggtctcttctgctggtaattcttgcacctggccccatccagagagttctgaaaccctgtacaggcttcccaaaacgccggttggtgatcagccatctgtcactgtgtcttccccatctcttccttcccctctcactccagtatacttgtccccatagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggtgagtcatgagtgggtgtcccctctctgtcttcccagggctgttggtctcccaggtcggacaggaggacacacagagacaagaacagagtagttgagaaccaggcaatctacactggaatcctagctctgccacatagtagtgggagactttgggcaaattgcttctaaaccagtactgtccagtagaactttctgcaatgatgggaatacaatagtcattagccacatgtggctattaagcatctgaaatgtgactactgcaactgcagaattgaatttttaattcagcacaattccaagtatgtgtgtgtgtgtgtgtgtgtgtgtgtgtgtgtgtgtgtgtgtatatatatatttagagacaaagtcttgggcaaattgctttacttttttaatcttgtttgtaaactgggctattcttcacgtaccttgtaacgctgtcttgaggactaaattagttaatatacaatgtaaagccaggcaccatggtgcacatctgtagttccagctactcaggaggctgaggcagaaagatcagttgaggccagaagttggaagctgcagtgagctatgattgtacctgtgaatagccactgcagtccagcctgggtaacccagcaagaccctgcctctaaaacaacaacaacaacaacaacacaacaaaaaaaacctgtaacatatacagtgtacttagaattgtgctgaattaaaaattccattctgcagttgcagtagtcacatttcagattgccacatgtggccaatgactactgtattcctatcattgcaaagttctattggacagtccaggcttagaaggatgtctggaacatagtgtttgataaatattagctgtggtaataaatgttattaagagaacaggactaggaacaagtgacaagctctggacattcgagagtggggtacttggggagtggggttggaagttgtgtgcattgcgctcgctgaagagacagcctgaaagaatgggatgaatgggcagcaagcctggtagagaaggccaggtagaggttccaggcagaggagtggcacccaggaagcctagtgagaagaggatgagctggggacggagaggtggtgggcctgtgctgggcgccccctaggggagtcaggggcagttgagaaaggttagggagatggccttaagggccatgtgcctctgtcctcctgagcctctctctttctctctccattgtaggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcatgagatgtggctccctttaggaggtggtagggaaatgaccagctgacctggtgagggagctgagtgaggagggaaagcttgtaattgattggactttgcagctttcttggtagaagaaaacaggatgaagtgtgcctggattgtggtggggacaggatgggggaaagggagcccatggggactcaccctgagtgaccgggtttcccacaaccaccaggtgtgggttcagaatctcactctgtcgcccatgctggagtgcagtggtgtgatctcggcttactgtaacctccacttcccaggttcaagcaattctcttgcctcagcctcccgagtagctgcaattacaggggtgcaccaccacgcccagctaattttttttatttttagtagagacaggtttcgccatgttggccaggctggtctcgaactcctgacctcaggtgatccgcctgccttggactcccaaagtgctgggattacaggcgtgagccactgcgtctagcttggtgtgggttcttatgttggatcctgtggatctctgggagggcatgaatggacttcagaggtctgtaagcctgtctccacctccagttatgcatatgtgcatatctgcttttctctggggaaggagtccattgaagttttatttatctttttgtttttcattttttttcttgagacggaatttcactcctgttgcccagtctggagtgcagtggtgtgatcttggctcactgcaacttctgcctcccgggttcaagcgattctcctgcctcagcctcccaagtagctgggattacaggggcgcaccaccatgctcagctaatttttgtatttttagtagagatggggtttcaccatgttggctaggctggtctcgaactcctgacctcaagtgatccacctacttcagcctcccaaagtgttgagattacaggcgtgagccaccatgcctgccctgaagtttcatttagttctcatgagggctcctggccccagaagagaagaagcccgcatctaagctacagtgttactgttttacaccagcccctcacccagggagccctctggccttctgtccccaaccaccctgctatcaccttataccttactccccccaccctctctgttcccactcttcaccccatgacctccactcactgccacctgcactgttaccttctttccgaatatctgtccttgctcccacacgccttccctctgcaacacgcctttgcagtgcctttggcctctactgctgcaccctgtactcttcccttcgccctctgtgactcccctcaagcccctcctccgtgtcctaccttccctgggacagtgccttgcctaccttgttcctggctctcttcattggtgacctgtggttatgacaaaaaagttgaggatgtgggagtaggggagagaagagtggagggcggaaagcagaagaagaaagtgaaagaagctctagaggaaaccacagggcctgtggggaaggagggtcattgccgtggtaacccctggttgtgggggaagggtataggtcctggctatcccatagcctgaggccagccaagcccacccagagaaagagcccctcctctccaattgtcccctcctagcagctacacctctgcaatccatctgacatttattgagcacctactataagatgggcacttggctaggtgtggtggctccagcagggaagccttgtagagccagtccctgcctacaaggagtgctccttctggtaggggagatcgacctgtgaacacagacctcatgtctagttccctctcaaagctcttagtgatctgtatgggccaggagcaaatcccattaatattttcctgctctccctacgggcttcatccttgccttggcttcagctgttgttcctgcactctctgcttctcccagttcacctcctccacccctttcccaggatccact

SEQ ID NO: 15723 - DNA, 36618 bp, Human
  misc_feature (1)...(36618): n = A,T,C or G
acaggtgtgaggcaccacgtccggcctggccaggattaaattttttcatgtgaaccacaacactaaaactttgtatattgctgcgcttatcttacaaatcaggaaataggggttcagagaagttaaatagcttgcttaagtcacacagccagcaagtggtaaagctgggatctgcatgactacagagcacacaggctccccaccagtagattagagagggggaggtctgctttggtgcagagacaggtgggatctgtgatgcccgttcttggtttcaacattcttttaaactctcctatctgagcctaggactttctgcagccttcctgttttaggctggcagctcacagtccctctctggttattttcaggtctgtgtgtgccacagagaggaagggggcaaccacagtgggaaccgctttccagccctgctgcaaccccttttgaaatagcaggcgagagggctggtggcctccactgtgctcttctgttcctgtctgtgggcatggctaaagcaaacaagctcacccacaccagctcccatcgtgcggtggatcagtgcatgtgcttggttctgtctggcactgctgatgggtggttcctacagaaagatccagatgcacggggtctgaggactgtttcagaagctctgtccgtccatgcttggccctgtccacttgggagttccattaggccatgcctgttccagctgtcccaggatctttgatctgggttaggattggcctgaaaccaaaggtagaaaaacacattctaatgagcagttgctggtctagaagcttctcagcctaaactttatttcagcatttttctttccctccagattcagctatgaggccatcctatcagctttaggctctgtgggggtccttgagagagttcccctccaagggacggacagatggtccccttcaaggtccttgtggttgctcaaaagccaggtgcttgtttctttctttttttctctccttcctttccttccttcccctctatccctccttccctccctccctccctcctcccttccttttctttctttcttttcttttttttttttctttccagacagggtctcactgtcatccaggctggagtagcagcccccaatcacggctcactgtaccctggatctcccggactcaagcaattttcccacctcagcttccctagtagctgggactataggtgtgtaccaccacacccagctaatttttaaatttttttatagaaatgggggtctcactttgttacacaggctggtctagaattcctggactgaagcaatccacccacccggctctcccaaagtgttggggttacaggcgtgagccactgcccctggtgttagtgtctgtctgtcaagtcaggagggcagccatgaacgttctgatgtctactgagcacgtgtggcccagaccgtgtgtcaggtgtttaggtgccatccacagaaccttcctaataaccctgggcagcataggctttcttatctctgacagatgaggaaatggagactcagattctgaaccgaagtcacagacacagtagatggtaggtctaaatggggacccaggtctatctgactgcaaagtccaaaccgtttccttgcctctgctgcagcctgcgaggagcagctgggcagaaagactgtgcctttacggtggtgagtcttccgatgcccaagcctcaccccagaccgatgaaatcagaatctctggagacccgacccagacattggtgggttttagggctcctggctgattccagtgggcaaccgggctaccaagcactgttttaccctaagggtaagaggaacatcgcctcctcgagggctctccaggtgtgcctttcacagcgtaatcccgttcacgaaaccaaaaatcaaaactaggccactgcccactggtggctgatacgcccttttctcatcaacagaaccgggaggaagggctctggtggggctggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccggaccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcagggtaagggcttcgggcgcacctggagggctggggcagctagcggctgggggaaaccgccttggtcaccgcagtctgtgggaggctggagggaggaaaggaggtgcgacggatccccttttctgtggctgccttgaggccccgcgggtacctagctgtgtggtcgcgggtagtggctcttgcgccccctgctgcgcttgctcccttggtccggagcgctccccggaatgcccggtgaagctgtgcgggaaccctgcggtctgtgtacaggactgtgtccttgcaaacctgactctcgagcttccttcccagtgcccccaggagcctttacacaaccgcgtcccaggttactctaaggggagactgcccgagagggcgcgccccagcggggtgatgtacccgcctggggagtcctttgtaccagcgcccctcttctccctctgcattgggggtccacctcgcctggtcctccccccacccccgcgggtgcatgtgtggatgacagtgccctgactatgaagggactgacatcacgggcgctgagtcacggatcttcccgctgcacggagtcactttggcagccaccaactctgggaagccaagtgccccagtcctgggaattgagtcgggaggctggcaagggagtgagacctcctggggctggcacgtgctggactcccctctagaaaagagaaggacccgtgagggagagggcagaggcacttactgctcccgttgactgtaatctgcccctggcaaaccaggcttttcttgggctctggccgcatgcccagctgcgtgtctagtctctcttctggaagagttgggcaactggctctccagaggtttattttagggtcccagtgcttctttgaggacacagcagaaaactaaggggcagctgacaggcttctggaacagctgacaggctggggaggctgaaggctaagactttcaaccactagatcacactgaattccagtcctaggtgaacactgatctctccctttgaggaggtgactttctgcaactagaggctgagctggagtgtctgaggctctctttgctttttggatggttgtggtccttatgattggaagaaaaaaagaagggattccattttcaatacacatttataactcctgccagtaacagacactgttgattggggcacccattcaatgttttctaatcctccactgtatctacatataactttgtttgaaagaggagactgaggttcagggaggttgggatggcgggatggcaggttgtcaggccccggtgatggaggccaacccctcccgtggctctgtgctccagtgtggtagatgtctaagactctcaaatatagaactagatcagcaggcagagctgggggcattggggcaagctgagagtcactcttgtctggctgagtgctgggacagaaaaggctgagggagggaagtggaggcccaggcttgcccatggtggtgttagagggatgcaagacaggttccagggctcggatggcctcaggagcaagcagggctcccttggctgcctctgctgctgtcacgccagcccaaggctcctgccccagggaggttactgttactgctgtagttgccaccacctgttgctcctgagtggatgctaggcccttccagggcagccagttacagtcagttttccatttccctggtgctcaggaaggattaggagaggtggtctcatggcctgaacagcccatgaaaggcagaactgagagactggggaggaagtgaaagtcctcccagctcagaaggaaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagaggtttgttttcctcgggatcagctgccgcccacacaccctggagctgccaggacttctcaggtgtactcgttgtctaagggcctggactagctgggacttaggcttctgccggttccaacactctggtgctggaaggctggacttgggtgactcaagttccctcttcctactgcaatgcaagaaaatacacaaaagaagtatgtatacctttaagtatctcaaagagctatctcagcttctgaatttccttctagggcacctcttcctgcccccattacccacacacgtgcctagcctcaccctaaatcagtatttctcaaaagcttagttctgagcctagcatcagatctggtgtgtgtgctgggtgggagggctttggtaaacatgatgatttttgaaccctaacccagatttattaaataagaacacctaggagtgaggcctggggcatgtccttttaaacaaactgccccttgtgattcttaggcactgtcaggtttgaggacggctgcctaaatggtgtcattgaggaactgaatgaaggccctcccgcttcgggctctctgttgccagaaatctctccttgctttggcttgctgcttgtttattcattgcagcaaacatttcttgagtcggtgtagagcctgtgaggcctgtgtaggatcagctatgcagactccaccctaaaaggagcctgaaaatggtcatgggtaaatcctgagaagggctgagaaaccccagactctgaccgggccactgggtaccaactacccgtgaacagattgtctggcttggggtagggggtggttagagagaggaagttcctctgactgaggaccaagatcccaaggcagcaggcacactgatcctgaccctgaccctcatctccagccctcagcagccagggtaaacaaatactcccctcactgggtatttgtagattacacaaagtaacctaggtgctgactgctgaaaatatacactcccttcccccgtctcctgaatcctggtcccaccaggcctggaagccacagacccagcaagcaaaagagtttccagtcaatgaatctagtctggattgaagctgtgctctgtaatacggtagccactagccacgtgtacctatttaaatttaaattatgccagcgcagtgactcacgcctgtaatcccagtactttgggaggctgaggcaggaggatctcttgagctcaggagttggagaccagcctgggcaacagggtgagatgccgtctctacaaaaagatttaaaaaattagctgggcacagtgacatgagcctgtagtccctgctactgagaaggctgaggtgggagaatcacttgagtccagtctgcatggagccatgtttgcactaccgaattccagtctgggcgacaggagaccctgtctccaaaaaattaatttaaatgaaatcaaataaaaacttagtttcttagttgcactagtcacattttaagtgctcaacactcacattgctagtggctactgtactgaacagtgcagatacagatctcttccatcatcgtggaaagccctactggacggtgctgggctagagtgttaaccagtttcttccagaggttttctgttctcttttcctttatccccctctgccttctgctctcctccacctgaacacagctcattttgcataggtgatggctaaggtcttcaagccaggcacatctctgccctgcactgccaagtaaaaatgataacaccttgggcaagtgatttaacttctttgacagccagtgttctagaaaatagaaataattgtattacctcgaagggtggttatgaagatgagatgagctaagtaaggtatgaaatagagtgtttacagaagtccctaacacacagcaagtgcttaaataagtgtaggtgatcattcattcactccaaaaatatatttttggagtgaacacctcctactctgttccaggcactattctaagagctggagatacaccatgaataaaagagacaaaaaccccaggcttagttgagtttcattctagtgtgggagactattaacaggatgtaaattaagtatgtggtatgctagcgactagtgctaaggagaaaaactaaagccgagagggagacagaccccatgtgtgtttgtggcagggtggggtggcatggtgccttggatgggaggccagggaatgccttgctgagaacataatatttgagtgaagacctgaagaaaatatacaaatctctagagattccctatatgtccatcttgggcaggaaaattcttgcctcctctttaacaatgtgtactacctgagggtgtgttatgttctggagcagagggctctgtggggacacatggatgctccctgccctggagaagtatctctggggtaacaagtcctcagccctttagctccttgaagtctagcagagggaagtgctaaatgccaggtcataactgcaagtctgcaggtgggatccttgagggctggagtggcaaggggaaggtgacaaagaaaaggccttttttttttttttaaatacaggatcttactcccgtagcccaggttggagtgcagtggcacaatcactgctcactgcagcctcgacttcctggtctcaggtgatcctcccacctcagcttccggaatagctgggactacaggcgtgcaccaccacatctggctaattttttgtatttcttgtagagacaggatttcgccatgttgcaggctgctctggaacacctaggctcaagcagttcacccgccttggcctcccaaagtgctgggattacaggcgtgagcctttgtgtccagctgggaggtttttttgtgtagttaatctgtgttctttaccctctcctcttgcctgggatctgaagaggtcaaaagtccctggcaaaggcagaggcttttctgccactgggttcaggcttgacgttagctggacctcagcagcctcccccactcctgctcatcccttgccagctctgtcgggtgctttctactcttaggagtatgtccctgaggccctgcatccagcctattctccccagcacctgttctctgaatcagttcccactccacttcccaaccgctttcccgaaaagcatcctttggtcttccctctctatatgatggttacaataactgttaccatttatggtgtgtcaactgtgtgcaagtagctgtgctaggcccttggcatctgtgatctcatgtaatcttcaaaacagcctcaggtgagagaagtgctggccccattgcatagatggtgggctgtaggacaagatgagaggccagttttgcacatatggaaacaaatgtcttttgttttcgtttttgttttgagacagagtctctgtctcccaggctggagtgcagtggtgcaatcttggctcactgcaacctctgcctcccgggttcaagcgattctcctgcctctgcctccagagtagctggcattacgggtgcacaccaccacacctggctaatttttgtatttttagtagagatggggtttcaccaggttgccagtctggtctcgaactcctgacctcaagtgatctgcctgcctcggcctcccaaagtgctataggattgcaggcatgagccaccgcgcctggccgcaacgagacaatcaagagaagatgctgataaggagttggatatgggagtcaggaatttgggaatgaggactgagcttgagatgtaaatgtgggagtcgtgtgctggcagatattatttcaagccctgagagtggctgaggtcccccacatctattcatatgcctttggtcagtggaatgttttgcaatccacatcactataaatgaatttcctctgtctctgagagaggccgctgaggtagcagagagaaaacagctttgagggcaggcagtccaggcctgtctccccattaactgcttcaccagctaggggacctttgggcaagtcactacaagctttaaagtataaaatactttttgaggccggatgtggtgtatcatgtctgtcatcccagtgctttaggaggccaaggcaggaggatcacttgagcccaggagttcgaggctgcagtgaaccgtgacagcaacactgcactccaacctgggtgacaaagcaagaccctgtctcaacaacaacaacaacaaaagtataaaatactgtaacagacaaaaatgcatgcttgataaatgttattgatcctaagagccttttttttttttttttttgagatggagtcttgctctgtcgcccaggctggagtgcagtggcgcgatctcagctcactgcaacatccgcctcccaggttcacgcagttctcctgcctcagcctcccgagtagctgggactacaggcatccgccacgacgcctggctaattttttgtatttttagtagagacggggtttcactgtgtcagccaggagagtcttgatctcctgaccttgtgatctgcccacctcgtcctctcaaagtgctgggattacaggtgtgagccaccgtgcccggtgagccttttttttttgtttttgttttgagacagagtctcactgtgttgcccaggctggagtgcagtggcacaatctcagctcactgcaacctctgcctcccaggttcaagcaattctcctgcctcagcctcctggcctcagctgggattactggtgcctgccaccacacccggctaatttttttgtatttttagtagagacggggtttcaccatgttggccaggctggtctcgaactcctgacctcaggtgatccacccaccttggcctcccaaagtgctgggattacagacgtgagctaccgcgcccggcctttaaaagcctattttgatgggaggagggggatgctataatgtgaggactttctcccagaaaaggagagagaggcactaatgcagtggggataataattaaaatcgcttaacattttttttgaaagattaggtatgttctgaaaatagtgctgaggtttttgcattaattatctaatgtaatcctgacaacatttgaagtacctatggttattatttctattttatggatgagaaaagtgaggcctagagaggttgagaaacaagcccaaagtcacacagctagtgagtgactgagatagggttggaacttgggtatatctgaatcctgggcttgacctgtagacccctgctcctgtggactaggaaatttaaacaaagaacttcctctttttttttttttttgtatttcattatatggatgtactgagtttatttatctggttccccccctttttttttttgagacagagtcttgctctgtcgctcagacttgagtgcagtggcacgatgttggctcactgcaacctctgcctcccgggttcaagcaattctcctgcctcagcctcccgagtagctgggattacaggcatgcaccaccaagccaggctaatttttgtatttttagtagagatggggtttcaccatgttggccaggctggtctcaaactcctgacctcgtgatccacccaccttggcctcccaaagtgctgggattacaggcatgggccactgtgtccggccacccggttaccttttgatggatgtttagttgttcccttcttgctcttacggcccctgctgtggggaataactttgcatatgcctcttgttgtgtgagtgcaagtacacctgcaggatatattccccgaaggggaattgatgggcaaaggccatgagatttgtcatcgtgagacagaatagaagttgcaccaatttatacttccagcagcattgtgagaatgcttgtgtccctatgcccttgccaaaagtgtactattaacctggtatctacacagacaatggcgtctgtgtggaattaatttgcatttatcttatctgaataagattgtatgggttttttaatgtataactgacatttgcataatctactatgacctgcctgttcatattcaatgctaattttattttgattgggtcattaatcttattgtttacaggagctcttgacatattaacatgtcatacatgacttttttttttttttttttggtggtgggggtggtttttgccaagaaatttctttttttccatctctctctctctctctctttctttctcagggtctcacggtgtcacccaggctggagtgcagtgacatgctcatggctcactgcagcctcaatttcctgggactcaagcgatcctcctgtctcagacttctgagtatgaggctcagactcaaaagattggggcttttacaggtgcacaccaccacacttgactagcctttgtattttttgtagagacgggattttgccatgttgctcagactggtctcaaactctgggttcaagcgatcctccctccttggcctcccaaagtgctgggattacaggtgtgagccactgcgcctggctgcaaatttttttttccaactagttgaatttaccagtctcttttatagcttctaggttttgtgtcatacttaataacatccttcccattccaatattttatttttatttattttttgagagaatgtcaatccacctttattggaggaaaccttgcactgtaactgttttaaataatgtgtgccctgccccaccctgtgcctggtgggctcagaagatcatctccagctgccgggcatactcggtgacctgtttggccagttctgtggagggaatggtagtgtcttctggctcctgctgctggccggcaaaactatattagttgttggggcccgggacccaccctcacttcttggtgtagtcggtcatctttttgggtgtgttgaagaagaggatctggtggcctcggtaaaagggattttctcataggctttcttgatgcacccggccatctcatccctgatagtgtcaagcaggatgtcgatgaagacggtgtagctcttggcgaggatgttacccttggccaggaacactttgttgtagctgccctccattaggtattgctccagggacacagggtttttggtgtagacattggtctggatgtccttggcaggcagccactccagctccatgtggaactcagccacccgcttctgggacagcaggaagaggagattgaggcccaagagctggtgcatgtaggctgactggggaagctgttccttgtaatcaaagtagcagcatttgagctgggtcatgtggcgctggaaggaggggatgtcctcgcataggatgctccactggccccgatcttcagtatgtcacgggccagaatgagctgctgtttggtcagcttggtccctgtggttggcaagaagttgagctccagaagaactagcttgaggcagcccagctcttccctgcacttgctaagattggggcttttacggttccactcgcccttgagttgcttgtacttgccgtcctcagcctgcaggacagggccctaggtcgccaggggcccggagctcaaggcgccggctgcactgttcacctccacccccattccaatattttaaaagattctccttttctggtattgttaaaagttttaaaagtttaaatatttgatccattttgaatttattaatattatggatgaggtatgaagtctgactccagctttttctttccagttgtcacctgacatctctttacagtttattgaattcatctttcccccaccaattttcaaagttacattttaaatctaccaaattcctgtatacttgggtttatacgcctcttggcatagcgagtagttaaaagcacaaattctgaggcccaattgtctggacttgaatgcaggtcacccctaattagctatataacctcagtctcttcttctgtcaaatagactattgagaagatcaagttagttaatctatgtagcacacttagaaactgcctgtatgtgtagcaagcacttagactaagttatttttttaatgtggtaaaaacacataatataaaatgtatcagccgggtgcagtggctcacacctgtaatcccagcactttgggaggccgaggcaggtggatcatttgaggtcaggagtttgaaaccagcatgaccaacatggtgaaaccccatctctactaaaaatacaaaaagtagccagctgtggtgacaggcacctgtaatcccagctactccggaggctgaggcaagaggggaggcagaggttgcagtgagccacgattgtgccactgcactccagcctgggcgacaagagtaagactcatcctcaaaaaaaaataaaataaaataaccattttaaagtatacagatcagtagtgcagactaaactattttttatttttattagttctgaactttctagtctcttccataatttggtctccctattcatgtgccagtatcgcactgttttaattatgtagttttattttttccttcctatttttttagaggaagggtctcactctgttgccaaggctggagtgcagtgtctcgatcatagctcactgcaaccttgaactcctggactcacgcaatcctcttgccttggctttctgagtagccaggaccacaggtgcatgacaccatgactggctaatttaaaaaaaaatttttttttttttttttgtagagatggagttttgctatgttgcctaggctggtcttgagctcctggtctcaagagatcctcccgcctcagcctcccaaagtgttggcattacaggcatgagccactgcacctggccaagtaaactttagagattaattagggaacactgatgtatttttaatgccgagtcttcctatctcttggtaggcctgatggggcttatgatgagggaggaggagctggggcaggagagcccgacattcaggtctcactgaggggagatgtgcccaggacacttccactggaactgcttccttgatggtgatgtggagtgagctggaccagtgtgtgcgtgcatgtgtctacccaagctcatggcacatgggggagcggagggggtggggatggctcagcagtgattggaatgcaagagtggggactttggggcctgtatgaaaaagtgttatggcagagtgacacacctacgaaagagtgtggtcagcataggcctcacactgggtgggtttttacaaactgaacacatgcatggaaccaccattcagaataagaactgaacagaagcatcctcaggggagccctgaaatccccctatgcacacccctcaaacctccccttatccctcccagctgctccatccacacctccacgtgacttcttaaatcttcagctttgctgcctcatagctaagggggtcagggaggggaagctggggggtctgtagatatggaatgggggtgcgtacatcaggtccctccctctccctgccctcctgccaccttccagaagcacataaaaaaaatctgactgagggccagcctctttgttatactctgagactgtgctcagagatagaagacaagacccctaggccatgcttctgggaaggcagagggctgcgtgttaagcctggaccgagagtcccagagcccagctccggtcctgacaccatgcactgctgtgtgacttctgggccctggttctcctcatccaccaaaatgagcaggttggcctgagtcgtccttaagagtcctgtatagccttaaaacagcgctccttatctcagcaccctacacactggctgtagcttctcctcactgtccctttcaggaccaaaatactgggtgtatccatctgcaggtaccaatggctttactttctaaggccctgctgcgtcctgcttttaatctctttatttctctatctgctccctggggttaggtttgggccagggagtggattgtttgccctccttagatatcctttctttttttgagacagggttgcccagggtggagtgcagtggtgcgatctcggctcactgcaaactccatctccggggttcaagtgattctcctacctcagcctcccgagtagctgggattacaggcatgcaccactatgcccagctaatttttttttttttttttttgagatggagtttcactcttgttgcccaggctggagtgcagtggcatgatctcagctcactgcaaccttccggtttcaagcgattctcctgcctcagcctcccaagtagctgggattacaggcacccgccaccatacccggctaatttttgtatttttagtagagacaggatttcaccatgttggccaagctgatctcaaactcctgaccttgtgatccgaccttctctgtctcccaaagtgctgggattacaggcgtgagccacttcacccggcctaatttttgtattttttggtatggatggggtttcaccattttggctaggctggtcttgaactcctgatctcaggtgatccgccagcctcagcctcccaaagtgctgagattacaggcgtgagctgccgcacatggccttagatatcttttcctctaattagtttataatctctgagagttgacccaggttgtaccttcttggactggagccaggtggttatctctgatgctgccagaggaggattagatgttttatctcctgagttggtcacacgcgcacgtgggtctctgagtcagcattgagcattacctgtttatgggtccaaaggagcctccctcccagaccctctctccagcagtgtacagtccatcgtgtggatgggaggaaggcaaggccaaggtaaatactgactcagacaaatacaagcaggtacaagaagtacaaatacatatgtgggggaggagggagcaggggcctgccagccaaagctagtcatctgagaagagggggttgcggacaggtggggctgggagctgagtcagagaaggttgctgggcctcccattagagcctgggagccttgacttgccgtagcctgcggccttgcctcttcctggacagtggccgagggtgccctctgaaatgttaaggagaaatgaatgggcccagatggtggggtgacttggggaggacgcgagatttggagtccaaggggaggcagttttaggctctaactcatcctatacacgctgcggctgtgggggaagggagagaaaggccaagggcacgactcctggctcctgagagtccccagtgccccattaggttggcagctgcagtgatggcgctgacccccccttgtgcacacccctcaagcctcagcattcccttccctgggcctctgaagggtggaaagatgtgagaagagcagggaagaggagaggaaattgggagagggggagagagagggtggtggggagcccagagaagggagctgggggtggagcatggagaggtacctgggccaagtagagagaggctttggccaggctcatctgggtccagcgtggattccctcatgcatgagctgtgtgaatttgggcaagttccctaacttctctgatctcttgttgcctcaacaatgaaatggggacaagacttcctccctggcagactttttgtgagtagtgtgctcttagggaaagcccagggcgcagggtaagtgtcccagttgctaatgattgttatggttattatcacatcaaagccaggagccagtctcagtccaaagatggagaatgcaagaacaggtgaccaagagcactgggacttgtcctagccctcgtgggaccaaattctatacttgtttccatgtggacacaaggtgtccacaggcttctcctggaggcttctcagcacccacctacttttagatcaagaccattattgctgacaggggacctttgtttcctctgtagccccttctgaaatcctatgcctttgcaacccaagaagctgggttaggctgggggcctcctgtgctgccagctggcctgggcagcggggacctgcgtctctgctcagaaactggggtggtgagatgggattagcaggcacgagccaagcctgtgtcctcggtggcaggccaggcagctggttcaccgcttacataaacggggccaggaagctgaacttgtttttgctggcaagagctgcggcaagctgcaagagagttgagaaatatgtgtctccgtgtgcgtgtttttctctggttattgacatttgcaagtttacttgaagagggggaaaaagtagaaaaacaacaaagctgtttggattcctggcacccaaacttaggtcccaactggggaggaaccccactttcccagagctgtgctgcagggtccccagaccaaagggtgtctgggccatggtgggggtcccagtgtccctgggagggggaatcctaggccaccggggcagggagatatgggcttgcttgttgggagttactaggacctaaactctctttcccttgaggaatgggaggcaagggaggttgtgggaattttccctcccctagagctctccagggagaaagaagcatttttctgagggcactgggatgatctggtcatcatccttctcccaaagccatcaactattaaataataaatccatagattcattatgtgttttcaagctgagtattgtttgcttcctgccctctgagagctaatgattgggcgccatgggatgctagaccgcaggagtgggggcctgtgggggatctacaggtcacagtctgaatcctcatttcacagagaaggccagtgggctctgccaggggcggtgacgtgcccatggctgcctgtgagtcatcacaagaccaggaatagaactcaggtcacctgacagcacagagctgtttcctctacaccaaggggcctcctgcttgtggagatgtactttattttattttatttatttatttatttatttatttattttcaagaaggagtctcgcccaggctggagtgcagtggtgcaatctcagctcactgcagccttcgactcactgcagcctctgcctcccggattcaagcgattctcatgcctcagcctcctgagtagctgggattacaggcacacaccaccaagcctggctaatttttgtatttttaatagagacagggtttcaccatgttggccaggctggtctcgaactcctgacctcaagtgatccacccgtctcagcctcccaaagtgctgagattacaggcgtgagccactgcaccctactgagatgtactttatattaaagaacaaatcaaggcagactgtacgtttgtgtcagcccaaccccacacaattaatagtcagtgattaaactgaccagaccagaccagacaccaacactgactgttgaggaggagcttgggggtttgttttcgggaggcaatactgcctccttttgtgatcttagtcccaggtgaggtgcttccttgtcctctctgcagaatcccattctttcttagcctgggctgaagctgctccctccctgtatgtgaccctggccttggcgcagtccttgggtgctcttcctccctcctgcctctgcgctgcttcatgatgcacaggagccaaggaggggcaggggacagtcggttttttctcagggagattggaagagaacagaaacaagaagcaatggaatgctcctgtcctggaggttggtggggcagtggggagaggtggggaagccattgagcctgcacatacttttgacaggcttggctcatgcctgccaaccccatcccaccgcctgggtttctgagcagggacatgggtccccactgcccaggccagctggcagcacaggatggcctccaacctaacccaggctcttgggttgcaaaggcatagcatttcagaaggggccacagaggaaccaaaagtccccctgcctgtggagtcaggcctgatctctttgagggtgctcacaccctccatgttcccctgtaggtcttccttccctccttactgcatttcagatactccagtcaccagccctccccagaactctcactgttttttgtttttttgagacacagtcttgctctgggtcccaggctggagtgcagtggcacaatcacagctcacttcagacttgacctcctgggctcaagtgatccttctgccacagcctcccagatagctgggaccgcagacatgtgtcaccatgcccagctaattttagagttttttggtagagatggagttttgccgtgttgcccaggctggtctcagccacctgggcacaaacgatcctcccatctcagcctcccaatgtgctgggatgacaggcgtaagccacgatgcctggtgactctcaattctttttttttaaattattattattattattttggagatagagtttcacttttgtggcccaggctggagtgcaatggtgcaatctcagttcactgcaatctctgcctcctgggttcaagtgattctcctgcctcagcctcctgagtagctgggattacaggtgtgtgccaccacgcccggctaattttgtatttttagtatggggtttctccatgttggtcaggctgctctcaaactcccgacctcaggtgatctgcccgcctcggcctcccacagtgctgggattacaggcgtgagccacggcgcctggtgactcagttcttaatgccttgcatatactgttctctctttatggaatgtaactccctgtggctccacttatcaaacccccactcatttatcaaggccccaataaaatctctcttccccctttagaataattgatccctcttcttagttccctcagtatgttggagacatttatatcaggttggcctgtattacagatagttttaagttctagggctttgtggggtttaaagaagattacgatatggaaatgataggaaggagtgccagtgcattgtagatgctcagtagcttcaatatggagttttttttttcctggattaggaacttctgaacttgcacatcatgggtgcacaaaaattattgaattcttgaagaagggacaggcataggcttgcaatcctggctctgaatgctgagcaattgctcacggacaaatgctccgttgattgtgtgctctttgctaaatttcagtgtgtgcaccagccacgccttcgcccccgcgtgccccgtctcctagggcctactatgcaaggcctgtgtcaggccggggtgggagcatgagaatgactgggcatatctcccaggaccaggaaggactgctcctcaggagccccctcctcacctggttcctcatcgtgtctcttccttttggcccttctctttggtagggcctacttagggagggccccagcagattcccaggggaacagaaaaacagacagatgggaggaatcaaggctgagcccagggtatggtgtcttgtgtccaccagggaatcaggcctacaggggagggctgggctatgggtgcagaattcagtgacagtgacagtgagagaactcagcagtgcaagggcaaagtggcactgtttggcctgaaggtgctcggaagctgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcaccagctgggcgtggtggctcacgcctgtaatcccagcactttgggaggccgaggcgggtggatcacctgaggtcaggagttcaagaccagcctgactaatatggtgaaaccccatctctactaaaaatacaaaaaaaggaaaaaattagccgggcatggtggtgtgtgcctgtagtccccaactactcgggaggctgagacaggagaattgcttgaacccaggaggttgaggatgcagtgagccgagatcgcgccattgcactccagcctgggtgatagagcgagattctgtctcaaaaaaaaaaaaaagaaagaaaagagaaaagcatatcacagcagaagactatattcaaaccatttatatgaagctcaaaaatgaagcaaagttaagaaaaatgtagggatgtatgggtagtgaaagttaggttggtgggctttcctgggtattttatgcttcataaattaacttttatgtatgtagcttttacatacattatatatatgaatttgcatgtattcagtattatgtaatacattaaaaacaatgttcgcaatgctaaaaatatattgttgaagattctgtgtgaaagctatactgtagttgtggctttttataaccctttcaagccctctgggcagtagcagtccaccccttattgccctcagtggacttcaccttctagggactcagaatttttttttttttttttgagacggagcttcgctctttttgcccaggctggagtgcagtggcgtgatctcggctcactgcaagctccgcctccctggttcaagcaattctcctgcctcagcctcccaagtagctgggattacaggagcctgccaccacgcccagcaaattttttgtatttttagtagagacagggtttcaccatgttggccaggatggtctcgatctcttgacttgtgatccgtctcgcctcggcctcccaaagtgctgggattacaggtgtgaggcccagctgggactcagattttgctgaggaccaggacagtactgtgtgctgtgtcctggccttgcagcagtgaatgtgtctcccgtttctcaagggcaggtctctgggatgcctgactgtgtcttccttgccagtgcctggctgctgcagcctcctcaaatgtttatcaaacacaggacttgcccaccgtgggagaaagtaaggccataggtgtctcaggaacctgcccaaactcgcctggctgcacggtgacaattcaaccagctttcttacccaaggtctgttggtgaccagagaaaaccttagatgaccggctgccatgatggccttatatctgtcccttttctgccagccttgaggtagagggtgccagggaggaggactctggctctaggtgttaaagtgagagggaagtgtgaagggtatctgtatagctagacagggctcaatgccaggcagagctgtctccgcccctttgatgtctatgtctctgtccctggactgtggccagtagccagtgtggactccaacctcaccagctttaggggtgttatctgcctgggagtcactgatccttactccctcctctgacagccaccttggatggggtgaaaggaaggacagcctgccaagtatgagataaaaacgcctcataaacaagaagggatttgcaggccaggcagagagccttgtgctgcttctgagtcccaggagcatgggcgaggaggtgaggtcaggcactcagcagctgctggtcctctctgaaatctttggccagatttattgctactgcttgctaataaatggttatgcatttggttcaaaggaccaagtgtgcttacatgaaaactggctgtgttccctggcctctgtttccttagctggttggactaatttgattggttaataaatgagtccaaggtggttgggctaatttttatcttagattctatgactctataactgctactcaaaaaaagtgtacttgttcctttaatctttaatcttatttttcttgagtagtagaatacacccaatttttttcaaggggtagagaatgcattttttttttaaccttccagtttggtccctagagtaaacacagcattgctgtagtagatgtagggtactggagggagcatggaacagggaaccagaagccctggttcctaccccagctgggcatctgggccagtctcttgattcctctgtgcctcagttaccaactatataacgggcattctgccatgaataccctgcgatttggaaacctcctgtgtacgtgtgcacttgggtgcctggcattcattcctaatggcatccattcgttcacacattcatccagtactcagcagactcctgccatgggccaggcaacgtcccgggcacttggaatataatggagaacaaagcagggtgcctacttctgtggtgcttggagtcttgaggggaagagagacacggaattcgtaattacatggcagcgtgtgggtgacgtattgcagaatgagggcctagtggagctgggggaccggaaacgatgtttaggccgagacctggaataggaggagttgtcgtggggatgatgtaggaagaacgagtgtgaggaggagagcgaggggagttgaggggagggctccacaccttctaaggagtggggagagatgaggcctccaaggacagaagggccctgcaggccacgctgaggagcttggacttcatcttgtggatggtggcaggcccttgaagggttttctaatccagggagtggggtggctggatcatggcttcagaaggctctcccaggcagctggatggtgaagaccaggttggggaggtcaccaggagaatgctgccctaatccaggcagaggtgacggtagcctgggccacttcatcattatcactgaggcctctcgtggcttcctcagaccagaacgaagcccccttcttcagtggctgtgggctcaccaagtgtcttctccctcctccagaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatggtgagttgtgcctcagaggtcccggagatagttcccgtaagaaatgaggctttgtgcattccagacagtccctgtctgagccttcaaactcccaccatttccttggcgcaagaattttggggaaggcccaccaatgtctgccatccagatgctggcaaagactgctgctgggtgggagtgggagcgtctgactggtggggaacattggctttgggagttaggacttttggtgaactggtgaatagcctggggcccggagtcaggcagcctgggtttgaatcctgctccctcacatacagcttaacttctccacccttcagtttcatctttggcaaaataaggttaattttattaccttaccttagagttgttgcaaagggggtgtatgtgaatttgcgtatgtgtgtgtgtgtatatcacacacatatgctgctaaaaagtctgcatagcccatcctaagctctcaaattagctattcttatttttttagaattagcaagttcttagctccctcatacctagataaagacttcctggaaccagtgccctgtgtgtcgagccctatgccaaggcactttcttccttgtatctcttgtaatccttcagcagccttgtcagggaaagcaggcttatcatcatttccatcatcattacattatcatcagtttattttatacatgaggaaactgaagagcagctaggacttgcccaaggccgcacagccaggtctgtgtgactccaaagccctttttttcgatcatcctctctccccttcagacaagttggtcctgaggttcttcccttcccctgtcccgggatccgtgtctcagactgaaaggaggactttggtgtcctttaatttcccagctgcgattccattcatgtgtggctgagtgtggccagggtcctgactagctccagggctggggccgaggggcccagccacgtgctcccctcaagggaggctgccctgtctgcgaggtcagtgcgccccaggatccccgcccgcctgctgacacctgcaatgctttcctttcagttccccccgaggagccccagctctcctgcttccggaagagccccctcagcaatgttgtttgtgagtggggtcctcggagcaccccatccctgacgacaaaggctgtgctcttggtgaggaagttgtaagtatcttgggctgagctatgtgcatgttggctccctccttcccgaggccccccagagaggggctggttcaggtgatttcaaaacattatcattaggaattaattccttcaggctgaggaagaggagatgagagggaactgagatttacatttgactgccccccctgagctaggcactgtgcttgtgcttggaaccttgtcctattcacttgaccttggttatcacaacagctatgggaagtgggctttatttttctcacttaacagatggagagactgaggcccagagactgattaacaggtttggttcacttagctagtaagtggctctgctgggaattcaatcccagtctgtctgatttcattcaaagtccgaagattatgggcgttgctctgaaaaacatgcaaatatccctgggagggggtgtagcacagccagaccattatcagtgtctgggcccttgtgggcgtatcaggctatttccatgataaagacacgagagagaaagcggtgatgggcgggggagagggagcttggggccgtggggggagaagtcacgcctgcctgggggctctgcatcatcaccggaagacggcttaacgtgggaagacctgggatgggttcaggcatggatgtagaggaggtggaagatgctgaaaacaaatctgcctctgcagttttgctggtctccatcccagagccacagtctcccttagtccagaggtttacaattgagtttgagctgtcagtcatcagaatatagggcaaggaggtcgcattccaagacccctagtggatgcctgaaatcgcaaatggtgctgaaccctatatatagtatgtttttctatagatatgtacttatgatagtttaatttataaattaggtgcagtaagaggttagcaataactaaaaatagcatagaacagtgataacaatatactgtaataacagttatgtgaatgtggtctctctgtttctcaaaatgtcttattactgtactcacccttcttgtgatgatatgaggttgtgaaatgcctgcatgatgggatgaagtgaggtgaatgatgtaggcattgtgactcagtgttaggctactagggctttctgaccatgtgttagaaggaggatcagctgttttgggtgactctgggtcaccgagccatgatgatggcggtggatgtcaggacgagtgatgggtagcatgcacagcgcaggaatgctgaacaaagtgatgattcatgtcctgggcgggacggtgtgaaatctcgtcacacttctcagaacagtgggcactttaaaatttctgaagtgattatttatggaatttcccatttaatatttttggaccgcagttgaccacaggtagccgaaatcttggaaagcaaaacctcagataaggcaggactactgtatcagaaagccagagcagtgacttcaatagggtggttcagctcccacttgggtctgtttccatagagttactgggctgcctggcagtcatgtttttgttctgtcctctatgatgaaaagtgcggattaccatctgtgaatgatgcagctgccattagcactgtcagctcatgccccaagcctggatagcttcacagcccagcaaaggatacaccttgtttgtacctcaaaggcttgtaccatagataggattagccaggatagagactgtggctggcagcttcccaggccagcctgtggaaagctctgtcatttctgacacttcaactgaaatacttttttttttttttttttgagatggagtttcgctctgtcgcccaggctggagtgcagtggtgggatctcggctcactgcaatctccgcctcccgggctcaagcgattctcctgcctcagcctcctgagtagctgggattacaggcgcacaccaccacgcctggctaatctttgtatttttagtagagatgaggtttcaccatgttagcggggctggtctcgaacttctgacctagggtgatccgcctgtctcggcctcccaaagtgctgggattacaggcgtgagccaccgcgcccggcttgactggaatactttccatgttgacagcgggagtgggagagagtacagtgcttgtcctcccgagcagcctcgtgcctttgcttccatctgctttgaagagtcagcatgaccactgggcgcctttgaagtgaggaaagagcaggggaagtggcttcgagagcctcaggggccccagcccccactgaggccccacccagacctcaggccactgcagggcctggaagagacaggcccctggaaagggattactgggagctctgctttttctcttgtgtgtctgctttcacacccttgcccaactgcagcactgctccctccttcttccacaggcaggggtgagctcagcctctgccttggaccaggcgcagtgctggggcagtgggaggaagcgggccaacaagactgagccccggccctctgaccccacctgggcacacacgtaaagcagtcggtgaccctgccttcgtggctgggtggaagcctgggtggtgttgggggaaggaggaaaggggctttaactcagcctggaaaggttgggtttgtcccatgtgctggattcagcaggagcccagggttcgaacccaagtcagaggtggcagactcgtcaccccagctggagggtgagtggttgacgtggcctcacatgcccacatgtgtcataagagggtgaagcctcaggtttccaggccaggtgggatggtggctgactcacctcgaatgtcttcagttacccagaattcttttctggactcacctgccagaacccctctagcactttttgtgtctctggagtggcatttctgctgggtgtctagtcatctgaggacagatcttttttgttagtgccttgaaggcagggtggggcctctcttgattcatttctatatcccctacagtgccaagagcacaggcccagcgggagaccagagctggccagccgaccattgcctgagtgactagctgagccctccagcctagctcccctcacccctcgtgccaggcgctaggctacatgtttatatatatttgtaaatccagctagtttcctcatctctagattttacatttattgctcaatttttttttttttgagatggagtctctgtcgcccaggctggagtgcagtctctgtcactgcaacatctgcctcctgggttcaagtgattcttctgcttcagcctcctgagtaactgggactacaggcatgcgccaccacgccaggctaattttttattttattttttgtatttttagtagagacagggtttcaccatattggctaggctggactcgaactcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgagccccgcgcccggccttatttctcagtcttaacagaaccagccacgtgtgattgttcatgcctgtaatcccagcactttgggaggctgaggcgggcagatcacctgaggtcagcagttcgagaccagcctgggcaacatggtgaaaccccatctctattaaaaatacaaaaatttgctgggcacgctcaggaggctgaggcaggagaatctcttgaacctgggagggaggcggaggttgcagtgagccgagactgcgccactgcactccagcctgggtgacacagtgagactctatcacaaaaacaaaacaaaacaaaaacttaacccctactaggtaagtagtattaatattcctattttcaaatgagaaaaggagacttagaggcacagggcttataagtctggagctgggattcaaaccccgggattccacttcccccttctgtcccgtcttgagtctgtgcgaaactgacaggcaagccctgcccttgttttgtgtctaacagtcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatctgtacgtaagctctaaccccctctccagcagtttccttctcttttgatttaatactccttatcgacttctcagagtggcagggaaggggtggttgaggggtttggtgagttggtgccttttgggcgttgcttgccgggaggtgtggcaatgataaagcaggcccttgtggagctgtgcatggggagtgaacggggctgggtggggccctgcttgctgggatctcagcctacatgggcttctctacactatatttggtgctgcaaaggagtcatgctcacttttcccacagtgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtaaatttatgttttacttctggtcagagaggcgcccctagatgcttaggcgtagtagaaagggtactagaggccaggcatggtggctcacgcctgtaatcccggccctttgggaggccaaggtgggcgaatcacttgaggtcaggagttcgagaccatcctggccaacatggtgaaataccgtctctactaaaattacaaaaaattagctgggtgtggtggcgcacgcctgtatcccagctattcgggggctgagacaggagaatcccttgaacctgggaggtggaggttgcggtgagcagagatcacaccactgcactccagcctgggcgacagagttagactccatgtcaaaaaaaaaaaaaaatagaaagggtactaaaaggaaaaccataggctctagttcctgcttcacaattggctaccttcgttgctttggataaatgttttaagctttctgagccttggtggtatatcatttattaaatgaaaaggataatgccaggccagtctcctcttcccgggcttgtctgtgaggagagcaatgtgggaagagatttgggctgtagacatgtcaagggttgtggcttgcaggattctatagtgcatgggtggggcagggactttctgcttcagcttccgtgggccctgagggcaaccccctctctagcagagcctctggggttgtgggagcctctagaggcctccgccagctgaagcacagggctggccaaggcaccaacccactggggtgctacctgcccagcaccatcctggatacctccccagagtcaccgtgcccccgccctcaggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggtactgcggtgggcactgagaaaggaagggatgtttcaactgtcattgcatcaggtatccattgctatgtgacaagttgcctcaaaactagtggcttaggccaggtgttggtggctcacacctgtaatcccagcactttgggaggctgaggcgggtggattgcctgaggtcagcctggccaacatggtgaaaccctgtctctacgaaaaatacaaaaaattagctggacatggtggcaggtgcctgtaattccagctactcaggaggctgaggcaggagaatctcttgaacccaggaggcggaggttgcagtgagccgaaatcgcgccactgcactccagcctgggtgataagaacgaaactccgtctcaaaacaaacaactagtggcttaaaaacgaccatcatttatcggcttgaaatttcaaaaatacagtcagttaggcagctcttctgctggtcttgcctgaatcaggaatgcagctgccatcagattgggatggtctgagatggcctcagtcacatgtctgacgatggtgctggctggtggccgaggccctgggttctccctgtggcttctcatcctcagctgccagcccagactcagggcaggcgggtggggatcccaccacagctggagggatgcactgcagagaagttagccgtatttaatctagggctttttatttttttcaaatgttaaaggtagtaataattgccattggggattgttgaaattagagcatgaaaaattccagaaagatatgaagaataattatcaccagtacttttactccctagagaaaaccagtgagaacatgttagtatgctgctttcctttttctaggtacatgtatgtgtgtgtgtatttatatatataaatgtaatattccccatgttgtcaattacttttggaaacttattatttagtaactgcctgattaatacatatattttaaaactccatggaaatttgttgttgttgttgttgttttgtttgtttgttttgagacggagtctcactctgtcacccaggctggagtgcagtggcatgatcttggctcactgcaagctccgctttccaggttcatgccattctcctgcctcagcctgccgagcagccgggactacaggcacctgccaccacgcccagctaattttttctattttttagtagagacggggtttcaccgtgttagccaggatggtctcaatctcctgaccttgtgatccacccgcctcagcctcccaaagtgctgggattataggcatgagtcactgtgcccggtcggaaattttttttaacttaaatttttttttttttgaagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatggcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaaaaagaataagatacccatttatttgagtaagtatggataaaaaggaaaaggtagaattgacatcagtcccatcccgacccctgccactttctcccagccctggccccagggagagaaggcttttatctatgggctgcacattcttcccccagattggatggtgtggggtgatggctcttcctcctggctggctttgtactgtggggtccttgtcccttgtctttcctgtcctggggagagccagaggagtatgctggggcttagggtgtaatcctagttggatgcaataatatgaagtgccggcttccatctttgttggcactttccttgttcatcaaggacaggaggcagctttctattgggccctctcctcaaaagcttttttcctgctcagacctggacaaggagtggggcctaactactctatcttacttagggagaccattttaataaatcagtgcatccttcagggtagatcgtattgacctgtccatggttttctttgatttgtgtatactttgagccaaacacactcatttatctgaatgctgagcatcagtatggctttgggggcctttttaaggggggaaaaatcagctctaacatcgtgcagaggaataggaattccaaatataggctgatccctattttaccttttattccaaccacttagttcagatagtcacaagcagcttaaagcttgtgacaagcagcttaaaagcaatcttgcttttttataaagtttcttctaaaaattttcaaattgtaaaatgtacataagatttaccatttatattattattattattttttgagacggagtctcgctctgtcgcccaggctagagtgcagtggcgtgatctcagctcaatgcaacctctgcctcccgggttcaagcaattctcctatctcagcctcccgagtagctgggactacaggcacctgccaccatgactggctaatttttatatttttagtggagatggggtttcaccatattggtcaggctggtcttgaacccctgacctcagg

SEQ ID NO: 15724 - DNA, 51111 bp, Human
  misc_feature (1)...(51111): n = A,T,C or G
actgaggcaggaggatggactgagtccaggcattggagaccagcctgggcaacatagtgagaccttgtctcaaataaataaatcaaatttaaagggaaaaaagccaaggctcaaatagcatttataccaagcaattgtgggaagagaagggtgacatgtctacatacttgtgtttaagaatctgcttggaaaaaaaaggaaacataaaaatgcctctgccaaaagaaaagtcttttcactctaagcctttttgtgtttttccaaaatttttttttgccatatacattcattatatttcagcattaaaatatttcacctgtcaacttggaaaagtaaaagcgtgaatacagtaaatatttaaaaacagatgaagataagtaacaggttacattaattgtatacaatcaatctagtttgaattaggtgtagatataataattctgtgtgtttatcttggtgaagaatggtcctttaggttgtcattaaaaagcacctctgggaggtaaaagacataggcatctggaagattcatatttaatgaagttaggggacatttgatgtcactccccaggtgtggggagatatggacagaaaaccagaaggaacgaatgtggtcaggaaggaattggagttcccctccaaacagctgccacaagaagtccacacacgtggagacagttgtgcaatttggtcacagagtgtcctaggtgcttttgcttcattgctcctccactgaagcacgctggcagctggcctccttcccctgggactaaggatatcttggctggaactctgctctgaaaaggggcatggccaaactttcactagggctcttcgttggggagcacgatggacaaaagccttcttggggctaggcaggtcacttcaaacttggagccgccaaatattttgggaaatagcgggaatgttggcgaactgggcaagtgcgttttctgattaagagcaaccagattcagctttttaaactacaattatactggccaaacaaaatacccttatacaaaaaccaaaactactggcaggagtcgctgccagcttgcgacccggcatacttggctgagtatccgcttctcccttgtggctccaaactgctgcagattctcggccacttcagacgcgcgcgatggcgaagagggtcctgcactttgacgcgcctggtgaagcggctcttcgcagcgctcctggtgatgctccccaaatttcggggaccggcaagcgattaaatcttggagttgctcagcgcccgttaccgagtactttttatttacaccagaaacaaagttgttgctctgggatgttctctcctgggcgacttggggccagcgcagtccagttgtgtggggaaatggggagatgtaaatgggcttggggagctggagatcgccgccgggtacccggttgtaggggcggggctggcgcacgggaggagccctcctccgctccggccccgccgctatggccccgcctccgcgcttctagagtgtcggcacaggtcgcactcgtcactgaggtccgcgaacgcgagcaggcgttcaattgtttggtcgcttgcgttctctgcgctggcccgacattacttgtcgccctgataaagttccgtttgtcaccctggataccttctcctaccgggcaccggagtagggccttgtacctgtgttctgccctgtttcttcctatgctatttgccggcggacgctctcgtaatctcgtatcattatctatcctgtttcttgtcnnnnnnnnnnnnnnnnnnnnaccagaacaaagttgtgctctggatgtctctcctggcgacttgggccagagcagtccagttgtgtgcgaaatgggaatataaatggcttggggagctgatatagacgcgagatacccggatgaggggcggactggccgaacggagagcccctcctccgatccggccccgccccgcatggccccgcctccgcgctctagagtttcggcaccagctcccaccctgcactgagttccgggaccccgggagagcggtcaatgtgtggtcgctgcgtttcctctgcctgcgccgggcatcacttgcgcgccgcagaaagtccgtctggcagcctggatatcctctctaaccggcacccgcagacgcccctgcagccgcggtcggcgcccggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtaaggagcccactctggaggaggaaggcagacaggtcgggtgagggcggagaggacctgaaagccagatctaactcggaatcgtagagctggagagttggacaggacttgacattttgcgatctttcatttaccagtggggaaactgaggctcagagactggcccaagattacccagcgagtctgtggtcgcctgtgctctagcccagttccttttctaggactctggtttgcgacagggacctcggctggagcgtgtcctgagatgccgacacaccctcaggctcttgggaggctggggtgggaaggcgcctggggttggcaggcaggaggtgcctccgcaggcgagaaaaggcggtgaaaagttgtctggctgcgcgcaacatcctagtccgggcccggggaagaaaaccttgccggaatctcaggccgggtctcccggatcggacggtacactcggttctgcctctttgcgggacccggcccgttgttgtcttcatgctcgaacacacttgcacacccactgtgtgaagtggggtctggagcggagagaaactttttttccttccttggtgcaggacgccgctctccttgcagagcgaagaagggggggaatagggacttgtcctgggggctttgacagcttccccaagggtctccaagtaacagccaactgtcctgcgtaaagcattgcacatctttcaaagcgctgtggtccttggtgtaagcgcatagtcagaagttcaagctccgaaaacctttcctgtgggccttggtacctagctttagtgccattccttcctctccctgccgcctaaaatttccgtctccttcaattaggaacacacacgttcttcatgcaatagctgtctgtcttttcttcctcactttcctttctctctcaaccccttagataatatttctttcctgcagccagtttgctgatatccagatttccaccctttgcagggtgagaaaggggaaagggtcagagaaagaaaaaaaaaaagtcgaataattcagggaaaaaaatttcttacttcctaagacaagaatcacatgtcttagaagacactcacacccacatacagtaccaggatcatctgtccatggttactgaattttctttataatgacttggttcaacgggtccagtccaccatggacactcatttgtcccagacaagccctctctctccccctttctgggcagagaatgaaggtctggaacatgtggttgctctgtattccacaaagaagtgagttgcttttaagcctggggtgtttcctagcgtagtagtaacggcaggccggtcgccctgaatataatggtgaacttgcccttttggagtgcattacttgcttaattggattgggctgtaattggtgccatcaaattctagagacagaggcactgttgtttttccttcccgtctttgagctggaagggtaacagtgcacaaattaattaatattggttatgggatttgaacatagaagggctttttattgagtagtagcatatgtacctcttacagttatttctttagaactttctgaagagtccagctcaagcttgccaatgaaaacgaatgacatttaatggagcaaaaacaaaaaacaaaaaactatgttggtctacaaatatgaatttgaagttattgagagccttgttgaatagatttttgttgtaaacgtgtctctagaatagtatggcattgtctcagcttcctatgaatgaaggacataccttttcttttttaaaatatttgttacacaggaaagtgtgtctagaatgtgatctgtggcaataaattatgagagaccttcaagagtttctgattttggtagccgagtgggcacagtttattgagaatcatttttactgccatttgttttctcacaagaatgtgcccaaataatggtttttttctcatttggatggcagtgtgaattgtacatcatgttttcagcatctttctcaacctagtgttccccagtcaagtttgaaatctgtgttatccaaatgaattgttttcattttccttttcttagacaaagtgggactccaggtttcattttgcttttaaacattttggttttttgtttgcctgttttgggggcagttatttctttcatattaaaaagtactgtgcaggctgggtgcagtggctcattcctgtaatcccagcacttagggaagcagaggcaggaggatcgcttgagtccaggagttcaagaagtgcctgggcaacatagcgagaccccattctctatttaaaacataaatgtaacccccgttccacgcacaaagtactgtgcaaattaattaaacatgaccacccagaccagcaactgtccaagagtggcccatagaccatctgtggtaggataatttgaaatgcttgttaaaatgcagatttgtagacccagggatattctgacagagtctaaagtcttaagaacaaaactgttctaaacataagtcagtaccaatgccagttaatttctgagatatattgatataacttagtttccagttttttaaaaaccatattattgacttaaaaaccatgatattgaccagttatgtcagtaacttattttgcacatctgtgtggtgtgtgagaacatgtgcagtcacttattcattttgcctgcatttgttcatattgggatcctcagattcaatgcactggatgtttgcactgggtatttacttatactctctctatttattccgtctcatacttcgtcctatttgttcatactctcttatttgcccagcaaggtcaatgccagtttaggcctagggagtcattttttcttagttgatatgacttagaaagcttgggtgcctgcccaacatcaattacttttttaaagctggtattttctaggtcttgatatttattaagaccctagcatagtggacaatttttctttctctcatgctttttcaacacctcatagctcttcacatttagttgacagagaattcagttatcttgctgtagagtgacccatggtgaggaatctatgccatggtacttttctggttcttatcccttataggtaaagacaagtttcttatgtctgaagcttgatgtcaggatgagttcagggctttgatgaataagttcagatctcccaattgtaattcattagcattgcacttaaaaaaatttatatacgtttttaaaaaagggtaatgctaatgaattacaatagagagaaaagtacattagtttgcatgtatgtgtgaaactgggaaaatttttcacgaaaatattcatatactttttaaaaaaagggtaatgctaatgaattacagtagacagaaaagtatattaatttgcacatatgtgtaaaattgggaaaattccacacatacataaaagtatattaatatgcatgtatgtgtggaattggggaatgttttctcttcctcagtttctctcccttgcttttaatgtacagtctttatgagccattatttcagctgtggcagtttggttaccaggggaagcgcactagaaaattgataaaggaaaatgagacaaggtcatagattctctcactcccttcagggtacgtagatgaactatataaaaatccgtctaagtgggattcgttaatcagcaatttagtcaaatgtgtacatcctatgttctataagaaatgtcagtgggtcctttcccaagggagtgagatcatcagatgaaggttcatttggtttcaatgtcccgtatccttttgtaagaccttgaagttggcaatgcaggaaaacaggaactccaccctagctccatgaattgcagaactgttgtgttggtttatgaccatctgcccattcttcctgttatgacacagcttgtgaacttttactgagaatggtgaaaagtaaattcccagttttatacaatgaattgctgaagaggccttttaaagtatagagtatgcattgtttatggaaggtgtttcctattaggtctaactcagtggcaactacattcatttatttaatttgtttctaggtttgcctagtgtttctcttgatctgcccaggctcagcatacaaaaagacatacttacaattaaggctaatacaactcttcaaattacttgcaggtaaggattcattctagatctagatttcttgtgttaagtaactgattgtttattgagtggaaataatttccagtagagcagaattataatagagcttgtagtaattgttcataagtggtgaggtttctaagaactgatgtaataatggaaaatgagaagaattttctctcaaaaattctgtacaattttgctggtgtttttatactattctctgccaacatgcatacacacacacacacacacacacgcacacaaatacacacacacacccacattccaataaccagtacagccacctggcgtatagtagacatacgctcaataaatatgaatgaataaatgaagttgagggcatacatttaaggaatagagttgaaaaaatttgggactatatttattatgcttggtatgattcttgaacacttattatccctttccaaaaactttgctttataagaaatttattactataattacttaggcagtaatatttaatagcaatttaatatttagtgggtaatattactgagcgcatgatctacataaataatggacttcgggccctgccttgatattctggaatgcatctttccccacttgctagcaagaagtcatgctattgatttttgataactggagaagtagacttctttgtcaagaagaagaggcctttaaattttgcctttcaacccttaccccaggacgaaagatagaagacccttgggtttaacatagtgatcacacacgaaaggcatggagccttcttaggacctgtgtgtttttggtagagactgtgacaagtggaggtgatgttaccctcctggaagagtgctgggggtccacaaaggaccttgggtaggttattgccattgcttcatacttgttgaatactaagcattaaaccgaatgacatacatctattttagactgcagtataaagaataccctagccccttaccaatacccagcccttgggaaaaaacacagtagcaggtgctgtttctctagctttacttgtttaagacacatttcccattagattttccttttaccgaccctcgataacaaggttatttgaaatccccaaggatcccatgctccctttttaaaactctgcataaacatttcttatgttctgaaaaaaaccatggagtgtgttaaaagtaacttcattgatttagctgcaacttcctggaaattttaagttctttgaatgaagggccaataatgttacattcttcttgatgttgactatcttcttatcttccttggggccttgtagagaaatgctgcagtacaagccatctatgttttaatgcgaggtccttacaaggtcctgagggactcttacttgcacctccttccttcctaacctcacttcttactcccctttgctcactcttacctggctgctctggtttcctggctgttcccttaatactccagatatgcacctgctccagggcctttccatgtgctgtttttgctcctgtaatactgctcttcatgatgttcctatggctagctttatcaagaccacctcctgcaaaattctttactcttttctttgtatcttctatatttttctccatagtactaaacactatcttttatacaataaactttccttactttttaattgcctgttttctccagttagactgaggttccataaaggcattgatttttgtctgatttgttcactgctctttctctagtccttaacaagtttggcacatagtagatgcttaatagatatttgttgaaagaaagaatgcattaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattctcatgcctcagcctcctgagtagctgggattacaggcatgcgccaccacacctggctcatttttgtatttttagtagagacagggttttaccatgttgcccagcctggtctcgaactcctggcctcaggtgatccatccgcctcggcctcccaaagtgctgggattataggcatgagccaccatgcctggccggtagaagactgactgtgtctgttgaagagtttatttaagtttcaaaaccaaattttctcttttcttagaaatagcctcacagtctggcacttcatattaatacctccctgaaattaatttttcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaaggtaagtggtgaaataaaattcatttcccacgtctctttaccagttataaaagacaataggctcaaagaagaattgagtacaacaaagggcttgctctaaaggctgtttgccaagaggaatacacacaattcttctctcctgaggctttctctgagaaataagactcattgattctggagcttgggccgtgttacctcttttttgcccagttagtttgggtctgatctttgtttccaaggtaaatctgtgttcactgttggccattgagacttataaaaagtcttcctatgtttgagaagaaaacctaaaattcttgaaatcgaggaagatttgggggtgaattatggagaaatttctgtggagagataagttatctacagcagagtaggagattttcccaagaatgcataggaaagcattttttgccaagggctctggagttttttgcacataggaacctttttttcttactagtatttcataaaaaacaattcccatactcatgtgcaaataaagacattgcttcagactcttttcaggacaatgtttctttcctttgcttgtttggtctgagatcttggatgatatgctgtatctttctaggatgtgcagtttgggattgatattatgaaggctgacttaacatccatatagtataaaataaatgtcacacatattctgcatttataatgagttatgcattcttttgtgtttcaaaaatcttacactatcttatcttttctgtgaaaacctaacttaactaatgagatccctatgatataaatttaaggaatgtaagggctgcatcatagtttggttggatgtaccaaatatttttcttttcagtgaagataaacagacattttatgtatttacgtatatgcctttttacatcccagagtatttgagacaggtgaagatgacttagacttttttcccagaagcagcttttacagggcaagaatttcatcagctttgggaaacacacttgcatatctctgcttacatttcagtagtgtaatatggtcagtgcaatgaaaaagtggagaccacatcaaaataacctatgccactggattcacaatgtttgagaaatatctttgcccagagtaagcactgtcaaagatagaattctgtgccctcctccttccctccacaagatttgaaagagacaaggctcacatcttggagaatttctggctccttttgacctggcagtcttgagagatgcagctcggtcagaagattgcaaggatttcctgctttcagcctgtctagaaatactacaagatgaacatcccccatatctcattatttacttcttcctaagtcaggaaacttggagacatgtgaaaattcatttcatgagtttcagtaaatattttattttgagaggctgggtggtggtttgggtttcttttgtttatttcctttttttgagataccgaaatagaattgatttactaaataggtttagtcttacgtcaaagggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggccatgaagttaaacaatgggaaaggaaacactgaagtattctctatggataggtgtttaatgtcccctctggtcgccaccttacttccctagtcttctgaccccattctcttcagcaatggatggagccaggaagtgagccctggcctcataagataatggctatggcatgtggtgggctagattggctgcttttctgtgctttccagctgggaaggaaatcaaacttctgctgttgcagggaattagctgcctttgtcccctgtggtttaattaactctttcttcactttgactgactattatgaagcactctgagaatgcttgatgagatgtgttgggcatagcaatgtgaaatgttatctctctgagatttcaagcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaaatgattctcctgcctcagcctctgaaatagctgggactacaggtgcgtgccatcatgcctggctaattttttgtatttttcgtagagatggggttttgccacgttggtcaggctggtctcaaactcctgacctcaagtgatccacctgcctcagcctcccaaagtgctgggattacaggcgtgagccaagaacccagtcagaatctcttcagttttcttctcagtctttggagtggtgacttttcaaatgtttgtcattgaagatatcaatgactgctaaatgttaaactaaatgcaaaaacaattaaacatggttttagaaagaatcatatccctagtcttcagaatcttaaaatgctcacatgaatggtcctcttgaataaccaaattcaaaagtgttagctgtttcctgttaatctaaagatcctttgggatccattcatttattttcatggaatttacattatttacctaaagagagagcacatgagtattttaaatattagtaaaacttgtcggtaaagtgtatagatttaactttaaattttaaagtaaatattatccttcattttgaaaaaattataatgattaatcttttaaaatgtgaaatctataaaaatatattctgcttgtcaataaaccttgtgaaaggagtcaatctcaattgggagttttttttcaaaatttttatacacacagatatatacacatgcatgtgcatgcacaaacacacacacacacatacacacacaccctcatgtagcacagatatctatcagcagaataatctgtggatgcctttggttgtgtgaggtgtcccttccagtcattcacttgtctggttagagtttaggaacctgaaaaatgaccaacttttctagtaaatactattaactcattaataaaactaaattttcttctagattacagatctccatttattgcttctgttagtgaccaacatggagtcgtgtacattactgagaacaaaaacaaaactgtggtgattccatgtctcgggtccatttcaaatctcaacgtgtcactttgtgcagtaagttgcatctcctccaatcgtctcttaagtttttataattttaagctaatattaagatgggtaacctgtttataatattcacaatgagttttaaggatcctttaggaagggtcaaatgcaatgaataaaactaattagtattcttaaaaataagatgaattcttcagtgatcattgtacatggctctcatttttggtactggattaaatatttgatatgtctttttattacccagagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtaggtaagaggacatttcctttccatatcattaataacatatccttgtattaagatcttggagataacaacatagagtgaagaaggatattgaaaagtataggaactcaggatatggtgttgggcaattcatctgctcttctctaccaaataaacccatgtgcaattgaggttgtctcttttcttgccaagattaaggaagaaaaagaaaactttttaaaaaaaggatgaaagcgaatggtattactcgagcacattttatgaagaattcaatgttcagagcattgcttgctatcaattatttcaattatgactattttatggaaacttcagcaatttgctaaagctggccctactggcctagggctactgaccactgaaagtttactacttttctgtccactgggttacaacatctttgagatctgtgaaggtagtgctttgtaaacctctgttggccattttcctgggagctaccaagtattggtgaggcctgcagggaaaaacaatgtggcatgttttaaagttgcattactttaaaaaataaatctgtgcaaagttataggcttatttgctctctcatgttctgttttttcaatttacttgctctagggtataggatttatgatgtggttctgagtccgtctcatggaattgaactatctgttggagaaaagcttgtcttaaattgtacagcaagaactgaactaaatgtggggattgacttcaactgggaatacccttcttcgaaggtaacgctaatgattcaaagccagacctccaaatacttagataataagccccaatgaagtttgcttgagagataggggcctctttggccagataaaatgtaagagccttaaacacacacacatacacacccactcacacacacatacacacacacacaatttaagggaattgcagaacagatagcacccaccaaaaggtgaaataccaggaattttgtcctattctgcaatagccaggctatgaatattagttttctctaggtgattacatctttccacattatgtcatttctctgttctccaaagtttttgatctacattccttttaagggaatttctctttaagaggtggcatgagatacactgctccttaaacagtggtcacatttacttgtgtttctgcagtttatatccatctcactttcaccacgtgaggttttaaaaatcctaattcagttggttccatttatttctcctgaaacaaaatatatttgttgtctgcatgaggttaaaagttctggtgtccctgtttttagcattaaataatgtttaccaaagcccagatttaattctgtgtgttactagaagttattgggtaatgttatatgctgtgctttggaagttcagtcaactctttttttcagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatggtaagctatggtcttggaaattattctgtgccttgacaagtgagataatttaaataaatttaggtcacttagtgattcctattttgttcattcagaagatagtttctagtttttcttgttagggaggccacatgacctagaggtcaagagcatagctttgtagtcaggaacttgggttcaaacctcaactttaaagatgagatgtgctgatatacagtaagagttcatttagtattacttattatagttattgctgctattaggattgttactatgataaatagtattagctaaggtagtttttaaattttcattttattgcaaggctgagaggcctacttgaataagcatgagctttgcaaactggggaaacatttagcaatatacagttgacctgtgagcaactcagggattgggggaactcaggggagttcccctaactttccctcctctgcagtcaaaaatccatgtataggccgggcgcggtggctcacgcctgtaatcccaacactttgggagtctgaggtgggtggatcacctgagatcaggagttcgaaaccagcctggtcaacatggtggaaccccatctctactaaaaatccaaaaaattagcctggtgtggtggtgggagcttgtaatcccagctactcaggaggctgaggcaggagaattgcttgaacccaggaggtggaggttgcagtgagccaagatcgtgccattgtaccccagcctgggcaacaagagtgaaactccttctcaaaaaaaaaaaaaaaaaaatcaaggtataacttttgacttccacaaaacataactaatggcctactgttgactggaagccctactgataacataaacagtcaattaacacatattttatatgttatatgtattatatactgtattcttccaataaagctagagaaaagaaaatgttattaagaaaattgtaaggaagagaaaatatatttactattcattaagtgtaagtggatcatcataaaggtcttcatccttgtcttcacgttgagtaggctgaggaaaagggggaagaggagggggtggttttgctgtctcaggggtggcagaggtggaagaaaatctgcttataagtggactcatgtagttcaagtttgtgttatttaagggtcaactgtaattgaactggaattaaattgaactggccttgagaaaatcaccttaattttttgtttattctctttcatttacataaatgtctgagtttacatggtaatttgtgtggcatcctacttataagccttggaaaggattttggagtttatattatgagaatgcatcaatacagtgaaattttaaaaataccttagataatgctatttattagagttgtaatcataaaagtggcaacaactataacaagtatgatttagtgagcacttactttattagctcatctcatctttgaagctgagattggaactcaagttcctgactacaaagctatgctcttgacctctaggtcacgtggcatccctagcaagaacttgaaaatttcttctgaatgaacaaaatagaaatcactaagtgtcctaaatttatttaaattatttcacttgccaagatgcacttgtcaaaatacacagagagagatgtgctctggcttatgtttttatagaattacttttgttctccagaatacttcagggaaataggggcagaaataaggaggtcagttgggaggctaattgcagttatccaagtgagagttgaggggtggcttagacaagggtagttgaggtggaggtagtgagaggtgatctgcttctggatatattttgaaggtagagtcaacagggtccgctgatcaattcattggttgtggagtataagagaaaaagagtggaagatgactcgagcgttagcatgagcaactgagtaaatgatggtgttatttactgagatggcaaagatcgagaaggcagtgagatttagggaaacagtgttagatatgtttatctggagatgcctgttaaacatccaagtggagatatttaacatatcaacccggaacccagaggagtcagggcagaagataacacatttaggaggtacgtgaatgatactttaaacctgaggctagaggaaggtgtaaataaagaggaggtctgaggactgagtcctggggcctcatggtggaagaggtgtgtggaggctgtcatgggagcagaggagaaggagcacccaagcatccctgggggacttagagaaagctgcacagaggagcaagtgtttgagttgagacttgagcaatcactaggcttgtgggagtgcactagcggggagagaaaagcaaatgcaaacacaggaggtgtgggagaaacacgggaggtgtgggagaagctgaaaagtgacccactgaaagatagtacaggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatccctgcgaagtaccttggttacccacccccagaaataaaatggtaactactggaaataaatgcaaagcatcatttcgtgtgagagcaaatcctttgactatactaattcctgagaattttttttcataggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatggtgagtccattcaattttcctctctgcccaagatttattatgatacattgtcttccaaatcagccaaaccaccgttcctctgcctcctgctgcttcactcatatcatggctgggcctgtgtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatattgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccaggaggagagacatagagtattcaaggtttaacaaacctatttgaccagagcaccttttttcccctgagcaaattcattaatctctcactccaaacagttcgagaaatgcttctctgttgtaattctttgttcccccttctggtacggcatattaaaacttcaggatattttcccatgacattaaggtgcttccctacgtgtcctgatactcttctgtaggccgctgaacttggctttattattttttttcagggaatattttaaagataggctgggtgccgtggtttgcatctgtaatcccagcactttgggaggccgaggcggatggatcacctgaggtcaggagttcgagaccagcctggccaacatgatgaaaacccgtctctactaaaaatataaaaattagccaggcatggtggtgggcacctgtaatcccagctacttgggaggctgaggcaggagaatcacttgaacccaggaggtggaggttgcagatagccgagatcgcaccattgtactccagcctggtgacaagagcaaaactccgtctcaaaaaaaaaagttaacaggttccaaaaaggttgtttagaagcagcataggtgtaggggactggggagaggagaaactggaaagtgtataagtaggatgggaggaggaaatgaacaggaaataaaaacaaaacacggacagcaaatagcccatttcatcagttcatgaagccactaaatattttattcactttagcaaattctctgctatatgaaataaacataaaaaagaagtcaagtcttcaaagcataatctgaggctttaggttgacagtaataaggaaatagttttgactttggagtcaaaaaagaaagaaaggaaaaagggagagaagaaagaaggaagtgagagaagggagaaggaagaaaggggaagagggaaagggagtggagagggagggaggaagagggagagagaatgaaaaactcagatgatggtggcaggaatgcattctctaaagatttacaccttcctttaacatgaggtggtttacgtgtttgggttcagaagtcagagtgtctaggtttgttccaggttttgccgttcgttaactgagtgaccttgggcgagtcatttttttctgtttcatttttttctcacgtataaagctgtggacagtaatagtggttgtgaggattaagtgaatgaattcatgcaaagcacttcaaacaatgcttggcacataataaatgtatttactgtgctatttcagctgttttctgtagcctttccctgatctcctaaacttgagaggacagagagaactatctctgtaatacagatgagaggcacaggatttcaacacttccataaagtcattcagcttgttagtttattattattattagcttattgtcatttttattttatttcgttactttattccttttttttttttttggtagagatggggtctcaccatgtggcccaggctggtcttgatctcctgggcttaagcgatccacctaccttggcgtcccaaaatactgagattacaggcataagcccccatgcctggctagttgttatttttatgagtatcactagaactcaggtctcttgtttccacatctaggtgttcttcgaaaaagaaagtggaagcaaaatcatatgcttaaagaaagtcagctttagttgctaaaatcctctatttcccattcttcaaagctgactgacaattcaaaagttgtttttcccatcttcagtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccaggtgagtaaggccacatgctctttgctttcctgccatcttgcatttcttacagctgagctatgatatgactccatcctaaatggagaagcctaaaccaaaaaaagttttctctcaagaggtagcctgaatctccatccatctttctctgtgtcttacattttaggggatgtctttgcttggagtatcctcctttggggttagctaagctcagccttgttaggttagccgtgaggtacacttctccaaacacaggctatttgctcagtttgctaattgccagtctttggtttttctcccgataccaatcggctggtgaataccacatccctccttcttgtgtgtgtgaagatccatctctcagaggaaatgctgatagatgagaggcagtgatagacccagccccagtcctcagggtctcaggcccagcttatcatgctctgacacaagtccagacatccttagggaaaaacacaacaacagcagccaacccaccaccaccctaagcagtccacttcctgttgttgtttttgaaatggccactatgagcttcttcctcagctgctgatcatttccttcacagagaccatggtcccagagaaattactttaaggagcccagtggcttctaagtttccttgccttcctttgaactaaattaacttgaattgtcttgtcgatccaatttatgaatgaaggtttattcccagaatagctgcttccctcctgtatcctgaatgaatctacctagaaccttttccttcattgtcaatgcctatttttaattggcgccaagtcttgtaccatggtaggctgcgttggaagttatttctaagaacagaataaccaaagtctgaatcttttccttactcttgactctaattaaagaaaaattaaatcataatatgcgctgttatctctttcttatagccaagctgtctcagtgacaaacccatacccttgtgaagaatggagaagtgtggaggacttccagggaggaaataaaattgaagttaataaaaatcaatttgctctaattgaaggaaaaaacaaagtgagtttgaagttttaaaatttgaaaatctctctctctttaatggaaggatggtacaataatatgtgaggcatattggagattaataatcaaatagtctggatgattaaatagagcgtattaagtcactttgaaaataccattgacttttagcagtaccattaacttattaatagcttatcagagaaaaataaaaacatctatgacattaaatctatgcatctgtgtagggtgattctgattttataaacatgagaatgaaaaaatgtgtatcatatcatattaaaacacatcattagtttcatggcttccaaagccctttttatataatgtgtgagctccacagcagcataattatacaaattgagtaaatatcccaaacctaaaaaccccaaatccaaaatgctccagattctgaacctttttgagtgccgacatggtgctcaaaggaaacgctcgttggagcattttggattttcagattagggatgctcaactggtaagtatacaatgcaaatattccaaaatccaaaaaaaaaaatccaaaatccaaaccacttttggtcccaagcgttttgagtaagggatactcaacctgcaattgcataaatttgagcgtgtccaaccgctgcagaagtgggaatggcataggcaggttggagtgattgtggagactgctggactgagtgcttgtgcacaaacagccgcgttgtttatggcctgggatttgttttttccccgcacagactgtaagtacccttgttatccaagcggcaaatgtgtcagctttgtacaaatgtgaagcggtcaacaaagtcgggagaggagagagggtgatctccttccacgtgaccagtaagtactcttctctggaggtttgggttggatcactcacacagtgggtactaagctatgtaattccctgttgtttttgccattcatgtgagtggcatggcatttaggaaagaggacttggattgatcattgatgctttcattcataaattacaacttctcaggtatctcctgggcttatgtgaagtcagtgcgtctaactacactggagagagaatggtttcacagatgctttaaaccacaagctctgtgtggtatttacatctcagtcttcagagtctggcacagtgcctggcttattgagcttcagtacatattggtgggcttgctgtggaacagttgatgagggtgggctttatggaggcaatcagaaggacataggagcagtgccctcccaatgctgccgattttgcctgtgcatcttagttttatggataagctttagctgattgtgctgaatggaatattatagccagggctaattcattggcataaatgtagctttcatatcattgagtgttagtgttaatgaagacctaattttaaaattctgttagaattagagattttgctttggatttttaatatattaaacattgcgtagagctcatagtggagatgtggtaaatatctgaggaattcgtttacattttcaagtaatgtgtttggccaaataagatattttgggacctgaattgtctagtttgtttgtcaagttgtagtacatcacctggaacggatagagcttcatttcttttggtactttgtagtagtctgaaagcagcaagatgatagtgagctgtaccaagttaaatcaccattcaataactatggcctcttcattttagggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctaggtagggagacaattctggatcattgtgcagaggcagttggaatgccttaaatgtagtgcaattcaggtgctatgcaaagattactgtcctctaggagattatgttgtaaactggtgcacacttcttcaccgaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcacagtgaggtctctgtgtccatgagaacaggaattgttctctgttttgctccctgctatagctctagtcatagagcatagcagcatatactaactgctcaataaggcacctgctgcatgaagagtgggatgatgggctgcgtttaagacctagaagactccatgggaaggaagctacattcactgtctgtacctctgggtcatcccacatgatccagcgtagcccaaggtcaatgggacgatcacttcagtgagcagatagctctgtaaattcctccatagaggcactgtctaccccttgtctaaccgcatgccttgtgcaaaagctgggcagccatggctttgtctgtgggaaaatcaggcaaatttggggagcgtctctttgtgccacttctctccattttctcctcttgtggtgtccctttccaattcctaggatatatgtgccctctgttttttttttactgttaggaaggaaattgcccaagtaaattcatctataccacagttttagagggtaacgtcttcatcagaggccttggcgtatttgaagaggcaccttctgacagacactagcataaagttcgctagttttaagactcaggtgtcataataagagatactttggggtcaagtcatccccagcatccttcaagtcacaccacatagatcacatggattttctgttggcttgtctggcttcaaggttatggcagaattgagaaagagatgtgaagtaggctcctggcctagctgtgcccagaaaatatgtgctcgcagttagctgctttgcttccctaaggactcctaacttgttttcctaaaacctattcttagaaataggctagaatccagtacatttgcttagacttcaatgtagtacgctgttgaggtaatctcattttgctaagtgttgacgtggattttttcagcatgattccttttgatgttcagttggttgggacaagatatttccacagcactttgatgatctgaagaaagaataaatctaaagtgttcttgtacacttaaacaaatactcatgggcttcattttctttaaatccaagacttcccttagggtattgttgttttgtttgtgttttagtggaaatagcactgaactggtcttttagcctcaccagattctgtaaacagttcaactgtttacttagttgcagggacatggacaagtggtttaatgtcgctgaacatcatttatttcatctgtgagataacgctaacagtcctattctgctcattacataagatcactagtgaggaacacaaattgtgtaaacaagttttataagaattgccaaataaatgtaaggcattattggttgaatgatactaaaatttggcacttccaagagaaatttgaagggattctagggtattattgactagaatcttcatgggagggaagttttcacctggggaggctgtgtctaattagaggaaaaatccataaaggtgaccctgaacctttcttttgtgatgggattaccagctagtatcactaatatgaatgttaaaagccattaatctgtttgcagtgtcctgactgacttgtttcatttaactttacccagtgaccagtgtattttcccagaagttaatatatcaacaagttcctttttactaaatttaaactgtttaaaactttgctgataccagaaccatttcaaaagttataattccatgttctgtgattttctttttgtgtgtctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggtaaatagaatttggctatcactcttgggttgcagaactttcccagggatgttatctaaaaagccatattatttcttgatgtaatgtagaaaaaaagcagtattggtgtccatgacctggctcatttcacagacttagaattggagtatggggccctgttgaattttcatgaaagccatataggagattagtcagcagtagatcccatgtgactctacagagttagataatagaacaagatgaagggcagcatttatattttctaaatttccctgaaaaacttcacagactacatcatcataaatgagaatgatcgttttcttcctctgttaggcattgtattgaaggatgggaaccggaacctcactatccgcagagtgaggaaggaggacgaaggcctctacacctgccaggcatgcagtgttcttggctgtgcaaaagtggaggcatttttcataatagaaggtcagtgggataaaaaaaaatgtggtacatatacaccatggaatgctatgcagccgtaaaaaggaatctgatcatgtcctttgcagctgcatggatggagctggaagccattatcctcagcaaactaacacaggaacagaaaaccaaacgccacacattctcacttataagtgggagctgaacaatgtgaacacatagacacagggaagggaacaacacacactggggcctactgtgggttggggagaaggagagcatcaggaaaaatagctaatgcatgctgggcttaatacctaggagatggattaataggtgcagcaaatcaccatggcacatgtttacctgtgtaacaaacctgagcattctgcacatgtatcccggaacttaaaagaaaaaaagaaggtcagtgggaagtcatagatacatcctgtggtttttgaagattagtttgtatcttatagacacacattcactttgaatagggcaacgacagatgatttttaatattctttgtactttgtaaattttctcagtgagtatgtattcttttaaccagcaaacataattaatgttgttataattctgcttgcatcacatttcctattcctgcagttcttattgtggaaaaattcttaatcaggcaggatgaatagcctcttctccctgattctgtctttgtttgaatggcttgattaacttatagaaatgatgcctttatatttatttggaaaaacattagaattgctgcctaatcatggcagtcaatgctatccagatagtcacaaggattccgagttttaattggactagagataattaagattcacttgtgaacaatagaccattgctcttctgacatggaaaatttttggtttttatctcaattcgtgtgtatgcagaagtgatgtgaaatctgtcattttcttagctaggaaaagtaatttgtggcagaatattttatcttaagaagtatattcctatggcttttttttttatagcccaccagggaaagaataaaactgtgttgtggggtaaaagaatggtatgcaagggtaagaaagaagtatggtgatagaagggatcgatggatttctatgaactcatcctaacttgtctctcaaagtctagattttggtccctttactctgccaaatctatgatgccaagtattgcatcgagatatgttgacatattttcaaatgtataagcttattagcatttcataaactacacttgcaaataaagatttcaaagaccatggcagttttgtcatttccaaagtgattcatgttttagggcaaatccgcagaatgacgtctagattgtctctgatgctctgcattacctcttgttggtggcctgcagctggttacagatgcctaactaggtaacactggcacagagattatagttacttcttacctggagtgaatgctaagaaaggcagagctagatatttaatactcctgctgggttcccaaatgttatgcgagaatattaatatacaaacacatagaaaacagactctttgaactttttatcctctatgttcaactggacttttaaatctgtgtgtataaatagagaattacttccctaggaccaccagagaaacaaaatttactccaagcataattgtgcttgtctctcaatggttaagttaacttttattttgcaaaccaatttgttacttattttgcaaaccagtttcttacttgtcttcttctctcttgaggccgtagtgggccatccgcacagcttgtggcccggtttgattctccttgcactcttctgatgggaggccccaagtgatgactgcttccttatcatctctttgctaatcactcttagtggaaagcctgtttctgtattttgtttcttccactcagagctgtcctctgaagccctgagcatctgcagctttgcttgctgacttctagtttcctcttctctttcctttcatgagtgatttgaaactcccattaccaggccatgcgtgatgtgctcatcttggctcttcctcttctcctcactcagactcctgccacaagggatggggtagtgtatgtaatggttagttcatgttggacaggcctctttatctcttgactgaaccactgactagctgtgtgccctcagtcaagtagcttaagctctctggtcttctgtttcttcatctgaaaactgagagttgttgaggagattaagtggaatggcatatttaaagtgatgagtgcatagtagatacatggtcattagtaactctcaggtcaaaaaattttgtttatttccctacttggtttcttatgtgatccttttgcaaactctgcacagatcaaaatattgactatcagtttaaaagaagacttttgttttcctcaaatagaaatatttttttttctctgtagagaatgatctgttttctttccatcaaagactgctcttcctctaaacactttctatgtttggcttttaagacattactacttctatgcttaattacttaagaattttattgttgtaagtttacatgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggtatgcacctgtagtcccagctactcgggaggctgaggggggagaatcgcttgagcctaggaattggaggctgcaataagctatgattgtgtcatggtactccagcctggaacatagaaagaaaccctgtctctaaaaataaataaataaataaataaataaataaataaataaataaataaattaaattcaaaaaaagaattctgtagactccattcaagttacgggtgtgtaactgttgtcctctaggatttttccaagttggtaagcttgggattttgctttagtgctaaaatttgtcatcttacaaacaaaaagtataagtttccaactgttgatactcattcaattgtgtctttccaggtgcccaggaaaagacgaacttggaaatcattattctagtaggcacggcggtgattgccatgttcttctggctacttcttgtcatcatcctacggaccgttaagcgggtaaaaaaataatttcccttctgcccatgcacattggttttcatgattaatgaaaactgactggggttctttgagttgtttcttcccattgttattggctcaatgggcacatttttatttcaatacaataacgttcctgcccactttcttttggctggatctcagggatttaattgatagaagccactagagaggaaaagggcttggactgtctagtgtaattaagctttaaaaccttaattctgagctcctttgggggacaagggaaactagaagcagggttataataggaccactctcaaactccatgagttttattggaaaatgagacaggaatgaggctccaataaacagcaataacaagcacacaaaacaacagccaaacaacagtgtgtttatgactggaaggattgatgctttccaggccaatggaggggaactgaagacaggctacttgtccatcgtcatggatccagatgaactcccattggatgaacattgtgaacgactgccttatgatgccagcaaatgggaattccccagagaccggctgaagctaggtgcattttcaattgctattaatttgatattgtgtttaccaggccatctcttcctccattagaatgatgacaaatgtggtgtattcagatgttggattctggtttagaaatattaattccatttcttgaatttgtataatcattcatatagccacttagaggtagggtccctatgtaatcatccaaagcaggacatttggagagtgaagggggagttattaaataattaagccaggacaaaggagtaaactggactatccatgttaaattgggatgtatggtcaccctatctagttgatgtctctgcgtatcactttggttgtatagtaatccaagtctgttttcttgttgctgttgttgttgactctaggtaagcctcttggccgtggtgcctttggccaagtgattgaagcagatgcctttggaattgacaagacagcaacttgcaggacagtagcagtcaaaatgttgaaaggtaaaagcaaaattatgtggtgatctatctttctgttttatctagtctttaaatatgttgcaaggcttgtatcagtagctttgtgcttatgtgggcctactagccacacatgcagtcagcctaaataatgcccttgtgcaaattggaaaaaggatcctcctttgtagctttatgccaggatgcatggtctggcaagcaaagttgggaatggctttcaccttcttgcctggttaccctcgtgcagggctcagccaacacagttgtacttagtggttctgggtacagggaaaaaggactgtggttatattaaaattgtttcttaatatattgtggaatcagataattatagaccatctagagacatggaaaggaagatagtgaaatacaaaaatagcatgttctccagaattggaatatgtaaaagatgttcatatgtaaaagataatttgcaaaacaagaatggttgtgttagaaaaaaatataatgggttatattttttaaattaaaagctttataaataattgttaattctaatagtaacggaattctggtctggccattttcattttaggaggttagacagtaaagcttctttcttcaattgtgatgttctttcattgatgaaggcagtgccaatgaccctttgccaataggttttgtgcatttcaaagctatctttctccatctgccttttttctcttgtggccaagggagtgtgtaattttgaggtggctcatcagagccttagatgtggaccatgcctgtgaattagtgggaagtgtagcagtccatacaggatcaaacacatagtcttagtgccatcagcctcatgtgccaactggtctttccagctggccttaattcgcctgcacagatcggcacagattggctggaacattcggtatagcccctaacacgtgaagatatttaatacatggtgttgcttccttatgaggaagtgctgaaatgatcagaccctcagaatcatagtgaacctgaaatgcaaaaatccagttttgcagaagaagagaatctgggcatgattccactgcagatgtattctccgctttgcaaaaggtttcacaatgggttcctttaaatatcaaactttctggctcacttaaaatatgaattttatttcaaattagaaaatagaatttacacttcacttttgaggaaatgcatgtggtctgtaaactaggtcacagctgtgttaccccggagggtaagttgtatagtggcatgcagggagggagggaccccaattattgaaggaaatgtccatacctatgatttccctctttgtactgtatttgtagaaggagcaacacacagtgagcatcgagctctcatgtctgaactcaagatcctcattcatattggtcaccatctcaatgtggtcaaccttctaggtgcctgtaccaagccaggaggtgagtaactgtgggtggttttggtcacccaattttaacatgcctctctgatagtgtttgagggaaagcagtcaactcctctggccttgattttcttagcttagaatactttgcggattcctaggaataaatatatttcatggaggtttaattggcactagaattaaattattgtaaaactttctctgaattaagaaatgtcatgctactatgatacagtttgttacttgtgtaacagatgtccagagaagagtaaacttccctaaaacttgaaagcttaagggtagttacccccaaaatggaatcatatcaggagattgcactgaaaagcaagtagatgggtgggttttcttctgaaattttggttaatcttgtgaaaatgtgttctggaaaaaagaaaagctacaatataaggggattgggaccagctgatttctacactcctgtcccaatgaaaggttgtagccttcttctaaggtgtttttgggttcatcactatattaaacgcttagtgaggaatatgagtgaaaacccattttccttcctggacatgctgcctgcagggccactcatggtgattgtggaattctgcaaatttggaaacctgtccacttacctgaggagcaagagaaatgaatttgtcccctacaaggtatgtcatctcctaatcctgctctggccatgttataaaatgaagggaaactcaaaatggtacaggttagttttttagttgaaattttgtgaagaacttgtgaggaatcttctcatattacctcttggctgttgtaacttcctcttttaccttctgggggccatatgtttctgttttatgtatgtgattttaatctactgacccattacagagtgtggacatgggggagaaggcaggtatgagcgaggaaaggggagggcagagggtaggacatctctgggttattctgtctctcccctagccatatttggccccgtggagtgtaaatccctctgtgaagagcatcctaatgctgaaagtgtgtctgaatgcaactcaaaatgtggcatttgtcactttaagctaaagaaggagctaggctttgtggaagaaaccctattatgcacaaaacttgccccaagtttcagctcagagattgcataatcctgaaattgatgtcctccttgtctgctttttagtagtttcaattatctccatggtttactacattttaaaggttgtaaacttttaaagactcattttgtattcaaggagtttgtttgttcctttgcttttttatagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaaggtactggctagtgcttcctgcatgctatggcatgctcttgtcagagcagacagggtgatagggtgttacaaggaatttgatcatgggaaaagtccaatactacctcataatttgaaagagacctgaatttctataatagactgcctccattctgtctccccaaaagtgaagtgtggaagccctagactgggaagtgaagcagggctagcctgagaaatctgggtagtccaagtgggctaagcagtcggctacaaccacagcagtgttcttaaaatactggttcagcatttattagtgagagaggccacaagttttctggtagttgactagcctctccattgccttggagagccccagagtggtttgccccacgttgcatgctttacctgtgcaaaagtcttttcattatacctaaccttctcaaaggcagtttaggagccatctgttgtttctaccctaccccaagcggcttatcaagtcttccttccaaccatacttcctcaggcgagtcttgataaatatcctggcctttattaagttatgtttccagtgatattttatttatttgtttttatgtttatttttatttttttgaggtggagtctcatgctgttgcccaggctggagtgcaatggtgcgatctcggctcactgaaaccttcgccttttgggttcaagtgattcttgtgcctcagccttccgagtagctgggattacaggtgccttccaccatgcccagctaattttttttttttttgtatttttagtaaagatggggtttcaccatgttggccaggctggtctcgaactcctgatctcaggtgatccgcctgcctcagcctcccaaagtgctgggattataggcgtaagcctccgtgcctggcctgagtgatattttagtgctctttttgggtggagctgtggtcccagcctaacttccaggacttcagccggctccaggacacactgtatttctgcctccttcagaaggagcagagatagcgttgtggatgtagagatgggtgacaggctggctccccttgaggcataagtctagaagaatagtggaagaaacccactctgtttcccttgacatgaggctacagagagaatttgcatttaactccttttccttagaagctgagaaggtagtgtgaggctgggacttggtctagaagcacatggggaggtggtctaggcttcatttagctgggcccacactgagtggtgctgcctctaccctgctctttgtctttcaaaaaacagtggccagtgagccagaaacctaagagattgagttgttgagaaaaaggctcacagccttttaaatacttacgaatttattactacaactaagtttttgtttactctggtatttgtctccaggaaagaagccataagtcttatctgaccaaagagatgattttgaaacacccatttaatatcttagtgtttatttgtaccagttgcactgaagtaaataccaccaatttacgtaaatttatctttccatgtttctgttatctctcaggaaaaaacaccctcccaggccagatttaatgtatttacagcactttttaagtttgaaaatgaattaaatatatttctagtatttttagttatctattgcagattatagtttgacttttggcctttgtcccaggacaaaacctggagagaagagattcaatgaccctgaatattgttgttttatttttagagttcttgatatgaaactattgtttatccctctgggtacatgacaaaaaacagtgtaagtggcaaatttggaaatgtcctctttatttcccagattatctaggtcagtgttaccttattctacctcctggatttactggttcaatttggctaaaatggaaaaaccagtattgttcctaagggggtatgatgaaggctaatgatactgggattcaggagatttacagaagatagaagcattgactctctgcttctatttcctaaaaacttaactcccaagtcttaaaaagattattactctagcaaacttagaaacatcacactaactcatggaaatactgatctccatcctcctgcctctttggacagctcctgaagatctgtataaggacttcctgaccttggagcatctcatctgttacagcttccaagtggctaagggcatggagttcttggcatcgcgaaaggtaagaaaggttgaggggaaatcagctatcttttcagatcacaggtttggaaataagatgtccagtgtcagccattggtgcttgtttgggattgtaattcattcaccacttctacgtcttttagaagagctctactggggaggctctgtttctgctgagtaagagtggttaaggagttcatgaaattaagctgtataataaaggcttgtcaagcatctactaagtgtgaggcagtcttctgagcactgaggatactgtggtgaacaatcaggcaaagctcttcaccttcatggagtttacagttctagtgggtagagcaaacaataagcaatataaacaagtaaaacgtgttgtaggttagatgagagtaaatgctatggggaaataaagcaagaaagggttatagaatacacaggagcaatgcacttgtgtatgtttatgcttctctgtgtgtgtacatctactttaaacaaggtagacgaggaaggctttactaagaacttgacatttgagcaatgacctggaaaggggaggggctgagccttacagatatcttggcatgagaatcatttttaatttattttacattcatcaacatccatcaaaaagtatttgttaggagtataattagaaacgaggaaggacaggcttcagatgagagcgattaaaagagctaaaattagaaaagtaggccaaacaaaggctgagatggggacgtgacaagttacaactattccaaaggttgtaaacaccaagcggggagcaaggctggtggcagtgattcccctggaaaggataaaaggtgtaattttatattaggtaacaatacttcaaattaaggatcaggaagaactatcagttgacagaatgtattcatgcagcttaatgaagaaagaaagacttaagtcatatttttttttgtttttcctaaattagaatgaaatcttcaacccatgttttccccttctcatagcattaaaggcctcaggctctttgatgtttctgctaggtagctcttatgttctctctcccaaggggaaggaggagaactgggaccttatagggttttcccaaagagaaaggccctttacacttcttggagattatgacttattattaccatttttttatggccggaattcgccacttagtcagggttccttttggggactaggaagagaatggaaatgaatgtgggaatgctttaactttccttacatctaccagactatttcttgaatccacttggttgtcgggttaaaaaaggaaactttttgtttggggggaaaagtcaaaaacactgtctgttttttggaattgccagtgttgctcaattgtgctagataatgtgcttctgaatatgccttgttcagaggagagtgccatacagatttgaggtgtgggaaggtcagcaatgcctggcttacatgatcacttctccaatgatttaagaattctccttttggctgggtgtgttggctcatgcctgtaattccagcactttgggaggccaaggtgtgtggatcacctgaggtcaggagtttgagaccagcctggccaccatggtgaaaccccgtctctactaaaaatataataattagctgggcgtggtggcacacctgtggtcccaactacttgggaggcagaggcaggagaatcacttgaacctgggaggtgaaggttgcagtgaactgagattgcaccactgcactccagcctgggcgagagtgagattccttctcaaaaaaaaaaaaaaaaaaaaaaagttttcttctaagccattgattcatttcttgtgctccccaagactcattttcttacaaaatatcatgtggagctaaagctgccgagtagtaggaagttagctgaagtttggaggatacagagaaaggagaaactgagaagctaaaaggaagagaaagaagtcaagatgaatctcattgtattattaatgcactagaaaatcaacctgacttgtgataggctgaaattgccttaatagacctttataataacccagcactttgaaatcaggggaagccacattgggaattgtttatcagagccagtctggcttcagcttcatacggaagggggaaaccaacaaagagcactaaaccaatgagagccccttgtttctgatttccgtgcattcattcaaaaaacaaatcccgttctcggacctccttagaataacacgttttaaaccaaatatggggccaggtaaaaggaatgtgtggatgtgaccagaaacacactcttttgtgtcctagaggagcctatttatgattccatcatcatattataacttaattatttaactccaaaggctggggctgtttatggaataagcagatgtgtgtctcagcaaagctcacagacttttttcctgaagtgttgataaaagatactaacccagtccttgttaatcagttggctttctgatgtgggatttttttttgatgcatgaggtcacaacagatgtgaaagagatcagctgtgccgagacctaatgcacacatgattctctttgcagtgtatccacagggacctggcggcacgaaatatcctcttatcggagaagaacgtggttaaaatctgtgactttggcttggcccgggatatttataaagatccagattatgtcagaaaaggagatgtaagtttcaaatatgaacccagtgcttggttaagtaacagaattaaaactcctcgtagagagcttcaggacctgtgttcaggaacagaggaagtttttttcttcagatatttgctaatttgggttctgaatccttgtcttctacccctgtaggctcgcctccctttgaaatggatggccccagaaacaatttttgacagagtgtacacaatccagagtgacgtctggtcttttggtgttttgctgtgggaaatattttccttaggtaagtcatttctttttgtccttccatccagactccaaagaggaagacaaaagttgtcttttcctctcctgtacttcatgtctatcaggcaaaacttctcggaagctttgaaaaaaaaaaatagatacataggtgatgaggatgtgcaagattcaggctcagggttttctataagagaaaatcaaatcaaagaatgtctcctccctgttttattctaggtgcttctccatatcctggggtaaagattgatgaagaattttgtaggcgattgaaagaaggaactagaatgagggcccctgattatactacaccagaaatgtaagactttaagaagtattcctgtgttctctttctttgctcgcaaattctccttgcctggaagactttccattatatagaccttcttcattgcccagttagtgtcctgcttttactttggggcctttcttgataatttcaagcatggagtcatcacttcttgaaaagatagtactttattattcaaagcaaccagttagtttttattagatgttgctttaaatgttttctatacacattgagcctctggagtatgggactctgtgtcttacacagttttgtatccttatttagcatctcacctcgtcggctctttacaaatgtgtactcatttaagtgcttattttcagcattcaggaagaaagaggcatttaatgaaatcagtgttttgcttctctaggtaccagaccatgctggactgctggcacggggagcccagtcagagacccacgttttcagagttggtggaacatttgggaaatctcttgcaagctaatgctcagcaggtttgtcacctccatccaagaagcacctacaaagagtacttagatgtcaaggactttcctactgcctgaactgtctcatggctaccatgccatcctctcagccattgaataatctactgtattcttctacatctgagtaataatgcttttctaaaagctgtaattacccttttagacagataggattctaatttataacccgggagcagaccactctgatttctacctacttatctttttgttatattttcaaatcctcttctaaagttaaaacaaagaaaaaatctggttgatccacagaagatcaacaatggaagaaatttcaagaaatttttaataaattctgcaggcaaaaatacatctaagctatgcaaaagagatggtttctgtcttggtatcatcccaggttcttataacttccactggaagattttagagttgtagtgtttactattagaatgttatttaatctctagtcaatgcctcttactacaatggaagtgaatttcctctttcttttcttttgaacagctgggggacgataggtcagctctatttttatcaataaaccttccaaacatttacagatatcaaatagccctttatttctttttcttgatgcaataatattaagttgtgcaaccttttctcaaaagacccattttcctacccatttgttgcttttctttagactgtcatcagtttttccattgccttgaaatgtggtggctaaaactggatgccatgccctttgaagggcttggctcgtgtggttagggctttgtgaatgagtgattttttgttctatgtagctccttgtgttctgttgttacctctctgaccacagcctgctttctcttcattgtaactgcacttccctgtgggctgcttacccatcttgtttttagttctctcctttaatataccttccatttcaacagctttttgtttctgacacatgatttgtattgttgtcttaaagttctatgttcagatatgaaagccacacaccctatgtagccaagaagtccctgtgccctttgtttttaatgaaaaggcacttgaagaactgaagccataacaacagtcttctgtgtttattgtttcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcaggtactgtatatggcctaacatcccccgggggagggtgacttcaaggccatctcgggagggggattggaagtggaaggaagaccttgtctaaggctgttgcatcccacttccacataaccttagccctgaggttaacataatggggaatgctcctggaagagggcctgggtaggtgtgcttcctcccatctgtagcccacgctgctgccacagcattgcctttaagaattccaagccctgcagctgcaatagctggaatgccacagtttgctaatttccagaataaagagacgagttttacaaagacatctgcatttaaattatccccgtgtatgcttttattaatgtgaattaaatggcttaggagagattcagaaaggaagagttctgtgcttgcatgagaacatgcttatggctctctggcaaggatacagaaagccatgggtctgtgtccggaattagactggacactgcatctcagaagcccctcccacgtctgattttcagcattttatttgcataatgggatgtctgggcttatttaaaacacatgcactgcagtcctttcctgatttgcagaggggttctaaaggcagctttcttttttctctctcccagcacctgtgcataaggaaagagttggtgtggttttctacaatatgatattaaaattgccctttactaaggctgggactacttcattttgctttgtttctttcctaacccgtttgggtgttttcctgctttaatggaacccctgacagcatgggtccagcctgccagcccgagtgtgcctgggctgcagggaggggcagggagctctctcatgtccagaacttggccaggttgccacatggcaggggatgctaaggagaaactcgtggacagtttgccctctagagtcgtgtggggcagcagaaacactgatgggaaggaagaaagcttagaagccagcaagacagctgaccgttccattgaagtcaaaagcattaggcatgtttttaaagaactttgccgtatattatcagatgttgcccacatcatgacactcagagtcaggcaaggtagaaacaatgatctttttttttgatgtattattgaacatgaggctcagttctattacctgagggcagtacaaacttgtagttaaagatcaggtattagagtcagatagaaatgagtaggacccccaagtctgtcttgtagcagctgtgcaacttggggcaaatcatctaccctctgcctcagtttctttatctgtgaaatgagacaaggtcagtggtgctgtttgaaaatggctgttttgagagttataagatataatctatttctaagcacctggcccttgaaagcactcagtaaaagatacctattaagtgagctgcttaaaatcacatccttgagatgaatccagttcctctgacccctaagtccatgttgtttcctcccatgccaaggagggccctcagagagaaacagtaatgagatgagactacaattccactcctgtgtttacacatttccagttcaagttgagctggccttttagtgtgacagttgttcccacacaccattattgcctccccctttatcagaaagccatttgatcatgaactacattccatgtgttttctgtgaccaagtagagtgatgatccgagtcggcagcctcctggctcaccgggtgctttgcatatggtgctgagcaggagaagaaatcatgtttgtgtaatggaagcaccaaatacgatgttggatatatagaagggctgctaacgtttatccccagaagcgtggacaaatgtgacaccacactcccagcacaggcctggctcctattttctgtctgtgatttttgaattggtttttccagcccagtttctcttttatccagccataatttgaaaaataaaatggaaattggaatcttttgtctgcatctcctctccacctcctccaccttttttcctttctataaaataaaactcacggtcacattttaatcatctggttttgaagaaaagcagatagaggcatttgcacacggcatgcttcattctgttgctctcctggggttctgtttctctggggagaatgagttgaggctggggtacttctcagggagcttgttctatcctcttacgcatttctggccaagtacaaaagctgagcagtctttctccttctaattttcaattctattgcattataaatagagttggacagagatatcactgtgggagctagcttcatgatttgttgcccctttaaaccatttgaaaaatatttacttagcatttatttagagaaaaggctgagaagtgtgtgggggagggaccactcatgtctagacttagctttgcctctaatttcccctgtggaccagctctggcctcaagtttgcatgcttcctgcaagaaaacacatacttgctgggctcatctttctttgagggcagtttggggaccatcggcaattgctctgtcattttccctgggagtttcacctcacacatcaagcagcttatcaaaaatttctttgcagttctctcttagagaaaggttttggtacataccattttcttcattttgtaattgttagggatgattaaatggcccttgtagattgatgcttggggcagcctgctagctaggtattcctgagtttggctctaccattagactgtttgcagtgggactgtcctttctgcactttttgtctgtttcataccccgtacttacacccctgaccctgctactgcatgatcagtgcatgcatgacaagagaacagtgctgtgcacatactgggtgcttaataatggcttgaacaattgtgtctgctgttttcttctttcttttccctcctgatactcttccaagggagtctgtatggagtagagtaaaacaaaacaaaaacttcacatgggctttagtgtctgaaggcctaagtttgagtcccagttctaccttttattagccattttctccctaatccttgactccctcatctccaaaggggaaatagttaaaagacctgtttctccgtcttaggagaaacagatgcaccattgtctgtgaaaatgctttgtcaatcatgagaggatcatgccatttaaaaaattactggattaagaatttaaggagctgtcctttctaaggcagctgaattattgtccaaactcgccaaccctagttgattctatcccctagatatctctagaatgagcccatgtctccaaacctcatgggcattccctttttctagccaagctgcctttctttctcctgaagaagtgcagtatttgtctcttgggtcttatgcctctagtcttattcttttcaatccagagtcaattctctaaagggcatatctgatcttgtcaatcccatgcctaaaatccttcagtggctcttcattgccctcaaaataataatccaaacattccagttatgtgattttggataagttcctcaaattttctatgccttggtttcctcatctgaagagttgggatagtaatactcacccctagagaggtaccgtggtgaacacatcatgagatgctgcttagacagcttctggcacagtgtcaggcttgcggcagattatcagtgagggcttcctgaacaagtgaatgcaggaatgattgactacggtaccagtagtgtttgacaactgttacttttaggggttggacttagaaagtaggctttgcttgcaccctgtgtatcatatcctcttaacttgtggagtttcctgagtgaggatgtcaccggaaaatctcattctctcctctctctatagggaggaaccagcctcttggggtaggggagagagaattaatttccattcttctcctttggcccaaggtctatgcagcatgttccagaagtctgcttgtagtgggaagtaggctggtataggaatgaagaatgtattttctgtctcggtgggcccttccagtgaataggacttcccttccctccacttgggctgtaagtgattttgatagcatcaactagactcacccaaagccacacggccgggaaggagcattctcaagaaggagaggatctgttgttcaacaagtcttattctttggactcctgaaggaagctttggaagtcaaaggagaaaaatgagctttgtttgaagagggcattattcttcctaagagcaataagcccaacattctctatgtcattcatcttcccaacatccctgtgagctggggagggagtgctactgccaacacatcttatagatgggacaagagggtcacagaaatattcatgactttctcaagtttctgcagtcagtggtagactctgaaataggcaaaatatcttgttattctcaaaccactgctctttcctgagacagcaactctgggggcgaaaacgaggggacagtgagactcagcccaccttctctttgcacaccaagcctctgttacatggaggaggaagaggttgtcttcaaatcactgctgggttcagtatcctttaaggagaccttcagatgtttcctctgcctatctttcattgaatggttgctctgtgagcattatccagaaaaactttcccaggagatggccagacagatgtgaaacactcagtaatatatccagagctcgatggaggaatcccatgcaatcaggaagccaagtagaaggcagttgatcactccatctgctgttgttgtctttagtccagaactggacctcagaagtaggattcaaaagaacaggctcatcgagactcctcagttatattatacttttaaatgtactttctcaggaaattaagccttccatgtgtgctagcagagaaagatttttattttgttttgtttttctaaaggatgttttgaaggttgctattaagtttgtggttgaaagataatgaacttaggtagccgatctgcagtcaaatataccaccactaaaatataaatatttgttcttttgcagtcagtatctgcagaacagtaagcgaaagagccggcctgtgagtgtaaaaacatttgaagatatcccgttagaagaaccagaagtaaaagtaatcccagatgtaagtacgtcttttaaaaatagtcttagaaataatacaaaggatgaaacactagctagataaatattagcctaagcattaaagttttggagcctcattagaaggctgccctcgagtgtgtgtatcatggggtcattatggagatggaactttgtttttttcataagtaaagcccttggtccaaggttcaagacagtgtagctttctgaccaatttcactaaagtgcaagtagtgtcatagtgaagacagcgatggtaacaggcattctcagctgctgatttgtaaattttctcttctccctggcctgtgtctactcataggaagcagttgcttccttttgtagcttggacaatttgtggctatgatacctttatgttcttccacaggaccttatttgatagacatgatagatgggttgagaaatcagcttaattaaatagttggtcattttatatgctcaattaactgtgccatctcattgtctcttaaaaaggacaaccagacggacagtggtatggttcttgcctcagaagagctgaaaactttggaagacagaaccaaattatctccatcttttgggtaagactcagccacattaaaaagacaaatttcaataggaatttttggaaggaacttaggactttcagtgtaagtgcagaattttccctatggggtctttgttggttggagaaattagcatcaatttaacaaataaagaatggaaactaaccacacaataaaattaagtgataaatctaaaaataatctgaaataaattagagaatttggtcaatttttatgagaattcatgaatactagggaatttctgtgtatatttactgtggtcagtaatggctaaatgaaaaaggtgattggatgtgatccgtaaagctgtcaatatgattacaatctttgtggactctgaagaatttttaagtctgtatacaaatgggtgcatctgtgcttaagaagtatgatatataaataagccaatatctatttgtttgagacatttaaatattattgtctgaattcgaagtatttcattgtgagaaaagtattaaaattagttttaaatataatctcccttctatggctcagtaggaatttgtaggtgtcttgaatacgtgtacgttctcttaacataacaaatcaatgaaaatctatatttataagaataatagaataagtgtagttatgtatttgctggagtttatttgctagagtattcttacctaaaggtaagaatagaggaggttttgatctgcttataatcttttatataaaatgggaatactcatgggtttttgaataatgctcataccaaaaagaaaacaaacaaaaaaaaccccaacatattaaaaggtgccattgtgctattttattgttttctttaaggcccaaggtaagaaattgtgaaagtcaatgatatgtttcattcattgattcaaaaaatgtttattcggcaagtatcatgtgcagagcaccatgccattgcttgagacacctacattagttttgttggggttgaattgaaagaaaaaattgtatttctcattatttgaagtaacttttaaactatgtataaacacgagttactaaaattcccttttgcagttttaacatgaagaagttggggaaaacacctattaccgggaaaaaacaccttagaatggcttgtgaaagtgtaaatcctgaagttttagatcaacacagcctgcatttctaggctttgacatgattaccgtctgtcaggattccatgccattgaaaacattttctagttgctgctgagtgacaggggttctcagtccttccaaggaatgtggttttgatgagtaaaaagcagcgtttgatatgtctggcttgactgcacacatgcttcaagttattaaagtttaaagttgctcaagagctttattacaaccatacacatgccccgtaattcccaaattgccacaataggaaaagcacaagtgaaatttaagaacatcccaatttccttgaatatcatgcaagtggccctttggcgcctgtcactgtatacaaatttgtcaatctgcgaggccataaacatgttccatcagttggggcctttgcataactcgagagaactgcctttcatctcatttgaggcttgaaagacttggacctgagtaagaggacttatctgcaactactaattcatgcgagtacctgaaaatagaccttgtccctgtaaacctgctatgctgattaacaactgggagagatacggggctgcggtctccagggagatggcagccatatggagttgggaatggggtgagggtaaaaagcaaaagaattgtcttctctctgccaactcctttgtttgccatttcttctgcagtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcagacataatttccatgtggttgttttacatttttactggttttcttactcttcttataagggatattttcataaactgattatatattttacaaaccaataaatgtatttgtagtacaaagtatgagggtataatatcaccacaactattttgaggataagtatgtctggtttaaagtttaactgcttcttccctcttcttcttcattacaaagaattcacacacacacacacacacacacacacacacgccacgcatacaccccccaacacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15725 - DNA, 264358 bp, Human
  misc_feature (1)...(264358): n = A,T,C or G
cttatatataaaacatataattttcaccagttttgctttgagctgggtgtacagggcttctcatgttgttatgcctctgtgggttctgtttcaataacttaaagtcagtgagaatgtggacagtggaaaaccacacaattcaaagtccagtgctcacatagtaatttaatatgcacacacgtatcaactatgaaaatggctcagaactaaatacggattgggttgacagtaactaaagtagggagtcctgcatggttagacctccattccccataaattcatggagtatctactatatggaaggtataggaatagaagataaaccgctaaaaattctgaaaattaggagattttcacaaaaacagaactaacaaactaataagctaaggcagcctattctaagtgcccagagaatacatgctccagtttttcagaagcacaagaattatgtgggactggagtagtcagataggatttctgtggaggaagcgtgagctgagtcccatttagaagaaaggtaggattcagccgggtgtgtaggttgttgggagggcatattccaaggaggcattccaaagcagaagagctcaaatgtgattgtatttggaatacttgggtattgatgactagacctgcctgcttgctggaaggtttgtatagagagatcaagatggagaaatgagatggagagtgatcagaaatgcaggagaggctgagttgttggaccatggagtttggactttatcttagagaagagtgacttgggcaagatattttaggaaaatggttttgcctgtagtgtgtagatggaatgaaatctctgcgtgtgtatgtgtgcatgtgcatacgtgcacatgcaccaggaagcctggaggcaaggacattagttataagattgttacagaggtttggattaagtgaagggattaggaatggaaaggaagtgtctggtggatggtaagatataaccaggacctcaataaagccaagcaattattaaaacaagcatggtagttgtgtccataaacataaagtcctagaatgcaagctgatttagcgatttgagatagtaagtatattttaatttaaacggagtctctttatttttgaatttgcatatacttttcttccctcttcttattcctctgtcaatacctcgcacttattcttcctttccgcaatccctctcttttaatttgatcacaaattaatctcttgtatgtatttacaggaggaaaccaatggcaaacgttgtgtatggttgcaaggatgagtttctcccccttgaaaatatccattcgcatagaaatgggaggcacagtgaccaactcttgcttcttagcaggtctaacatgaccttcaaaactccgtaggacatactggtctttggcggggcagcatctcccgtcagactcaggctggctgggtttctcacagctgcctggatgtgtgtgactcgcagctctaaggacagaattgccaaagcaatacaaaaacacggacgaaaagcaagccacaaaaccccatgccttacacattaggctgatgagtgaagtcgcggaaggtggctctgctcttgcccttttaaaattccagtgcagcaaacacacacacacacacccgctcggttcttcccattcccgccacactgcaccagcttccgtccccaagtcctgattcatgaaccgtgccacctttgtctcattttaaactgtgcagactattttaatcttgccacccccatcccagatttccccctcccttcatcctctggaagctctgatgtaaagcgcttgctaggtgggagagcgcttctcccaatccgctcgggtaggcgagtttccgagaagccccctccccgggaccccgccgcgagcgcgggggaagcgcctcggtccctttaaggtgccgcgctctccgaagtgcgggcagggagcctgggcgccggcgcgggtcctggagccgggtggggaagtcctgcgccctccccctccgtccgcagcccagcctcgggggccagccccctccgcccaccgcacacgggctggccatgcggcggctctgaacgatgtcctcctcctcctacgccaagaacgggaccgcggacgggccgcactcccccacctcgcaggtaccgccccctcctcccccttctcctcttcctcctcttccttcctcacacctcctccgccgccctagcgcgccccgccttcgtgccgggcgtgcggggccccagtcccgggagtcggcggccccgctccccccacccctcctccacgtccctttctcctcccgctcctcctctttctcctccttctcttcctcctcctcctcaccctccttcgggtctctgcgctcccgctccggagcccgcagcctcccccagcggatgccggggactcggaccccgcaccctgagagtctttgttaatggatgtggtgggtgcttgcgggctgctcttctcgagcatcttttcagcagtcgaggcttgcagtgggtgggtgggggtgggggctgtatttgggagtcgcggaggagacttgggtgcgggctctaggggaccccagggagcgggtccggaggcggactccagccgggggtggtcgccccgctctgcgctgcggtcctcaccggcttctctctggcccccgtgtgtcgagtccaggtggcccgaggcaccacaacccggaggagcaggttgaaaagatccgatggcagcaccacttcgaccagcttcatcctcagacaggtatgagaaggaggcgggagaccaggatggggaggaggccgagcgcgcggcgcgggggtcctggagccggccgtggcccacacgtgcgggaggcttcaagccccgcgcgtcccggcctcggccggtgctcgggctcagtccctctccctctagcctgggctcttgacgtcttcgcgtcccggcgtctccgcaccgccccgggaagttagtttgtgcatgtgtgtggacagttcggtggggacctggcttaagtcagggacgttgaatttaagagctggaaatatgtctggttgtatctttggtgcgtggagaaatgtctttaattcgtataactcgacctagagtaaccagacccctcggggccggggacctggtttgattcgagttgagatttagtggtttcttctgttttgtcctaatttgaatactcttatctgtctggatcttgggagagatcgtcaagctccggtcaaaagaaagacactgagcagaaagtttactctcactttaggaccgcttcttggattcgcttagttagggaaagacagctgtatctggttaaataggaattaacgaaggccagcactcagctccgggtctgggtgcgccttcacttcgtgtttgttttcttagtgcttgctttctcctgcgtggttctagtgcgaattgtctgtgctcgggatctccggatcgctggtaatgctcaatgcttaggtgcctttcaccttggcacaggaaattggtcctcagttttccaactgtccatgtgctgttaatgaaaccacccctggctgctgggtgctagagagatcatgcaatgagtcaccttgatctttctttggaacagaaattgtcggggtgtgtcctaggtttcgggtgacctaggaagacattggtcatcgcaccaagaggcttttatcccaggtcttcctgtgggctgctggagtgaccttgagaagttcttttccctctaggtcactcagtattgtgtaatgtgttttctaacctatgatggcagctctggtgtttctttagtgattatcatcaatttaaacatatcaacgaggaattgatatcaaaattgaactcagacctctcctaaaagggtctataaagcatatttagatgatatttattatgcagaatttcactttctgcagaagcggaaattttgactaccatttaattcagcgagcactaagcatgtacattatggaaataaatgcattttggattccgaattcattctaaaagtgcattctatcccctttgcagtatttagattatgtatttgataaggcaaacatattgtttatcttaaaaacatttttctgttatgcaactgtttgaggtcttgctggtgtttattttgtaggtgcctatttttagtggtgtttcattgttgcaaattcttggaaatactaattacacagcagttctttccataagctgtttgactaaaacttttgagttcatctacataactgcactaatgctttattcttccttccaagcacaaacaaaataatattctaatattcttactcttttctcaatttatgcccgtaactgattgagatgatgtatatataagttcttgtaaagcgtgctgctatgtgctggcttaagaaatgttaaaagtattgcatgctaaataattttgggaataatttaaagcaaagtagatttttttaaataaatatatttcatctatgaaatgggaattcattggtttgattaaatggtctaatttaaattcaggagttaattgtaattgtattatatacacaatcttatttttcggcacaaaaatagtacttaatttttttcttttttcagacggagtcttgctctgtcgcccaggctggggtgcagtgacgcagtctctgcttactgcaagctctgcctcctgggttcacgccattctcctgcctcagcctcccgagtagctgagactacagcacccgccatcacgcctggctaacttttttgtatttttagtggagacagggtttcaccgtgttagccaggatggtctttatctcctgacctcgtgatctgcccacctcatcctcccaaagtgctgggattacaggcgtgagccaccatgcccgggctacttaatttttatgagcactttacaactcactgagtatactacacatgatctcattcaaatgacatcatacagacttctgtattggctacaataaaaataactgagggatttacatttctttgatgagataaggaaaatgattacaaatgcagtttaacaataactttcggataaaattgaaatcaccccaatgccaaaaaatattttttatgaaagcataacagctgcttacgttaacagagccttgggctggtcacagtggctcacgcctgtaatcccagcactttgggaggctgaggtgggcggatcacttgaggtcaggagtttcaaaccagcctggtagcatggtgaaaccccgactgtactaaaaatacaaagaaatttgccaagcgtggtggtgtgtgcttgtaatcccagctactcgggaggctgaggcaggagaattttttgaacctaggcggtggaggttgcagtgagccagtattgctccacagcattccagccgggcgacagagcaggactccatcaaacaaacaaacaaacaaaaacagagtctcattatttgtagaatgaccagtgatttattgatatttgaattcttgatacattggagtgatgaaatttcttggtgctgtttcacagtctttgtgatgcctttgaagaagatagtggaataccaaaaaatatatatattgctagtttctttatcatattatttacaaaaatatggagaaaagctttcattaaaaaaaaaatcgatgtgttacattggatggggaagactgggctgttggtgaagcagagaaggcagttggcaactcacccaataagacaatatttgttctttgagcttgttaaaaagtttcagtgtttctgagactatatatgcacatatgtgtgcatgcacacacatgaacatttgaattggctggaaaacaagcagactgagaaagagagcctgcttccactctgaggactgctcatgaagcccctcaggaatctttgaccttgtttctggtctacaagatttctggcttccaccatttaggagggatggaggttttggaatgaatccagggagcaaataaatggcttctttgaggaaaggtgagaagatgaagtacttcgccgctgaaaggaaagaaagctaggagtgacccagaaatgatcttcaaagtacacacaaaggctttctttggaaatgtgatgaagtgttctcactcttcattggggatgaaactcaagaactggcccaaattagaaaggaatgatgttttacagcaagaccttcctaagagtgttgccatcattggagtggctttccaaatgaggccatagaattttctttcaggagagcccttcttacaggctatttatgaatggattatctagtcatattttaaagttttaggaaacacttaagtatttgctatgtgcctagcactatgttagatattgtaggggaggaatgaaaagatggatgagacacagcccctgtactcaaagatttttataatctagcaatggagacagagatgtctacaaacagtacggtgacatgtaacaaggaacgagagggcgggctcaatgaccatgtaccccgagtatctattatatatccataagtatatctacccatgggtgtcactacacatacagtttatacggctgagtactccaagttagtcctcttcccactggggtttgaagagaaaatctgatcagagtgggaatagtttgttgacttttccttgttaagtctgctcttatgaggccagcaaagtcatacctggcctggcccctgcctgcttccagcctcatcttgagccatgatctcttagctctggacacagagtttgaacacactgtcttccctcttgccactggtcctttgcatatgctgagccctctgtgtggcaggttgttgtccttccttctgcctagttaacttttaatcttccctgagatctgggggtttagtcttcacttcctcttctaaccttcctgataaagtcagttccccaacaaggggctcccagagggccttgtgccagttttcagtagcaccaccgcttttatttaacatgtacttagatttctctgttacattctgtctccccatccgtatgagttccacaaggacagggacatgtctgcatttgatctttgtgtcctcagcatctagcatagtatatgttcaataaacacacacttgaatgaatgaagcagtggatggatggagaactaacttgatatattttaggcatgaggttctgctccaacattaaatgctttgtttagtggggagaaattgcctcctaacctcccccaaaactctgtggcttgaaacaacaacaattttttatttctgtgtactaaccagacagttctgcattgtatgatgttatatgggcactgggatggctggaaggtccagagtagcctcacacatgtggttggcagttggtgctggctgctggctgagaactcaactagagcttttggcagcggctcagtttttctccacctgggcctctcaacatggttgcttgagctcccggataatatggtggctaggttccaagaagtgaaggctgaagccacagctctcctaagacccagttttgaaagctacactgtatcacttgtcttgcaaactcaagtcaaaacaggtccaagagcctgctcagttgcaacaaaagagaaaacagactatcttttgatggggtgcaacaaggtcacgttataaaagagcatatgggtaaaaatacacacacacacacacacacacacacacacacacacacacacaccaaaaaacagcaagtcaaattcagtgccaatagtataaacaggaatgtaaagattattcaatttatataacaaattaaagaaaaatatatgttgatttcagtaggtgccaaaaaagtatttgataaattttgtaagttaagaatagagcatatctagaggcacgtgattttaaaaaaagaagagaaggcagctccctaaatctaataaaaattatctactaaaatccacagcaaacatcacactgagcagagaaactagaaacaatatatgtatgcagcagtcagtaaatgagcaaataatgtacattggggccctcatccatatttttgcattccctggtttcagttacctgcggtcaactgaggtctgaatgtaggtgagtacagtacagtagctattttgagaatgagaaagagactacatttcatataacttttattatgacatattgttaacattgttctgttttattattagttgttattaatctcttactgtgcctaatttacaaattagacttcatcttaggtatatatgtataggaaaaaacattatatatatatatgtatatatatgtaaatgtatatatggtttgttactatctgtagttccaggcatccactggggtcttggaatgtatccctcacggttaagggtggactactatatattatactacagagtactattcagccattaaagaaaaaaataaagccaccctgcgtgtaatgatatggaaatgcatttaagacattcatttgaaatgcattcaagtgaaaaaagtaagttacagaataatgtataataatatttcattaaaaaaaaagagcatatggaatggaagatatggttgcagccattgttggaaccatctaccttggaacaaggaacctcgtattttttaaggtatgctaatcagatgatcgttacaataattcaatgaaccacactgtatttagagatctaaaacattcagatttttaggttgatactagaataaaacaagttggcaaacaaattcttggggttataatttgagcaccagttatagatatgtttctctgatgaaatgcaaattcatcaacagaaggtatatgctttgcgcatagctctaagaataatcatatgcctacaggcatgtatatatgcaaaatttatccataaacttagaatcacagaattttagaacaggaagagattgcagaaagaaaatacttcagtctcttttttcagatgaataaaacataggcccaaggacataaaggtcataccaatagataatggtagaacagacgcaagggatcctggctcagactctactgtttttttcaccacaatccactttatccctgaataaacaagccaaacacacaaactcacacaggtgtggatacatgcaaggacatatggagcttattcctctcagatcctggaaacgttctgaatctgcgtggttgctgtgaagaaccatagcatcagttgaagaatttagagactgtggtttcttcccaattctatcatggatggaatttttgtttgcttggttagcttcttgtaggattattccttccaccctccagtcttctaccagttcctcccattggctgagcctctctggaagcccactgacctgggattctgggaaacaagctgcaggcagtggccctctgagatggaaagtagagcagcggagtgggaggagtggatctgagggaaacagccaaggaggggcacaaccagttacgtttatgtttatttttgtttgaggaggagtctcactcttgcccaggctggagtgcagtggtacaatctcggctcactgcaagctctgcctcctgggttcttgggaggctggtcctgcctcagcctcccaagtagctgggactacaggtgcatgccaccgcatctggctaatttttgtatttttagtagagaccaggtttcaccatgttggctaagctggggcacaaccatttttatattttagctgcatggtagacagtattgaatcattttcatctgcaaagttggaagtttttacttgctctgtaagtagaccttccttgctaaatggtgtaatccagttacaatgaactttaaaaagttcgcgcttatttcctttgtgagttttttgtgcaatgaatcttctcttgctctgatagagcaagaaagaactctgtcgctcttggcaaactgtgcttcttcttgttttggggcttaaataaattgaactgagcttatgaagaaagaaatctaattactgggtagctaacccgttaaccagtcatttttacttatgtctgagtctctgttcctgatggatagaattgcctaaatttcacttttttttttttttgagatggagtcacactctgttgctcaggctggagtgcagtggcccaatctcagctcactgaaatctctccctcccaggttcaagcaattctcctgcgtcagcctcccgagtatctgggataacgggactgccaacatgcctggctaacttttctatttttagtagagattgggcttcaccatgttggccaggctggtcttgaatgcctgacttcaagtgatccacctgcctcagccacccaaagtgctaggattacaggtgtgagccatcatgcccaaccctaaatttcatttctgtagaataaatatttatcctttagttttagaatggtacaattttattgaaacttaggtaagttctgattcaagtttttatctttctttttttcttttttttttttgagatggagttttgctgttgttgcccaggctggagtgcagtggcgcgatcttggctcactgcaacctctgcctcccaggttcaagcaattctcctgcctcagcctcccaagtagctgggattacaggcatgtgtcaccacgcctggctaattttgtatttttagacaagaccatgttggtcaggctggtctcgaactcctgagctcaggtgatccgcccgcctcggcctcccaaagtgctgggattataggcatgagccactgcgcccatcttcaagttttaatttttctagaaaattataggaagctgtgtggaaatgtaagctgaaaatgactttggctttggccctctccccttaattgctccacctgctgccccagacagggtcaaccctggatattaaggaagcagagactgccctttcaaacaaggtttaaacaaaaggcaatgctatttaatggccttcctttggccactcaaatctgggtctgacccatcttttctgggtgtggtcttggcattgtccatactcatcttcctcaaagcttggcccatttttggtctcatttctgaagctctgactcagaataaagcataaatcctaaccagggtgaacagcttgcaactcactcacattcatgaagactctacagacatgtggagagtggggcatgcaggtcccattctgctcagtgaccctctgtgtttggcctctgctttctgtctttctttttttctttttgagacagggtcgtgttccctgcagcctcaacctcctgtgctcacgggatcctcccacctcagcctacaagtagctgggactacaggtgtgcactaccaagcctggctttttttttctttttttttacttttagtagaaatggggtctcaccatattgcccaggctggtctcaaactgctgggctcaagcagtcctttcacctcagcctcccaaagtgttgggattacaggcatgagccactgcgcttggctttgcatgctttttaagccatattttggaagagagagcttcctagaacagtgccatctctctattttctgtccctttgctggagctttcttccctgcagagtgtgtgagcagagaatgggtgacaggcctcaaaacatgtatcctctgagatgatccttcagtggggtgagcctggtgtaggctgagcttctggactgtttttcacttccactgaatccggtgtgttgcacaattatttcctttgtgggctatggcaagacaaagcttgcaaagcactctttgaccacccctgggaacacactctgctatacctctgcatcttagaatacatcaatgggtaagtctcaagaagagctgggctgttatccccaacgaaccccaatccaaacacactctggttgaagcagtcagtattgtcctgcttttgcacagttgcccttgtacttcatgaaccaggaaaacaatgaggtgaatccagtgctcttcattctataagagtgtcagttctgaacttgactacatggacacatcaggaatttcacatggatttaaccatgtgtactgtgaggagacaggagggcactcagggaggtaggactgtaagtagaagccgaaattcatgaaaaagctgaattatagattcaattttaagggtatactgtagctttactgctttcaagtaacaataatgacaagctgtgtgctagggcaccctgccttcagaaatagatgaggctgatatattatcatctagcttgaatataaacagtgctttggaattccttaaagatagttctcatttctagtagagtaaacatgcgcctttgtaaacttccctattttctttaacgtgtcttttcttattatacacataaatagagcagaggtaattacttgaatctgaagggatggcattcacgatctgaaagcattagttaggtaagggctgtaaaacttattcgacggctactgaatttttctgatcatctcactgtaatcatttggatgacaaatcgtgtctatttcatttctcattttctgttctatgttgatggatgtatctttctccaaggttgcagtttaattgctgttgtagtatttgttttgggagtaaatattttgtaaacataaacttgaaaagaatatgcatttctgggttgtaggatcactagaggtggttaacttttatagtgcttactgtgtccatatattatgatgagattttaaaattccttatggaaaatttttttagcagtttcattgataacatatggaaaatctagcagtaatggaaatgcatagtaacttgtgcagataaatatatcgtcttccttttttttcttcttaaatggcccaatgctattgctaacaatttaatgctgattattgtttagaatcgaacaggtgggtaaaatgatcattgttaccagtagaatgttccttagtcactgctttttaatttgccgtgtgtgtgtgtgtgtgtgtgtgtgtgtgtgtgtgtgtgtgtgttaagtggggaaggcattctttttttcaggcatgtcataatctaatattttcatggcctggagaagaaacctatccctgttagcagtcattctgcatcctcttccccacctcccagccctaggcatccactaatctattctctatctttttggatttgctcactctggacattttatataaatggaaccataaattaacatgtggtcttttgtgactggcttcagattttttctttttctctgtctctttctttttttagacagggtctcgctctgtcacccaggctggagtgcagtggcacaatcacaactcactgcaggctcgaactcctgggcccaagaagctgggcccaagctgcctcagtctcccaagtagctgggactgcaggcgtgcaccatcatgcctggctatttttcttattttttggtagagatggggtcttgctatgttgccaaggctcaaatcttttcattaacatattgttcacaccagcccgagaagtttcagttatagcccctggtctaaatgtgtagatgctggcgtgaggatagaaatggacttgcctttccttaagtcagtgtcagagatggcttttccagtcacagtattgaataggatggatcatattcttatttattttggagcttcagtctcagctcataaagctgaatgtgtttttttggcaaaattcttttttttttttttttttgagatggggtcccgttctgttgccgaggctggagtgcagttgcacaatctcagctcaccgcaacctccgcctcccaggttcaagcgattctcctgcctcagcctgccaagtagctgggattacaggtacgtgccaccatgcctggctaatttttgtatttttagtagagaaggggtttcaccatgttgatgaaaccaccaggctggtcttgaattcctaggtgatcaggccttggcctcccgaagtgctgggattataggcatgagccaccgtgcctagcctttttttttttattttttcagttagagtcttgctcttgttgcccaggctgaagtgcaacagtgcaatcttggctcaccgcaacctccatttccccagttcaagcaattctcctgcctcagcctcccgagtagctgggattacaggcatgtgccagcatgcccggctaattttgtattttttagtagagatgtgggtttctccatgttggtcaggctggtctcgaactcccaatctcaggtgatccgcccacctcagcctcctaaagtgttgggattataggcgtgagccaccgcgcccggccacaaaactctttaacctgcatggaaatcaaacccctgaccctggacttcttgtcttcctggagtggctcccatctatagaggggggtggtttttataataggatgtgatcgacaggattaaagaaaagtatatgaacaatagaaatggttattgtcatcgttttcaataatttctagtaatagaaatatcttgggtacttacaattcaaaatgcttcctttagtttgtctagatgttcatagtaactctgctttggtaattataacatttccttcttgagaaatacaattaaggagaaagcggagtgcttgagttccaagctaaatacaatatttaagggaattattaggtatataaaactgtactctctatgtggcaggtgcttctcaattatatttgagtacttccctgggggacaaaagtcaattatcaacacagttgtgtgggagagaaataggtcagctgcaaacattctttgctaatttcagaaagcttgaggggtgatttagtttgaggatgtgttttattctttctgtttctttgttgaggactctgatagggaaggctctgtttttcatgtagtattgattgtcgtattcatttactttattacaatatacatatttctcttgctcatgcaaaatgaaaattaaactatatctaatatctttttaaaaactctgtcaaatcgatattgtaagagaaatgtgtaccatggatattactgttatgactgtttgtccattagtagagacaccaagggtgtaaaccaacccaatcaaaggcaaatgtcatatttacaagtattttatttatttatttatttcccctctttagtaagaagacaccaaagagtgctaattgttgaataaaaaacaaggaccttggtatgttttctaacaattgttttatttatttattttttattgtggtataataaatgtaatataaaatttgctattttattttaaagtataggtgcagtagcattcagtacattcactgctttttgtttgtttgtttttttttttttttaatggctgcagcaggttatcaaaaagacagtgcaggcaggcaaaacgtatgtccaacatacacgtatgttaaaaacatccgccattattgtggcctccctccacaactgtggtcttatttaaagcaacaacagcaacacaaagccagaccttggagtgccacacccaagtgtgggtttgggagctgagaagggaacaagctgaaaggaagccgcaagagctgtggagaccagccgggaccctcatggtggggatgggaaggtaggagtgggaggatgaggctgcccaggggtagttctgcccccagatacttgttttcacactgcctgactgcttttctttttcctccactgtctgaagttcagacagttccaagatgatttgggttaacaagcagcctattttaaaaagataaatgttcccagcagtctttggaggctctattcattcatacattatgggaatttgacttattgcttgcaagtatgctcattttaccatcttaacaaagcgcaccccaacaaagcagccgtgctcccatctccccggatctgtttgccctttcatgccagtgtgttccccttccctcccctctgcctgtacttgcatggcggccgcaggtacctagacttggacgtaacccctgctttcatccctccactcccttgatcatgccattccttcaccttaaagtgctttccccatttccacttgataatcttcccacttgtcaaaatccgtcttcaatattctctgtgaatctctttaatgtggcactaggtctccttctctgtcatggcccttatactgtgttttggctgttcacttattaaattctcctttgtataatctaaatgtccctatgtcccactagcctgtgggtatacattgacattatgcccgtaatcacgcctgtaatcccagcactttgggaagctgaggtgggaggattgtttgtgcccaggagtttgagaccagcctgggcaacatatcaagatcctgtctctacaaaacaaaacaaattaaaaaaaaaaaacattagccaggcatggtggcatgcacctgtggtcccagatactctggaggctgaggcaggcggattgcttgagcctaggaggttgaggctgcagtgagctatgattgtgccactgcactccagcctggttgacacagtgagaccctgcctcaaagaacaaaaaacaaaggaagcagaagcagcagcagaagttgtcatgtatccacattaatagtccatatattgctggctcacatttctcacctagagacataggaccttaacaccttccccctaacctgttgcccattttttctgagtccagtaagtgtcttaacgtgtgctcacagctcccctgctcattgatgtctactgccaccagcctttgaagaggcttctgctgcaggagctgtgccttcctcagtgagaacacagcttcttccttctaaggtgctgtttttcagcactgtactcttcagcctccctggacaacctgtgttccagactttcgcaactctgggtcactctgtgtcccctgggtcctcgagtgactcttcttgtgcccagtgtctcccagattcttttgtaaagccagcttctgcagcatgacctgcatctctctgtggggaacagacatcattcagcctctgccccgaactgcacctaaaacctgcttctagcagtgacttttgtactcattcatgtcgacccacacgaactgatgtagacacaaactcttcgtcctcttttaggctcagttacaccatactcacagtaatttatatatttaaaatatttttgttttatgcatttgtacttgtggtggaggtggagcagggagtaaaaggaggaggaggaaaggagaaggtgatgtcagggcctgaagcgttttcaaagttagtgcaggcctgagtaggatatcggaatgggatccttgggacagaggagggcactggtgcctgggcagaaagagagtgacttgtggaagatgctttcagaaagggaagtggatgaggatcaaacttggtctatttcaaactttattcttgaagtgtatctgataagaatcttttcattgcaagcaaacagaaagccagcacaaattggctaccgcaaaatatggaattattgactcatgcaagtgaaagctcagaggcaaactttatacttcagatattgtatgttccaaagttcgtggcttcatcagcagctctactctttctgtgcggttcatttaacactgtgtgttcttctgtgtgctggtctaggcctcagtttagcacccgttattgtggtagcagtggccacagtgattcaggatctcccatttatccacgatcctgtccagttaggcttccttacaatagttccagcagaataaaaaaggagaggtgccttctttcctccctccttccctccttccctccctcccttccttcctcccttccttccttccttccttgctttccttgcttgctttctttttgcagctaatggggctttaaatactgtccctggcagcacacacacacatgtgtacacgtgcttgtgtgcatgtgtacacacatatgcatacacacacatacatatacacatttcttgaatctcattgaactgaaatggctcataaaccaacactatggccagggggactgtcttaaggcagcagttggctacctagagatgagattgaggtcagccccacagtggctgagattggggagggcagtttcctaagggaattttggacccaggcaggatcatgggaacttcttccttctgctcctccttcctctggtaccacaactttcagtcacttcatgagttagatattgttttaagtgtggtaaaataaatataacagaaaatttaccatctttaccattttttagtgtacagttcagtgacatttaagtacattcacatggtcgtgcctaccaacatcaccaccatctatcctaaataggattttgtggactaatctgggagcctagctttctgttgtaacaatttattttaatgggaaaatatgtagcaagtttcaaataactgactaaacagtgaagttctgggacaccacataactattgatacaggggagactgcctgaatgaatacttcttaaggcctctgttttccttgttgcaaaacgggggtgagaatggggaggactaggtaacctctaagattccatcacgttctaatattataggactttatggctgtgtccacagatgtatgtggtcaactcattcattttggtagaatatactgtacagttagctctcaggtctgagggttctgcaggctgactgcgggactcaagcatcaaggactttggtatccatggagggtcctggatccaattccctactgattctgaggaatgactgtattttgcagctttggcagaaagcctttgtcacttaagtgctgagatgaactcatacaacatacggccattcagtatcaaatattggaaacttcagataaggacattcttttataatgtagcaaagagatgatgtggagtttacaggaggaaagataatttgggatagagctggaatttataactctttcaagtatatgcatgcagcatgaaaggatgtgcaaagaatagagtgggctgtcaaggatgaagtatttgtgaaatgtggtgagatggttctcagataagcatcctggaagttattaagaggaagtctgctgaggaatagtatagctcctgctattataattattatagccaccaggaagaacaagtagctaatggggctttaaatctataataaagaataacacaagttgccatattggaactttgctgaaggtgagtggaaccacaaggttgattctcatcatttgaaaacactgcattagggacttttaatactgactttcctgcttactccgtgtttgccacgggcctgatatttgcacatacagttcagcaaagttgcctttattgcaaagatgaggtaggaatttctgtttttaagtaacattaactatttaataagtagattctggtggatatatttttttaaatcatatgtcgaagcactaactaatgtgatagtatttggaggtgcggcctttgggaggtaattaggtttagatgagattttgagggtggggcccctatgagggaattagtgctcttgtaagaagaagaagggggaccagagctctctctgtctccacaatgtgagaatatagctagagggtggctgtctgcaagccaggaaaagggcccttactaagaaccaaatctgtcaggatcttttttttttctttttcttttttattgacagggtcttgctgtgttacccaggctgaacttgaactcctggctcaagtaatcctcccacctcagcctccaaagtagctaggattacaggcatgcacactgagcccagctctctgtcagtatcttgatcttggacttcctagcctctgggactgtgagaaataaactcacattgtttaagttacccattctgtggtattttgttacagcagctcaagttgactaattcacttggtaagctggtgcacttgactattttccttctcatccttctagtcagtagcacatgctccttattcattatgtaaacattatatttatatcctgctttattctggaaatgacttaagttagcttgtgtatgatatcacaagagtgttagactgttggcattgctataaaagaatacctgagactgggtaacttataaagaaaataggtttattttggctcacatattttggcttgcagtctgcaagctgtccaggaagcatggtgcccacatctgctcctggtgagggcctcagcaagcttccagtcatggtggaaggtgaagggggagcagacatatcacatggcgagattgggagcaagagggggaaggtgccacactcttttaaaaaaccagatctcgcatgaactcaaagcatgaaatcactcattaccctgagcagggcaccaagacattcatgagggatatgcctcatgacccaagcacctcctactaggtaagccctgcctctaacattggggatcacatttcaacatgagatttggaggggacaaaacatccaaaccagtaggtgaatacaatgaactgatggaaaaaatacagatgagacagagtacacaaaatatatgccactaatcttattcactgatttgagtctgaactttctagaaactacctagagaggaaagcaaggtcatttatgagatttttcaatgtccaagggtaaaagtaaacttgtttaagaaaactacacaaatttcccaccctgaaactagagagaaacttctcccatgttctcatagagttgacactgtataagacagtaaattggccaggcgcagtggctcatacctgtaatcccagcactttgggaggtcgaggcagggggatcacgaggtcaggagttcaagaccatcctgactaacatagtgaaaccctgtctctactaaaaatgcaaaaaattagccgggtgtggtggtgtgcgcctgtaatcccagctagtcaggaggctgaggcaggagaatcgcttgaacccaggaggcagaggttgtagtgaaccaagattatgccactgcactccagcctgggcgacagagcgagactccgcctcaaaaaaaaaaaagacagtaaattaaaccctgaataattaaaccttataattctagagttgtttcttatcatatacttcaatatatagattatacttctcatcatgctggagtacaattcaataaaagcaattatgtaggagctattgctgtatggttcagaaatgcctgtgattctcaaccttggctgtacattagaattcccatgtccaagccacatcccagcctaatgatatctggatttcttaggggtgggactcagacatcagcctttttcagaactctaggtgatggatgtacttttctggtctgatgtaattcagggggagattttacttttatttttttatttttttgagacaggatatcgctctgttacccaggctggagcacagtggcgccatcaccgcccattgcggccttaacctcctgggctcaagcgatccttccactttggtttccaaggtacctgggactataggcacacaccactgcgcccagctaattttacaatattttgtagagacagggtttcactatgttgcccaggctggtctcaaactcctagactcaagtgatcccgctgccttggctcttaaagtgctgggattacaggatgtgtgccaccatgcccagccaagcagggagattttagagcagctcttttcagccaggatttatcagtcaggatacattaggtgatgttgcaataataaatacttctctaaaacaataacaacaacaacaacaacacggccgggcgtggtggctcacctcgtaatcccccagcactttgggaggctgaggcaggcggatcacgaggtcaggagatcgagaccatcctggctaacacggtgaaacccatctctactaaaaatacaaaaaatcagctgggcgtggtggcgggtacctgtagtctcagctactcgggaggctgaggcaggagaatggcgtgaacctgggaggcggagcttacagtgagcttagatcgagccactgcactccagcctgggcgacagagtgagactgtgtctcaaaacaacaacaaaaataacaacaacaacacaacacaggtttattttgcactcactctgcatgcctcttggtgggttagctggggttaactcactgttctttctccagtagagcaggcaccatgtagaacattactgtttgctgcagaagagggtgtgagagacatggtggaccacacactggcttgtgaaactctgcctgggtctatgctaagctgctgtaatactgaaaccaaaagatcaatatatatttctttgtcacttaacagtctacaagaaggtgggcagttcagcgtgggtggttggctgtattccaagagatcagtggtccaaggacgtaggctgttgggtggctttgccattttcaacatttagattccatctttggatccagtgtgacccctacagtcattaccattttctaggtagctcaaaaggggaaaaggaggataagcagcttcctttttaaagggatgacccagaagttaaacagatttcttcagctcataatccattggcctgaactttgtcatgaggcgacatctagcttcaaaggaggctgagaaatgcagtctctagctgagttgccatgtgaaggctaaaaattgggacagctctatttctggaaggaaggagagaatggatgttggagccagttatgcagactatgcctcatgatgataatagtttcaaagtttggttttcacgtagaagcatttccttcaaatgaaattgtggatgttgtctttggtagtcgacatatttggagatgctttgatgaggtgaggggatctgtgtggaccgccctcccagtttcctcctcatactctctgcagcagttctagaggcatctccagggaccctgagggctctatgaaaatcatggatgcagatgaagtgatgatttacatatgcagcagaacatcctcccagaatattgttcctcgcagaaggactttggattgatattgaaaatggaactgcatccttctagtcagttctatcgcaaaaagccatcccaagcccagccacctccctccatcgctcctcctgctgccctagttctcagcttgcgccaccgccgtctctcttctgacctactgaaagaatctccctctgtccatatgccagcaggtccattctctacgcagctgccagagttatctttttaaaaaggaaatcagatcaggccatttttctgttttaaaaccctctaatggatttcagttgggtttaaaatataatctagattcattattgtggcctccaaggctctgcagtgatataactcctgtcagactctcttacttcatcttcgtgtttcagcttactaacccttctcctctcagtctcgggttttctttatgttctttttttgagagggagtgtccctctgtcgcccaggctagaatgcaatggcacaatcttggctcactgcaatctccgcctctcaggttcaggcgtttctcctgcctccagcctcccgagtagctgggactacaggtgtgcaccaccacgtgtgactcatttttgtatttttttgtttgtttgtttaaaaacagagtcttgctctgtcgcccaggctggagtgcagtggcgcgatcttggcttactgcaacctctgcctcccgggttcaagtgattctcctgcctcagcctcctgagtagctgggattacaggcacgtgccaccacacccagctaatttttgtatttttagtagagacgggatttcaccatgttggtcaggctggtctcgaactcttgacctcatgatccatgtgcctcggcctcccaaagtgttgtgattacgggcatgagccaccgtgcctggccaatttttatattttagtagagacaaggtttcgccattttggccaggccggtcttgaactcctaatctcaggtgatccacccacctcggcctcccaaagtgctgggattacaggcatgagccactgtgctcggctctttatgttcttttaataagccaagattagtcctgcctccaggccttagcacttctgctctccttctggaatgctccttcctgagctctctagatggctggctctttcattccccaacccaaacattacctttttagagagacctcccctggctgctcagtccatggcggccagcccccctccctgcttactctctgtcacattccattactatcagaatttaccttctgtagttttcttttcacttactcatttctgtcaattctcactggaatgtaagctccaaagaggcaaagaactggtacatccttgtcattgcactttccaggttgacagaataggcatcaggaacgccatataagtttagtaaatattaactgaaaattgaacagaatgacagtgacttttgagattcagtatctgggtaggtcctagtctttattatcagctgagtgaggtattacacaaggatagacaggatgtcttcctttaagaattaagatatcttttaatacgtgtgcctgaaaagaaggcttagagatgattcaagggctgagggtcttctcagaaagtaatttggagtttacctgaaactatgtaaagagatgtccatggacccatagtttcgagcccaaacacaaactacagtgacttcttgcatggacaaaaatgaaaagcggccaggcgcagtagctcatgcctataatcccagcactttgggaggccgaggcgggtggatcacaaggtcaggagttcaagaccagcctgaccaacatggtgaaaccccatctctacaaaaaaatacaaaaaaaaaaaaaaaaacccaaaaaattagccaggtgtggtgtcaggagcctgtaatctcagctactcgggaggctgaggcagagaattgcttgtacctgggaggcagaggttgcagtgagccgagattgcaccactgcactccagcctgggtgacagagctagactctgtctcaaaaaaaaaaaaaaaaaaaaaaaagaaaagaggtggtaatcacatgtcctccttattagctcctgccaaggcctactagctttcagcaagttccttcctaatctactttgcaaaaagaccttatgacaaaatgcataccccacacactgaattaggtgacaggatttcagggatattagctacagtttggtgaaatgcaggtgagcaaatattttactctcgttttgtttggatgcctcatccttgacctgcttcaggacagtttccaccctaatagagagcatccagggagactgtgggcagcactgactttggcctcagctcttaatcttctggtggctgatgctttggtctggggcccagtattcgatgcctgagttcctgtagatgagatcttttagtcccagacctcctcaggaggcaaagacttattgggctctggaatttgagctggaggcagggcaaggctaggcttagcaggagtctgtgtgtgtggctgaggggtgtatggctcagctgaccagacctgaggctctcaggccaagtcaaacgtgggaaagtcagcagagccagcaacagtgagtccacactgcccgtgtccttcaggttggctggtctccacctggaatgctctcccttctgttgctttttctggtgactcttaactccttttcttcatgattgcatatatgtcacagcctctgtacagcctcatctgacactcctgggcaggatttgtttcttcctcccttaatacgctcagagtaactctcacattgttttgcagtgatatgtttacaggtctctctcccattgacagtgaacctcccaaggacttggttgtgacttaattttcttcagaagcaacaccagcagagctgttgatggaatcagttgtggcatcaggtgaatggactgagtccatgttctatcactttctatttgtgtgaccttaggcaagtaataatgtgaaataaggatgataatgcctgccttgtaggatggtgtcagaattttgaaaaatgaaataatatatatagatattggatgcaaattattctatttaaaaacacatctcactgtagctcttcttttcaagcagggtggtggccataatatgtatcggtatttgccttccactttcagagactggtgggaagtctgacattttaaagcctctgcccgtttctctgtttgttgggggaacatcctagagtgatgatggtaatactggtgatggcagtgagggtggttgtggtgatcatggtgatattagtggttatgatggtgctgttgatggtcctgggtgtcagggcaggggtggtgatgatgaagatggggcaatagtggtgactgtaggatggtgatggtgcttggtaagggttgggtggaggtgaaggtgatggtgatgatagaggtggtaatggtgagggggtgatggtgatggtagaggtggtaatggtgagggggtgatggtgatggtagaggtggtaatggtgagggggtgatggtgatggtggagaggagggtggggacggtagtagtgattatgctgtggtgacagtggtgacggttgtggtggtgctgctggtggtgatggtggtggcagtagcggtaatggtggtgatggcggagaggagggtggggacagtagtagtgatagtagtgattatgccacgatggcttggtgatggttatggtggtggtgctgctggtggtgatgatggtgatgttggtgatggcggagaggagggtgggaatggtagtagtgattatgccatgatggtagtggtgagggtgctggtggcggcgatggtggtaaagcggtgatggtggtgatgttggtaatggtgatggtggtattggtataaatgggggggtgctgatggtagctgtggtggagatggcaacgatggtggtggtgatggtggtagtgttggtggttcttaccctgggttcctcacctctgttgctcagcctgcctgttgggattcatagcctcctggagtgatgactgcataacattgttttcttttgttttgccattcctcccctgcctgcctgccttattctgaactcagtccccttcacatgggcttacctaggactcttcagctgattctcagcctttgaccctggacaatagctttggatccagcacagcatcctatcctgcctgcccctatcccctgcctcttacagtcctgcctcttctggtcctacatcactgcttttcacctagaagctagggacatttcctcattagatgaggccgttgcattgttgtcaaataagagcgtttaatgctagaggattgcatttgttattgaagggaatgctccaagttctgagagccctgctcttggagaacacagctggcagtggagaatggactttcttttaagagtgaaagcagattgacaaatctgcccaccattatctcttttgttccatttttaaaatgtatttttaattatttttgtagattgttttcattatcctgcactgttttccaatcccttaacattacttaacctgtttatttaaatacttagcaatctctgcttgttccaattcataatcatcccattcttatgctaacttatgccagccttggggatggcactagaatctgggggtggtggctaaattctcatgtaaacatagcaaagcacgattgccagtttactacacaggcgaatggcattgagctaaagcattcacttcaaagaggaggatgcttctaggtatattgaatttggcatggggtgatgggtgagggttggagagggagatgtgtttggaccttggatgacaaggaagatggtctttccttctcgactggctcccttcaataaggaaatcattatgctggatttgagatgtttcagtttgctgatagctgacttccgtctgctctcctggaccttattctctctgccaactgcacaagtaaatctatatagatttcttcctgatgccatttgtgatatattgctccctgaaagcattttcctgatattttatgaaaatccttgaattggccctaaattctggtagtagaaagagcatgatattttcagcaaaagcgtaagttcaaggtctagcttaaccatatactagaccaagccactgaacttgaattttagtttccaaccctataaaacagaggtaattggccaggcatggtggctcacgcctgtaatcccagcactttgggaggccgaggcgggcggatcctgaggtcaggagatcgagaccatcctggctaacacggtgaaaccccatctctactaaaaatacaaaaaaaaaaaaaaatcagctgggcctggtggtgggcgcctgtagtcccagctacttgggagactgagacaggagaatggtgtgaaaccgggaggcggagcttgcagtgagccgagaccatgccactgcactccaacctggacgacagaacaagactctggctcaaaaaaaaaaagaaaagaaaaagaaatggaggtaatcaacttctgtgcctcatcataaggttttcataagccttgtttgagatattaccagtgaaaaaggtttataatgttaaaagattactataactgttactaaatttgacttacgatattatcttgaggcatgaatgctctttaactaggaattttgttgtttaggaaaagtaagtattacagatctttgtgaaaataattatactcttaaattgcttttcatacacacatttccttaaaatttaatattcattaagctcccctagccacgttggatctctcaagttgtcttggagccagctccgtgatggacattcccccagatctgtgcctccagactgtgctcccttggtctggaatgatggtccccattcttggctggtgtcctactgctcatctctcaagccctagctcaaaagtcacttctctggaatcttgaactaactgctccaggcaaaaggagtcattctgacatcttacagctccttgttcttatctctaaactgcccctctcaattattgtcatctaactgtaaattaaacctgattgcaagcttcaggaaggcaagaatttttgttgcatttcatcactgcaattcccaatgcctagaactgtgtctggcacatagtgggtgctcagtgtaaacccttatggaataaatgaatgaatggatgaatgaatgaaattaaatcacctctaccagttcctaaatggcaggagtggtttacattgatgtttcttacacattcatcttggtcaaggcctggctctggtatatttgcactatgtttgttgaatgaataaatttctggattaggaaatattagatgcctttagaaaatagaaggaaaaggctaaatattataaggtactaaagataccattgtacttccacactataattgcttacattgcataattctaattttgttttcgggttactataggcccaattgctatttttataaaaacctgcaataaacatctggagcagtttttaaaaaccaaaccaaccaaatcttaggtttcccttgactagtttttaatgtaaattcttaatttttttccctaaaaattggcataaccatcattaacatagaacatgccgagaggtttcatgtctttagcagcctaatgtgtagatattaaaagcttccccttaataagaattactgcaaattcatgtttagtatcaaaataatgatagccccaaattttgcaaatggctgtttgccagatcttctgtaactctctcacccctgctatgtttgaggaagtgtttctcatagtaaggttttaaaaattctacttacaaaattatatatcctcttcagcagatgggctgaccggcttacagtctccatggtaacaaggtttctgtatttttccccctttttaaaatagcctaaagtcacagaagagaacttagatattaatagcctaagaaatttcagtgtgaacaacagttattaagtatacagcctttgattacttgtttcttcatccagcatcatttgtgatatatagcaactgtgattaagcatgtatgaatataagttggctgagtgcagtggctcacgcctgtaatctcagcactctgggaagccgaggcaggcagatgcttgaggtcaggagtttgagaccagccaggccaacatggcgaaaccctgtttctacaaaaatacaaaaattagccgggtgtgatggtgtgtgcctgtagtcccagctactcaggaggctgaggcaggagactcgcttgaactcgggaggcagaggttgcagtgagccaagagtgtgccactgcactccagcctgggcaatagagtgagactctgcctcaaaataaaaaagcatatatgaatataattttaatattcatgcagattaggatgtgccaattggtttgctgaaatgattaactattggatacctgtttaaattagcctctctttcccaacttcctttttgctagccaaatcagattatgtactacacttcacttaggggtcaacagcatagtaatagtgcattgcattatttcattatcgatgtgaaagacaaaaccaagcctgtcttcttcttgtgtggtttccgtgaacacccatttttgtgttaagtgtagtgtttttgccaactataaaaaaagcatgtatgacttcatggggccacagcccatgttgacttgattgggttctagtatctttgatatgcataaagaattacaaccccaaaccagctaatacataaatgattctctaaggcaagtacactaataaagcatgaaaagatattttaaagagacgggtatatttggtttgctaaaattcttgcattttcctaagaagtgccctgttcttgatacagtgtggtttgtacctcccacagaaaaatcaattcttatttttggattgacttttaaatgtttatttttgtgaagtcatgacatattcttgcttgtttagctgtaaatattgatgaagttggccaggcgtggtggctcacgcctgtaatcccagcactttgggaggccaagacgggcggatcacgaggtcaggagatcgagaccatcctggctaacacggtgaaaccctgtctctaataaaaatacaaaaaaattagccaggcgtagtggcgggtgcctgtagtcgcagctactcaggaggctgaggcaggagaatggtgtgaacccgggaggcagagcttgcagtgagccgagatcgtgccactgccctccagcctgggcgactgagcgagactccatctccaaaaaaaaaaaaaaaaaaaaaagattgatgaagtcgttgttctatcaaaagatctagaataaaggagaatattttctgtccaatagcagaaaattaagaaaattaagcagacctggagtgcctggccctgcaatgggctctttttaatatgtgattggagctgaaatcctatgacaagatcacctgagagtttcatttatatatctgttaaaactttttcacctcatttttccactgttgtgtctctatatttatttactttgctgtcagctgatcaggctgagctataaaagacccagtgtggagggtatgtgtgaaggaagaatttgattctactgaaaaaaaaaaaaaaaaaaggcgtgttctttatgtgcttgtgatgagattcagtgggaggttggttgggggtgagtatctggtgatgatgctcttatcactgccacttctgctgcaagatcaatttcctaggaggctttgaggtcttgacccacataaaaatactcctcccctgccctccaaactattgggctttgttttatcccatgtttctgtgatagcatgtatgcaggtatttatttgggaattgattccatggagtgggattggagcgggtgaagaactaatatcagaatatattaacaagttggccagtgctgggagcaattagtgattggtgataccatgcctctctgtgaagccccatgaaatgtggatcagaaatgtccaccctggacagcggtagggggaagcatttattcaccggcatctgttccccattgactgagagtagcctcacaggggttagctccctcatactacctagttgcacatgcgtgagtgccaagcatccggcacctctttgtggccagaaagccaaaggtcaccgcctcagtgtgaagctggtcaaagcctatgtgggcctgattattgccagtggctagaggggtagggcctagaggacatgacatggttcccaaagggaccaactgtgcatctcaaagatatcaacatctctttcatcagttcacttttttatagcctctgtgaaaggagaattctcctttctatccttccagaaaacataggtgtggattcttcggtctcatataataaatctatactaatgatcttaccaccctgacccttctaatcacctcctcagatccagcatctccacctcattaacaggaaaccatcttcctatccaggcttcttggagccattccatctgggtgttaggactggtttcaggtgtccttgtcaggagtttgaacccagagtcatggaagagtacccccatatcaataaattattctttatccaacttagcattttgtagcccctggtctaaaaccactcccgatgatcttcctctggttcccactgatacatattcctttgatgaataagcagtttacttctgcagcaggaactatatttccctgcttgggctgtgccgggacctgactgtagttactggctcagaggcaaagagattaactggcagcagatcttaaaaaggacaaaaatttccttgttaggcagctacctcatgtgaagactttgcagggtctctaggcaaggggatattgctctcctctagcaagaggaagggagagttgctaatggtttggagaattcaaaggaacctgaggattaaagattctcagatgtctgcccagatgccctgattccaggtcttggaatcctctcttttcctatgagggctctgactttgacatgagagacgtactgagactgtgccttcattttcctttgcaggtctttcagctttatagttagttcctgagcctgattttcagccccatggctgcaggcaatgagtcaacctaaacactgtcaaggaggcctttcacaatcctctttgagttgatagttaatgcacctaaacatataattttaatattacctcttcaaggcttccaaagcagttaataaaagccatacaactccatgattcttataattaccattgaccctatgtcattcaagtaccacaactaccacttaattcattatttccctttccatatgtacctcatcccagttcaccacaggtaagagttttagtagatgtgatgctactgtatgcctgcgatgattgctatcctacttaccaccagcaatagggcgggtgatctagctccatgatccagaggggctgctttctaaggccacttgcctttatagctcaagtccctgcaaaaacagatcctgagataattgcttgcattcaggtagtttatttgggatgagatcccaattggagtaaaggacctaggaagagaaaagggaaggagaaaaagccagtacaagaatacattatcaggctgggcacattggctcatacctgtaatctcagcactttgggaagctgaggtgggaggattgcttgagtccaggagttcaagaccagcctgggcaacacagtgagaggcacccccccccacacacacacacatctctataaaaaacaaaaaagaatacattatcaaactgaccactgctgagaatactgggtacttgatctcaggcacttttgaggagccatataaaatatatctcagaactgtctgccttggggctgacatgcagaagcatgtgtccatttgcttctgtccccattggccaagagtggcccacaggcatttactcccctgcacttcttttttttaattaattaatttatttattattatactttaagttttagggtacatgtgcacaatgtcgaggttagttacatatgtatacatgtgccatgctggtgcgctgcacccactaactcgtcatctagcattaggtatatctcccagtgctatccctccccccttcccccaccccaaaacagtccccagagtgtgatgttccccttcctgtgtccatgtgttctcattgttcaattcccacctatgagtgagaatatgcggtgtttggttttttgttcttgcggtagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgcgaataatgccacaataaacatacgtgtgcatgtgtctttatagcagcatgatttatagtcctttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgaaatggtatctcattgtggttttgatttgcatttctctgatggccagtgatagtgagcattttttcatgtgttttttggctgcataaatgtcttcttttgagaagtgtctgttcatgtcctttgcccactttttgatggggttgtttgtttttcttctgggttgcaaatgcatgagtgtggagctgctcctaagccttagttggcatttgaaagctctggagcaggaggtgaaaggtatgtggaagggggagagggaggcagaggcaaggtgctgtctgattatacctgtttgaatctggttgagcctgcatgtacgtggccacgtcagcagaggctggagtaagatgtggggctgagaggttgcgaagtacttgaagggcttcctgtataggctttattccacttgattgatttaagatgcattcatttattgtgctcactaaatgtatccacttttcttctttgttttctattatttctgatataaatatatttaacttttgtaaccaagaatagtgttactttaaaaatattatacccccttaggccagatgtggtagcaaacatctgtagtcccagctacttgggagtctgagacaggaggatcgtttaagcccaggaattggaggttgcagtgattgcaccagtgcattccagcctgagcaacagagtgacaacccatcttaaaaaaattacccccttacataaagattttaggcttaatgtgaggacatataggacaacctgaggaaaggacaagtggagagtgtagaagagagagaatcaatgatgtaagtaaatttctgcttgctgttactttccaagtagaatgtaggaaagttaaacactatagccaagagcctgaatttgtcctgtgtgaagtccttcaagacctagtcaaagtagcacattgctaaaaccttttcttcccagcactctttctttccctcatacttcagtgggcgggggtgatccatgtgactttagcagatctaaccaagccctaagtgaagttccctggggaaaaagcatgtaacttctctctctctctttttttttttttcttttgagatggagtcttgctctgccacccaggttggagtgcagtggcacaatcttggctcactgcaacctctggctccgggttcaagtgattctcctgcctcagcctcccgagtagttgggattataggcgtgcatcaccacacccagctaatttttggtattgttagtagagacagggtttcaccatgttagctaggctggtatcgaactcctgacctcaaatgatctgcccacctcggtctcccaaagtgctaacttctcttaaagttggaactattctgggtttgggttgggggacagacatgcaagtaaatcacatttaccacacaagcaagagtatgcatggaaaggtgaataagaatcagtccttgccctaaagagccattccttctgctggtcttgaagtttcataggagcgctgctgtgtagcagctgattgtgaactcaagggtcaagcttctctggatttaatattgggggtctagtttctctctatgacaggtggagaggatttcttggattttatgacaatctagacagaatttcttagattttatggtctagtttctttgcccggatatattttgataccagtttttgggtaactgtcttaggtgataattatgaaaaagtctgttttctttcttacctgtatttattatttgaagaacatatgtatgtactactttaaagtacattatagggccgggcgtggtggctcatgcctgtaatcccagcactttgggaggccaaggtgggcggatcacttgaggtcaggagtttgagaccagcctggccaacatggtgaaaccctgtctctactaaaaaaatacaaaaattagctgggcatggtgtggcgtgcctgtaatcccagctacttgggaggctgaggcaggagaatcgcttgaacctgggaggcagaggttgcagtgagctgagatcgcaacactgcactccagcctgtgtgacagagcgagactccgtctcaaaaataagtaaataaagtacattataaacattctggtgcatatacaaaaatgaaatattaaagaataaaatatagatttgaatatggaaatagagacttgaatattttcttcctgcactccagcaaatgtttttgccttctccctgggctgccaaagtccacgtgggagacatccgattcagatgtccatggctcccttcatgcacttcaacaatgtgaattttaagagatgtttggacccatgtactcaccgttagacatagctagacctaaactaacctctgtgtgtagttatatattgaagactgtcttcctaacatttcagaacttctgttaatttccagtactctatcattcacaagactgttattacattgtctgctgagaattacaatgaatttagaacaggggtgtcagcctgtgttggcagataggttttgtttggctcatcattcagaaaaaaataattttgaatgactgccaagatttgaaagttgggggattttgtacacgagtctgaattttcaacttttctggaaaaattgtgaggaatggcaaaactggcttttcattcttctaggaagacattcggagctgatgggtggctgcctcttttaggtaggcatctgccctcttggtcctcattaaccctgccccccgcctcacagccagtgtgcttcactcacttatattacttatgtgtcttctgtagaatttaagttgtttgctttggtctaaattttgcaagtgttaatattaacacaggcttcttgaaattatgtaatgtgcagaaaactcttcaaacctcaatctgtgaggagtgctgtttacctggtttatttgctgagaaccccaggagcttgattgcatgcacaggctggagctggcttggtgcagtgtgattttccaaacagcctctagagcaagattgcctgggttcaggttctgactctgctgttttctaactgtgggaccctgggcacattaatcactctctgcctcagtttctttatctgcataatggagctaataaatgaatagatgtaaaataacaggctaataacattgcttggcacatagtaagcatttagtatgtgttggctgttatctttaatttaccaattcctataattgggtattttgtaatgattttgaacagatttggaactgttagaggctatctaaactggttgagaataactaaatttacactgtagaatcatctatgtacagttcactgaacagttaactgattaccaatatatgtgcaataaactcccagtgacattgcgatatgtctggaatggaatctaatcccttctccctaagaggttagtgaattccttagtatggagcagctgagggaattgtctctgtccaagtccatctggatgcttctgactcatctgctgatcctcctctgcgtggatgtctggcccacaccctaaagctaatctgagtcccaaggggcattttcttgtccaaaagttgatatgctaatttcagagaagtgctagcctttctgtctaaaattgctcacagttcacacctcatgtcttgtcttctgctctgtttccttcctaatttggcattacacaggtctgtgcaaagccagactttaaggaagttccctctcctcccgtgtcctctgccaaatgcttcccgtctgtcattggcaaaggctctgtcttgccatgatgggagaggccaggagctgctccaaagctggtggaaagagagccgttccacgttcagtgctccgtgaagagctgcttccactattgagatggggaggtgattaggtctaggtggtttccagtttggcttagccacagagatcttgcccattctgtgtatgtacccccttggcttgctttaggaatgcatgtatctgtcagaagtgctgtttttctggaaatttctttgttctggtggtttaaagcaactatccttatgcaactgacacagtacatagagagactggatcaaaaatgaaataaaatgatttagaagagtggtcagtgaagtgttggtctcaactcaatggcggtgtcaactcagtggtgtgactggactggcctctggctgaggggatgttcacagtctttgctgcctgaatactgtttttcctaaactctctagctagtttttttttctatctgttgtaatgcattaggaattccatgtattagcatgtgtttattcactgaattaatgagtagttaaccaaaaattaggggaaattttcacaataaggtacatagaaagtgaatttatctagtaatcttaagtatttgctgaaaaagaattactcagggtatcaggaaatccagaaagcattcctaatcattattattattattattattattattattattattattttgagatggaatctcactctgtcacccaggctggagtacagtggcgcgatctccgctcactgcaacctctgcctcctgggttcatgtgattctcctctctcagcctcccgagtagctgggattacaggtgtgtgccaccacacccagctaatttttgtatttttagtagcgacagggtttcaccatgttggccagactggtcttggactcctgatctctggtgatccgcctgcctcggcctcccagagtgctgggattacaggtgtgagccactgcacctggcccctaatcattatttacatgatcattctttattctactgtttgagatgacagtcatatctggaaacattcataacttttttttttttttgctttgagaagcagaaatcacagtggctagatttggatttttgaatttacatggtttatgacttgagcaagtcatttaagatctatgaaattgatgtaatatgctctttttacttcacaaagttttgggaggctcaaataagcctacttacttaaagctgtttttaaaagtaaaatgtgatagattacatgagttatttttgcagtctagatgttactatagtaaatattcaattagtaatcatttgctaaatttggacaatactaattacctcttttctctattttaaaaatttcagatatttttaaaaactaaattaatttttttttagagacaggatcttgctctgtcacccaagctggagttcagtggcacgatcatagctcacagcaacctccaacccctgggctcaagcaatccttctaccctagcctcccgagtagctgggaggctacaggcatgtgccaccatgcctagctaattgacaaaaattttttgtggagacgggatctccttatgttgaccaggctggtctcaaactcctggcctcaagagatcctcccacctgagcctcccaaaacgttgggattataggcatgaactatcttgcccagccagttttaaatatttttgattaaaaagaaatatatgttcattgcaaaacatctgtgaaacacagaaaagtataaagatcacctataatatggcaactgctatatattaacattttgttacatcttttcatattttctgtgtatatgcacacatagatatagacaatgcttttttttacaaaaatttatgtattgttttgttatttgatattttcatataagactgtattgtagacatcttttccagttaataagatctagttcatcactgttaatctgatgtgtagatgtaccgtgatgtatttaacttgcccctgttgctggagatttggttttccaatatcttatattttcttgatgctgatgttttattttcttatgataaatgtatagagttggagttcctgggcagttgttttctaagttgaaaatctaatgtacactgctccctcaccccttgacatgagttgtggaatagctaataatgtagattgtatgcttttttacagtccttgatacattttgagcctcatagcatgctataacattggatttatcagagcagtagttttccttgaacctattcaaaggaggtatgcttaatttaaaaaatctgaagacctcattatagcatagttttacttgtagctcagcagtggttctcctgtgaattaataatgcattaataattttaaatcttttaatgtaatggtatgaaatgaatcaacattcagcaaacatttactgaatcccaactgttgattaactttttactacacaccaaaggctataaagatgaataaaactcaagtcattttccttgaaaaacagtctagtgtgggagatagatgtgtaagcaattaattatataacattgtattagtccattttcacactgctataaagaaacacccaagactgggtaatttataaaggaaagaggtttaattgactcacagttccacatgtcttgggaggcctcaggaaacttacaaacatggcagaaggtgaaggggaagtgaggaccttcttcacatggtggcaggagagaaaagagtgaggagtgaagagggaagagccccttataaaaccatcagatctggtgagaactcactcactatcatgagaacagcatgggggaaccacccccaagatccaatcacctccctccttgtcactccctagacatgtgtggattgcaattcaaaatgagatttgggtagagacacagagccaaaccatatcattctgcccctggcctctcccaaatttcatgtcctcacattgcaaaacacaaatcatgcctttccaacagtcccccaaagccttaattcatttcagtattaacccaaaagtccaaagtccagtctcatctgagacaatgcaagtcccttctgcctatgagcctgtaaaatcaaaagcaagttagttccttccaagatacaatgtggatacaggcgttggataaatgttgccatttcaaatgggagaaattggccaaaacaggggctacaagccccatgcaaatccaaaatcccacagggcagtcattaaatcttgaagctccaaaatgatctcctttgacttcatgtttcacatccaggtgatattattgcaagaggtgggctcccacagtcttgggcagctctacccctgtggctttgcagggtacagcccctgctcccaccctggctgctttcacggctgccgttgagggtctgcagcttttccaggcacacacacagtgcaggctgtcagtggatctgtcattctggggtctggagaatggtggtcctcttctcacagctccactatgcagtgccccagtgggggactctgtgtggggactccaaccccacatttcccttctgcactgtcctagcagaggttctccatgagggctccactcctgcagcacacaagtgcctggacatccaggcatttccacacatcctctgaaatccaggcagaagtttccaaacctcagttcctgtcttctgcacagccacaggacaaacaccacatggaagctgccaaggcttgggacttgcaccctctgaagcaatggcccaagctgtaccttcaccccttttagccacagctagagtgactgggacaaaaggcaccaagaggctacatacagcaggggggatcctgggcacagcccatgaaaccatttttccctcctaggcctctgggcctgtgatgggaggggccactgtgaaggtctctgacataccctggagacattttccacattctgttgatattaacactggactcctggttacttatgccaatttctgcatccagcttgaatttctccccagaaaatgggtttttcttctctaccacatcatcaggctgcaaattttccaaacttttatgctctgcttcccttttaaacataagttccaatttcagattatctctctcaagttcaaagttccacagatctctaggacaggggcaaaatgctgccagtctctttgctaaagcacagcaagagttacctttgctctagctcccaataaattcttcatcttcatgtgagaccacctcagcctatacttcactgcccatatcactatcagcattttgtcaaaaccattcaacaagtttctaggaagtttcaaatctttccacatcttcctgtcttcttcggagccctccaaactattccaacctctgcccattacccagttccaaagttgtttccacatttttgggtgtctttatagcagtacccccctctttgcggtaccaatttactgtattagtctgttttcatactgctgtgaagaaatacttgagactgggtaatttataaaggatagaggtttaattgactcacagttctgcatggctgaggaggcctcaggaaactttacagtcatggaggaaggcaaagggaaagtgaggaccttttttacatggtggcaggagagagaagagtgaggagcaaagtgggaagagccctttataaaaccatcagaccttgtgagaactcacttattatcatgagaatagcatgaaggaaactgcctccatgatctaatcacctcctaccagctccctcccatgacacatggggattatgcagattacgattcaagatgagatttgggtggggacacagccaaaccatatcaaacatcatggtaagttgtattatagtatgtccttggaaaaataagtttccttccctctgcctgccataggcagagactagagagaagaatgggactttgtcagtgtacctcattaggacttttcaggggtcagttcaattcaaagtctctgctgaagatctgtgcgtgtgcatatgcctctgtgtgtgcatgtgtgtatgtatatacatattttaaaacctgaaatgggtgtcatggaatagaaggggagtgagagggagagactgagtaatacaatctagtggccaaaggattcttacagactaaatgtccggtattcagttttgtgcttttaggatttttgtaatgtaaagcctccctgtctccctagcccatgaataaagtcttctgtatacacagaagtcacaagtgaaggggcagtttgtttatttttaggtttttgtattccttaattattgttgcatgaataacacacatttgttttctcctaatttttgtggcttaggaatctaagcatggctcagctgtgtcttctgtatcacctgtagtcacaaggctgcaatgagggtgtcagctagacctggggtctcatctgaggatttgtgggaaggatctgcttctcagctcatttgcatggattttgacagcattcagttccttaaggtgtgttggactgagggtctcggttccttgctggctgttgacaggagaccaccctaagttccttactattaatacatggacctccagccagtgagagagagtctgctattaataacaagatgacaatcactatcttttgtattgattaggggagtgacatccctcaatgttgccgtattctgttggttactcatgagaagaggattgtacatgactaggaatactgggaggtggagatctttgggggccatcttagaggcttgctatcagagctttcagtggaaatcagcataaggagttgaggtctatgtttgtaaaagtaagggatagtcacaagacacatagcagagaacaagaagtcaatgagggcagaaagttggaggtaacagtatccataggataatcaccattctcgccttattgtctagggatttcagacatcctgaatgggtactaaattttccacaggatgtggagttgtggtgcaagcagtggtaactggagcataaagagcagcatgattccagttgccatctgggttataataataatagaactatgaagaaaatgccaagggcatcacacacaggtagagtctattaattgcctagcaaagctgggaagacgtcactagggggtggcatgtctaggtcttcccgtgtgagcagcagaaggaaggtaccttccagagcaaaggagtttctagtagtgcagtggttttagtaaacctggagaaagttgatgaggcttgagtgtgtgaaacatgggagataattgtagcagataaactgacaaagcatttggggacacgatatttctgaaaatttctaatttctttttttttttttttgagacagagtctcactctgtcacccaggctggagtgcagtggcgtgatcttggctcactgcaagctctgcctcctgggttcatgccattctcctgcctcagcctcccaagtagctgggactacaggccctgccaccatgcctggctaattttttgtatttttagtagagacggggtttcaccgtgttagccaggatggtcttgatctcctgacttcgtgatccatctgccttggcctcctaaagtgctgggattacaggggtgagccaccgtgcccagccgaaaatatctaatttctaaaaaatcttgcgggtattgatgaaccaattggtataaccagatttttaaatatggtccttctggcttcagtgtggtgggtagtcacaggggcgtggtggtgagtagaaaccatgtgaggaggtgatgatagtaacaggcgagtgaggatataaacatactgagcttcggtcgccactcacttgctgtgccttgactgctctttgtcacactttgcccagtttctgtctccttcctccttagtagtcaaagtttgaaaatttcagaggttagagttcctccgaaaaaagttatttgtcttggcaatagcttcttaattatcttcttagaatcaggggggaaatcagccttcaaagctattttaaggattaattaacaattctgaaaggctccagaagcttaaaagccttatctagactttgcagtgttcagtaataatcaaagtgataatcagagcacagcaggactcagtggggtgtgcaaatccattcatgtcttgcattgcctgtgggctgtgtggtctgccatgtctccataagtgagtgagtcagggtaaggagaggccctgctgctaaagtggaaaagaatcaatgcctacaactgacaatacaagctgaaaaaagcttgtttaaagttgatcttaagatatggcactgaagcacaagtaaccaaagaaaaaaatgaataatttggagctcatcaaaattaaaaacttctgtgcttcaaaggttactatcaagaaagtaagaagaagaccaggcatggtggctcacacctgtaatcccagcattttgggaggccaaggcaggccgatcacttgaggtcaggagttccagaccagcctggccaacatggtgaaaccctgtctctactaaaaatacaaaaattagccaagtgtggtggcatgtgcctatagtcccagctacctcgggaggctgagaccatgagaatcccttgaacctgggaggcagcggttacggtgagctgagatcgtgccactgcattgcagcttgggtgacagagcaaggctctgtcttaaaacaaaaaagaagacaacccacagactgggaggaaatatttgcaaatcttatatctgataagggacttgtgtctaggatatataaagaacttttagactcagtagaaaagatgtttcaaaaataggcaatggataggaatagacatttgtccaaagaagacataccagtggccaataatcacataaaaaaaagtgctccgtatcattagtcaccaggaggaaatgcaattcaaaaccacaatgacatgccactttacacccactaggatggctataataaaaaagacagataatttttggcaagaatatggggaaattggaatcctcatacactgctggtaggaatgtaaaatggtgcaactaccatggaaaagtttggcagtttctgaaaaggttaagtatagagttatcttatgacccagcaagtccactactaggtacatatgcaagataaatgaaggcatgtgtccacacaaaagcctatacaagaatgttttttgcagcattattcgtaatagacaaaaaaggaaacaacccaaatggtcatcagttgatgagtggataagtaaaatatggtctgaagaaaaaataaacaatttttctcctctactgtcatacagtcactcaacacaatactatttttttttttttttttttttgagacggagttttgctttgtcgcccaggctggagtgcagtggcgcgatctcggctcactgcaagctccgcctcccgggttcacgccattctcctgcctcagcctcccgtgtagctgggactacaggcgcgcgccaccacgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccaacacaatacttcttaagtgtagagggttttttccacacaccaaacaatcctccagcaggtgcaaactgggtatcctataattttactcaattctgacactagctacttgaagacaggatcagatcccacatgttgagggctcagtcagcacctctcccccagtttcagatgccaatcgcaagtaatagattgttacctatacttctaactgagggattcccatgaccctcattttgggttcagttaatttgctggagcagggccaggtgtgatggctcatgcctgtaatcccagcacttttgggagggtgaggcaggaggattgcttgagcccaggagttggagacaggcctgggcaacatagtgagactctatctctacaaaaaattgaaaaattagctgagcatggtagcatgtgcctgtagtgccacctagtctggaggttcaggtgggaggatctcttgagctcaggaggtcgaggctgcagtgagctgtgatcacaccactgcactctagcctgggtggcagagcaagaccttgtttcaaaaaaaaaaaaaaaaaaaattcctagagcagatcacagaacccagggaaacacttacatttactggttaattataaagaatattttaaggatacaatcgaacagctagttggatgggtggggaacatggggcttccatgccctctccaggcgtgtcaccctctaggcacaaactcagcaatccacaagctctccaaaccctgccctttggttttttatggagcttcattaagtaggtatgattgactacatcactgtccattagtgatcaactcaacttacagctcccgctcccttcccagaggttgagggtgaggttgaaagttacaggcctctagacatgtcctggtctttcctgaccagcccccttcttgaagctacctaggggttctcagccatcagatattcacttttgaatatcttttttatattcaaaactatagttccagagttctagagattccaagggctttaggaactatgtgccaggaattagaggcagagacaaaatatatgtctcttattatatctcactatcatatatgatatttcttttttttttagacagagtcttgctatgtcaccgaggctggagtgcagtggcgtgatctcggctcactgcaacctccatctcccgggttcaagcgattctcctgcctcagcctcccaagtagctgagactacaggtgcctgccaccacgcccagccaatttttttttgtatttttagtagagatggggttttactatgttggccagggtagtcttgaattccagaccttgggatccacctgcctcagccccccaaagtgctggaattacaggcgtgagccaccgctcctggcccacatatggtatttctatacaatagaatattatttggcaataacaaggaatgaagtacagagggtccttgacttaagatggtttaactttaagatgatgtgaacagccaggtgtggtggctcatgcatgtaatcccagcactgtggaaggccgaggcgggcggatcacctgaggtcaggagttcaagaccagcctggccaacgtggcaaaaccctgtctctacttagaatacgaaaattagtcaggaatggtgtgcctgtagtcccagctacttaggctgtggcatgagaattgctttgaacccgggaggtggaggttacagtgagccgagatcacgccactgtactccagcctaggcgacagagtgagactctgtctcaaaaaacaaaaagagataatgtgaataatctgattttcacttttagtacagtattcaatgaattacatgagacattcaatactttattataaaataggcttcgtgttaaaatgattttgcccacctgtaggctaacatatgtattctgagcacacttaaggtaggctagactaagctatgatgttcagtaggctggatgtgttaaatgcaatttcaatttatggtattttcaatgggatgtaaccccgccataagcggaggagcagctgtactgatgatgtgctacaatatgtgtgaaccttgaaaatattatgctaacactatgtctgaaagaagccagatacaagagggcttcatattatgaaaaactacatattatatgtactttaatgctacataaactacaaaaactacatattttatgttaccatttataggaaaagtccagtataggcacatttagagagacagaacggttagtgattgccaaggtcgggggagtggagggattggggagtgactggtaaagggaacagagttgtttagtttgctgtggctgccatgacaaattaccatagatgggtggcttaaacaacagaaagttacttttcaaagttctggaggctgaaagtccatgatactggtaccagcatgtttgggttcttgttgaaagccctctttcagtttgcagacaactgtcttcttcttgtactttcacatcctcacatggctgagagcagagagagaggaagcaagccctctcctgtctcttcttagaaggacgctaaccccatcaggagggcttcaccctcatgatctgatcacctcctgagcgctccatctccaaatgccatcacactggagattagggcttaacatatgtattttgtggggacatattcagtccataccaagtatttctctttggggtaattaaaataatctaaaactggttgtggtgatagttgcagcacaactctgaatatactaaactgttgattatgcactttaaatgggtgaattgaatggtatgtgaattatatttcaataatactgttcaaaaaaaaagttgatagtaaaaagccaaagggaaagctgggccgctgggtagggatggggggcggtcaaggaaaaggacctccctgggtaaatttcttcaccagtcacctgtctctccattaggtcattgtatgtggtttttgagggtttttttctgtggttggtggtggtgttttagaaaaagtggatgtgggctgggcccagcggctcacatctgtaatcccagcacttgggaggccgaggtgcgcagatcacttaagctcaggggttcaagaccagcctgggcaacatggtgaaaccttgtgtcaataaaaaaaattagctggatgtggtgacgtgcacctgtagtcccagctacctggggacctgaggcagaaggatcacttgaacccggtagatcgagatcgaggctgcagtgagccaagattgtgccactgcactccagcctgggtgacaaagtgagaccctgtctcaaaacaaacaaacaaacaagcagaaaaacccaacaagtggatatgcctgcattaaaaaaaaattttttttagagacagagtcttgctctgtcacacaggccggatggcaatggcacaatcatggctcactgcagcctcaagcttcaggggttaagtgatcctcctacctcagcttcccaaagagctgggattgcaggtgtgagccgctgcactggtcttgcattttcctttcctctaccaaacctggctccatttgcttgttaaaaaagcagtgagcattagtggaatgttaatggtctgaacgactttaactttccatctggctgttactctccaggaagtctcttttcatttgattgcaactgattagaggttcttgttcatgttgcatttgatgtggctcatttagagtaaatctagtgggtgattttctctcctcttatgtccagcattccaaagagctctcttttagaggttgtgtccgcttcatcaatagcagatgatcacatttctgaccagccagtgtgccaaaaggatggaaggcaaagtgagggctgaattgtgtgtgggagaacccggaaactttctttcctcgtctttacgtgacaggcagcgggcccagcacactatgtcactttggaaagtcatctgtccagggcagctgtgataatggtatttcacaaaaaacctggggctttcacccaacatgccaaatgccagcttggccaagatacatccactcagcagactgacccatgctgggattctgcagaccagattaaaacatttgggtgtcccatctccatactgtggtctggttggttgagatgcagttgccttgcagacaagtcgacacatttggccctcagtagaagttcctcactgtaggttaatgacagtcaccagtcaaaccaacatggtcttaacttgaacgctctaaaaggaataaaatggtttcttttattggtttatcaattcatagcctaaaagaggaagttagcttgtcgcctgggcacctgtgtaagcccttgctgctccatgtggaagattcatgctttagaacacagcctttctttctttctgtagattcggatattatagggagacagaatctagggctgtggctggtgacctacttccttcttatggtgaagaaggtcagggagagagagaaaatgaggaagggagaagaaaaaaaggaaagaaggaaagagagagagtgagcaagagagccacagaaaaataatcattataatgaatgagaagaaataaagggatctgaaaaaagaatgagaaggagaaatacggttgtgaaacgagagggaaagagaatgcaggccgggtgcagtggctcacgcctgtaatcccagctctttgggaggctgaggcgggcacatcacttgaggtcaggagttccaacatggcaaaaccccatctctactgaaaataaaaaaattagccagtactggtggcatgcacctgtaatcccagctacctgggtggctggggcaagagaattgcttgaacctgggaggtggaggttgcagtgagccgagattgtgccactgtactccagcctgggcaacagagtgagactcaaaacaaaaaaaagtttaaaaaaaaaaaagagagaatgcaaatgggggagagaatggtatcaaggtatgaacaggaaaacaagttatgatgggtaaagatatagggagtgctgaaaaacatacaaggctaccgcttatgaattcttccttctttatcctagaaattgcaattgattgttaccaatggcctggagcttgcatatttctcttaaaaacctagctcatgccctctcttgtgcacaccatacagtcacctgagagtattccagtgctttctttggttcttctgcctccatctgctctcttctttcttttaccctccccaacagttggtccctaaaatagtagtactttagatctagaagcaacctcagagaagggctaagatttggctctttcactttacagctgaagaaaaagaaatccagcaaaattaaatgatttgcccaaggtcctataaccagtggactgcaaggctggactagagggcagagtttccatcccatgggtgcaggccaggtcctgagggacacgcttctctctgtagagagctgtctctcctgctcacatcctgggtaaatccttattggcaaagaagaaggtgggagagaaggtggccaacaaagtgctagctctgccaacttctctcatcgtcaggagacaagtgttgcaggtactttttattctctcccttttagtgtggggatgaagtggaggccagttggtttcctattggacagattctctttctcccttggattctgcctggccgtctgctgatggccccttctggatgtaacacatgttatctggaatagcgcaggtggggatgggtgaagagcattcagatagaagtttctgatggtagtgggcagcagggtggaatctcactttaacccacgggttctcagctggggtgattttgccccccagggaacttttggtaatgtctagaggcattttttgttgttacatctagggggtgctagtgagtagtacatctagtgagtagagaccagggatgctgtcagacattctccaatgcacagacagcccaccataacaaagagtcatctggtccacgatgtcagcagtgttacccaactgaacttgagtcctctcacccagcatgcacaaaaatccaaacactgatactaggatttgcagggagagaaagttaggcgtttgtggcagggtgccaaacagagaattgagcagcgaatgcttaagacctgaactctccaatagcttacaagcaagagatgttttgttttgttttgttttgtttttgaaacagggtcttgccttgtcacccaggctggagtggagtggctcaatctcagctcactgcaacctccacttcccaggttcaagcaattcacctgcctcagactcctgagtagctgagattacaggtgcctgccaccatgcccagctaatttttgtatttttagtagagatagggttttaatttactgtgttggtcacactggtctcaaactcctgacctcaagtgatcagacttccttggcctctcaaagtgctgggattacaggcgtgagccaccgtgcctggctacaactgaggggttttagttttaaaggcaggggttcatttcaagaaagcagaagttacaagcataatcgtaaatcaatacatgggtattatacactggtttggcccaaaaagatgggatatcttgaagtgaaggttacaggtcgtatgtggattcaaagattttttgatttgcaattggttaaggaagtaagaattcatctgaaaacttggggtcagcaggaaggaatgtcagggtttggcctgtgggcataactctctctaggcccctcaggaagaaattgacaacaaagaactgtcctcagggttcagtcttcatttcccccttatttgaggtctgtgtgacagcggttgacattttccatctggtaagggtttgggtttctgaaaaacgactcagggacatatgtcaagatgttatttgtagtttctatagggaaccaagcatctcgtgagtctaatgtacttgggtgactattgttacgctatttttaccttcttgcttagcaggttatttattcatttccttagttgctggctgcatggctagctaggtacccagaatttcccttgaagggactcaaatttttctttattttcaggctgagaggaagctggggaggcccctaagagggatccctactccatctcaataatgttgaggtgaagaaatttcactttgcctgaatctttttttagcagaagttcagtgctcatagcccaggatagtcagagaccctttttcctaactgggtggtagcgcctggagacagttcagtgcagatacttgagcttggacaagctgcctgtgatgataaccctgtgatgaatttcagggttaattaatttaaaaagtcaaggtttgctgaaaaccaggcagaattctcatctcctttcccctggctacagctcaacaggcagagcttacctgcttctcctctgcttagggcgacatcttaaaagggcagaaataaggactgtcttaggtgtggacttccagtggtcaaagtgtagtgctgaatagatagaactctgtgagtagtcacggtggagaattaaaccagaaaggaaatgagggtgagatggaaggaggagagacagattttataaaaggcaaaatagattctcctgtttgcagcagtcaagttgaaaccagccatagctgtaggcaagaaattatagagagattatcatcttagtgattgttctgtaaaattgctctaggccaaaggtgctgctttcacatttttgtaatttaacctctttttaccttcctgagccacagtgtgcatttgtgtttctaataagctgtctttttccaggaaggaattttggtgatgtttctgcctgtgctcacatatagaaaaggggtgctacgtgttctgggccattctagcctcccctgaatggacaatccatatgatataaaaatatactgttatataatcagagtttccaggtaaaataattgccacttccttcttaataactcatttttgttcttgtttatctaaaaagctaactaatgttgattttatttctatatgatcaatttatttttctcttattataatagaggttgttattaaagaaaaagttttccatccttccattgattctcagttactctaaggaccaagacttgttgatttccaatctgcctacattctagctcatttatcagaacttttcatcccctctatttcaagctatgttctaaaaaaatctttccaactgttcattacttgtgtttttttccttttcattgaatctgcaaatgtttaatgaatccctgctagctgcgagtcactgtatttagagctgcgggatgcacagctatgcctaaggtaccgtctgaactctcttggaactgtaggactgggaattccagtctgtgctcttggaggttgcgtgagggagagggagaagaggctacttataagactttgagggtgtactttgatccaccttttcattccttgtctttttttttttaaaatgtggtaaaatatccataacatttaccattttcaccatttttaagtatacattcaatggcactaagtacattagatgcagaatttttgctcctcctcccagctcctggtgaccactcttctactttctgtctccataaatttgactactgtaggtagctcatataaatggaatcacacaatatttgtccttttgtgactgcttatttcacgtagcatgatatcctcaaggttcatccatgtcatagcatgagacaggatttccttcctttttaaggctagataatattctgttgtatgtatataccacattgtctttagctactcctctgttgatggacacttggactgtttctaccttttggctactgtgactaacgctgctgtaaacactggtatattcccagtccttatctttaaaagcatatctgcatgtgaaagcactgaaaaaaaattggccaatgatgcctctccatatccatacatatgtacatgtatttatgtagttgtatgtgctaggcatagttatgtggtggcaatcattttttttctggcttgaaattgtaagccagaccaatatcatctcatgcccttgcttcacatcctcctttctctccactaaatctctctcctccgccccaccaaccccccaccgtctcttccccatcttctctttcccctgcttcaattcagtttagcacacttttattattgttaactttttgggtgcaaagtgctctggaaattttgaagaatgaaactggccttgggtttttcatggtctcttattggagacgagacccacggtagcagttgagtgagtcaggctgtggacctgccatggtggccaggctcatgaaaggatggcaaagatgagggaaaactcattccagccaaagaaaatgacccaaacaaagggtgtgggatggaaaatattggacatatttcattttaagtagtttttatttgtatgtggcctttaaatgtttttaattattaggatgtgcttgataaattccctacctgggagtaatagtgatttctccaccctgtgttgtagattttatatagaaaatttccctttaataatttgctttaaggccgggtgcggtggctcacgcctgtaatcccagcactttgggaggctgaggcaggcggatcacaaggtcaggagttccagaccagcctgaccaacatggtgaaaccccatctctactaaaatacaaaaatcagccatgcatggtgatgcgcacctgtaatcccagctactcaggagactgaggcaggagaattgcttgaacctgggaggcggagcttgcagtgagccaagattgctccactgcactccaacctgggcgacagagcaagactccgtctcagaaaaataaaataaaaataaaaataaataaaatctgttttaaaagaagtgcatttgtgtttgatgtaatcttagatattctccatgcttcagagaaagaagcacgttttgtttttagtatattttacatcagtaatttagttggatttttttcttgtaattctattggtttttgaaagattttgaaaaaaatttttaagagacagggtcttgctgagttgcccaggccagccttgaactccttgccccaagtgatcctctcaccttagtctcctgagtaactgggactataggaatgtgccatcaagcccggctcttttggtttttttaattaactgaaatctgatagaatcaaatgtttgtgaagcctggaaaagaagccctctcaatttaacagtttaacatttgaagaatgatgttgctcagttgagcaatttaatacttgaaaagtggtttctatcagtcaatttatttaacaaaagaaataagtgaatttgagacatcttgccacaaatatgttacagaaccccagtaggtgtacatatgtgtatgtatgtatgtatacgtgtatacacgcacatagtccctctcactttaagtgtgaaggtaaaaaaaactgggacaagcacggtggctcacacgtgtaatcccagcactttgggaggttgaggcaggaggatcatttgagaccaggagtttgagaccagcctggagatggcaagacctcatctctacaaaaaattttaaaaattatgcaggtatggtggtgtgtgcctgtagtcccagccattctggaggctaaggtgggaggatccctgagcccaggaatttgaggtggcagtgagctatgatcatgccactgcattccagcctagataacaaagtgagacctcattgttattggaaaggggtcacaatgcagaccccaagagaacgttcttggatcttgcacaagaaataattagaagcaaatccataaagtgaaagcaagtgtattaagaaagtaaaggaataaaagagtgtctgctccataggcgagcagtggcacgggctgctcagctgcttatacttattgttacttcttgattacatgctgaacaaggggtggattattcatgagttttctgggaaaggagtgggcaattcccttgaactgaaggttcctcctttttttagaccatacagggtaacttcctgacgttgccatggcatctgtaaactgttgtggtgctggtgggtgtgtcttttagcacgctaatgcattgtaattagcatataatgagctgtgagaccgagcagaggtcacgctcctctccatcttggttttggtgggttttagccggcttcgttactgcatgctgttttatcagcaaggtctttgtgacctgtatcttgtgccgacctcctatcttaccctgtaactaagaatgccttaatctcctgggaatgcagcccagtaggtctcggccttattttacgcagctcctattcaagatggagttgctctggttcaaacgcgtctgaaaacatctctaaaaaaataaaaataaataaaattaacaacactttcagccagaagggggaacataagatataaagtgccatttttctttttttgatctttttttaaaatgattatctgctatcagcagatggccacacaatatgagcagtaaataatgtagtacatttagccggtgatttgggtcaatggtactgctagtctagctgttttgacttcaacctgacttccaagagtagcttgccaggtctgtaggactcactcagggatcctcagaggcccgaaaggtccagacctttgttaagcaggagcctgaagaagtagaggctccaagaaatatggtccaaccccctggcaagctacgacatataagaaccagacctggggagggagcagatggatgaaaggaaatggaattggaaagcgttcctagggttatgcgggaagaggagcaagatgctgtttgaggccttgctggtgaccctagattagttagtaggggaacctaaaaaatggcattatggctttctctccatgcttagtagcaattagtttggaagcttctgggacttagtcccttacagagtcatttacctggccctaggcactggggagatagagtattgtttcccagcatggcccattctggctctgcatttagggtgaggtttggctagaagtgtggcagactgaacagatcacatagtttgctctttctttcactccttcaactatttattgaacacctcctatgtgctgggcattattccaagtgctgggaatgatggcgtgagcaggacagaggctctgccctgtttgggtttgtgttctggtggaagtaacaggggaattagtgctcacgcagggtcttctgacttctatgtggatgttacttgcaatagtgctagacagaacactatcttttaatcacttgcaagatatctccctttttgatggttttggaagaagaaagagaagtcatacccaaagccgtttttttaattcagttttccttagaaaatcagaggacttctgaagatgtctccgacaatataatctccatgtcttttggtgatggactgatttgtccagatgcttctttcttcctgcagtttctgtgccccagtctcctatcaaaactcagaactttcatggtaatgattttagtaaactctcataaccagcaataatatcccttcagcccctggcctggccaactgcctaccttcatgtttcttcccactgtcatattatgattttaactggatttaataactcgtggcaaatttaaacagaaatttatagcccccattacagattgccctttaccttcttccagaaatgtttcccataagtactgagcttatgcaactaaaacatgatgatgacttctaaattcatagtttattaaacagattcttgagcttaagaacacagatctctctatacacaaaggattctgcagtgaaaagttccaaaggggaataaagtaatactttgggattagcaaatgagagagagaaaaatcatttgtctttcttagtgtctcacaatcattatattgagtgccaaaagtttgtggggagaaacaggaggaagagctttatccgaggttgaaatcctaatggcctaatggtgtttctcccatggagtgtggggagtctgctcccaaagggcccaaaaggctgaggtcaggcgatgcagtcgtggctgttttgccatggtctttgagggctttgccaagatgaccaacatggggatttgatcaaaatgcaattttgtttatgtggacattttctcactaggaaattgtcttgaaaataccaatttgtttcacagaaaatatcagccaggggttaatcaccatcatttggcaccggcagcatatgcatttagatgtgaacaaaggactacattgttagatgagttgtaaaggttttgctaatcttgaaaacttctttttaaatttaattagctggctggaaacggtggctcacgcctgtaatcctagcactttgggaggccgaggcgagtgtatcacctgaggtcaggagttcaaaccagcctggtcaacatggtgaaacctcgtctctactaaaaatacaaaaattagctgggcatggtggtgtgcgcctgtaattccagttactcaggaagctgaggcagtagaatcacttgaacccagggggcggaggttgcagtgagccgagaatgtgccactgcactccagcctgggtgacagagcaagactgtgtctcaaaaaaataaatgaataaataaaataaaataatacaaatagataaataaaattaattagctgaagaaagtatcagtgaaatgtgagggcatgaatagacatggcattatatgctttggttcaattattatctgagccagatttaatgatagatatttataaatttaaagattctagatgtcattgaattctttataaaatgtaggagttaaatactgtgagataggagaatcatgagccttcagattcagcagatgtataaaattctactttttaactagtatatgggttagacctcttggtatttttgatacttaaaaaaactcccagctaatttattcagaatagcccataaatgagacattcccatttagccgcaatgaaaaccgggggccatcacttatcagccagtacaatttttgtagaaatagaaggtggaattaaaattcttattctttttggatataaagtatactcattgccttaagaccattaagtgactttaatctttgtcaacaaattatgtcttcggtgtacacaagaatcatattgccataaacttcttctttttttctgcattctctattttaaattcttttgaaaaatagatgttattttccatatggtctgcttcagtgcttacttcatgccttcgactatgtttctgaggacttatgtagttttccctgagcttcgctctacttttccagggttggaaggaatacctgcatttctgtgatcagtgcttggtcccaccctactcccttgccttgcctgcctgccatgcacagagtgatcactcatgttttatcagatgttttcattaagacatagagcatataacaaggctcttatcctcatagaacaaataatgtagttggaaatgtaagataaaacctatatgaaaacaagaatattctagggctccatatgctgcttggcaagtgaacagagtaggagaagtgtaggcttcctccaaaagactggtcaggggaaggtttgggttcagcattgagggaatagtaagattctttttttttttttttgagacagagtcttgctctgtcgcccaggctggagtgcagtgtcgagatctcagctcactgcaacctccgcctcccgggttcaagcagttctctgcctcagcctcccgagtagctaggattacaggcacccaccaccacacctggctaatttttgtatttttagtagagatggggtttcaccatcttggccagtctggtcttgaactcctgacctcgtgatccatcggcctcggcctcccagagtgctgggattacaggtgtgagccaccgcgctcggcccaataataagattcttaagtagagacctcagaaaactatgtttcttgcttttttttaaatacaaggaaatgtttgcttatacagctaaaccattttctttaaatgctgtttaattatccctatattaactaagcaagcaatgacctcagttctgaattactgtattatctttcctctatatccgtccagagctctagccaatgggccagcagggaacatgaggaagtgtcacaccctcttggggtggggacatacagggctgggaagagagggggagatttcctgtccagagtgtcctgggctgggaggtggaaggcctgagggaactgtccctctccaccactaacgtgtcctagcaccagtcagggcctctgtccccatctgtgtggccacagctggtcaccctcctcccaatctcacatgccatgagtctttgaaaatggctgagtttgcagcctgtcctgcttttattgccatgtcttttgtggaaagaggaaaaggaagtctcagcctctgctgttaatgagctgttatacgagccagcaggctgcagcagagtagtgggcctttcctcttctgtgcctccagctgctcacgcacacctatcctcttccatctcccagccagactcggtgctgaggtagaagcctgtgtcccaggtgctcatcatctctgctgaacacattcattatctgcaatcaagctgcattccagcttcttgccaaacccttgtctgtcagtagaagctgcattggggatatacagtctgaatttggctcattaggccaaaggcaagcagcagaacttggaaaaggccggggagggctgttgcgtggttctcagcaacttgtgcacactctggtgtgagagttaccaaaccccagaattacaagctcaccaaccccttactttacaagactttttgttctgcattcccattgcaggccagcatccttgatgctttgaagaatttaggaactttgccattggcaggatttatgaaagctacccccacctcctgcctccaaatacagcatggtagatcccagtaggttcctgacatgcatttctttgggggccctctgatcctccccagttttcctggccagatgaatgctgaagattccctgggccctgcgttttgtcacggcctccttgggggtggttcccttctgcatccagctgttgcagcctggctctgtgttcactgcaggctggggcccggccagctccctgctgtagcagttggtgagcagctccaaggatgaggggggagcagcagtgctgcaggcctgctgaggtcttggctcacggtggctcccctggctgacttttgaccaaatgggagaagaaaaatcttccctcctccctttaggtctcagagggaggccatgtctccctagagcatttctttctctccctcccatccttaggaaaagaagagtgtcatcctaaatgctgtgccttcacctgagaggggatatgtgcttttggtctaagcaagaagaatgagaaaaatttaggctcactgggagtcagaaggtcacattattcagttgttcatggaatacttcaaaatgtgtgagcatttatttcttgcctctcttttggctttgaaataccttaaaacaagtcagatacgtaagcatttgcagaagcagggtgtaagtagatttaagaacggcacgattcctctgtaatgtccacagacatatttctttagcaaagattgacatttgggccaaagcaggatttatttattcttgcaatcactcagtttgtaaattgacgggatatagattgccacagaagcacttccctgattcatattcaaaggagagtcttgttatattattaggtatagcaagtgtgttattgttaatatccacctttgagtacttgttcaaaggagataagcaggatattatattatttctaaccaaaccaagcttctcagacatcactcattgagaaggtaacaaaacagaagcccagggaagaataccctacataagtgcttgggaacctatgcccccgcaagaatcaactggcctgagccgcaagtgtggaaatggtctacatgcgccatcttgtggctaaggccatcaagaacgtttggagatagaaacacccaaataagagttctgctcaggttcactgcctttttgaagctgaagttcatgatagctgctttctagcatctagtgcacttcctgggattctcaattaatatttgtcaggtgaaactcttcgaaggaatctcatgtcatggcagagtatacttgttctatgttacactagaaggcatagccaagactgacatgtcctccagccatggtccaaggccgttgtgtccaaaataagacagaatactctaaacatggtctgagtagcctaaagtaacccagaaatattacttccaagactctggaaagtctgcttctagaggtcgacatcctcactgaaatctgcctttcaccacacttaacactttaaaaaaaattaatgtggtaaaaaacatgtaacataaaatttactggccaggcacagtggttcatgcctataattccagcactttggaagtctaggagagcagatcacctaaggtcaggagttcgagaccagcctggccaacatggtgaaatcctgtctctacttaaagtacaaaaattagccaggcatggtggcgcgcgcctgtaatcccagctacttgggaggcggaggcaagagcattgcttgaacctggaaagcagaggttgcagtgagccaagattctgccactgccctcctgcctgggagacagagcaagactctcaaaacaaaacaaaacataaaatttagcattttaaccatttttaagtgtacagtacagcagtgttaactatatgcagtccattatgcaacagatccctagaactttttcatcttgcaaaactgaaattctatatccattgaacaacaactacctgttaccacctcctcccggtgcttggcaaccacattatattttctacttctaagagttttactgctttggataccccatataagtggaatcatgcagtatcttttttgtgactggcttatttcacttaacgtcttcaagtttcatccacgttacatatggcaggatttcctccttttttaaggctgaataatattgtctgcatacgccacattttgtttatccattcatgcatagatggacatttaggttgcttccacatcttggctattgtgaataatgctgcggtgaacacagtgtgcacatttaacagttttattctcaatgatatgatggagtttaaaaatcttatggagaatttaatttattcttgaagttttaaactcaaatgcttgaggggtaaaagcttgagaaatgtctgttggttaatctgagctattcttgcggtttgtctaacaaggacaatcttaatccatatcaggtgcatcttaatacatacatacatatatatatatatatagagagagagagagagagagagagagagagagggagagggagggagagagagagagagaaagagagagagagagggagagagagagagagagaaagagagagagagacggagtttcgctctgttgcccaggctggagtgcaatggcacgatctcagctcaccgcaacctccgcctcccgggttcaagcgattctcctgcctcagtctcctgagtagttgggattacaggcatgtgccaccatgtctggctaattttgtatttttagtagagatggggtttctccatgttggccaagttggtcttgaactcccgacctcaggtgtactgcctgccttggcctcccaaagtgctgggattacaggcatgagccactgctcccggcctgcgaatatattttttaaagttgccttgaatcatttttggagcaagacagtgaataaatatacaaaagaaaatcatccgtttaagaaagtgcttgctttctgtgaagcatctggctattgcttgtaacatggtggagttgatgtcagacattatgtctctcactgaacgtcactttccttctcctgcccggaggtttgggattttgaagggcattggattataaagtgcacttgccaatttgtgattaggtctggaaatggggaatttgttcatttaacagcaggtgccacttgatcaaccactgccaatacttttgccgcggacttcccaggactccagctgcactcacgattcctttggtcaactgttctgcctcaagcctgctgtagatgccactgagaatagaaagttgaaaccagttgatcccagtgaagcagcaccacacagtacttattagagactaagaagccagggaacacttttcctcataattttttttccttaccccaggggttagtgtgtttaaaagagcactgtgggggtgctgttgtagaaagcagcaactctgtatcggatgccatcccctggtgttttaaaggcaggattacaaacatctagagaggaaaacaaaaaacaaaaacaaaacccacattctctaattcatatacagatcgttaagtgagaatggaatttatgcgatgcttttcatgatgggggattttctgcaagggaagccgcttgcccattttgtggtaacggcttgaaataaaggagaggccggagcaggcagcaaggttagcttgctcttgcaggataagcgttgtccttgctctcagttcccctgctgtgtggcctggtcccttccttgttatcacccttcaccagagccctgtgtgagggccctaatggagacttcaagagcttttagttcactaggtactgccacctgcatccactctctgcttttccttcccctgcaggtctcatgtgtccagcatagaagtatttttaagacctactttgcaagacgtgacttctgttgggattttaatttgaaatgaaatttaaatgtaccaaccctgggcattccgatcatttaatagacctgttgggagacaagtaatgaggagaaagccactccgagtccatcttgctcttaagcctgacaggttttatttggaagtgctgcctgttagtgagggagaaatgctcatttcttttttttcctgtgtaaggaactgttgaacttaattttcccccccaggtgttaggagacaggaattaaaaatagtatgtgacccagacacaccaagcaatacaaagttcttgcttctattatgttgctaactacctgcatcttgttaataaggaagggaaatgtctgttacctacaaactgaaggagtgaatgatttgattgagggaaatctgaaataccacgagaattagagaagtcctcacaaaagggcaaaagcttacatttttcatttttctctttatttcatgtgactttggccttaaagtcctccttcccactttctcacacccccactagctgaatgttgtgtcagattatttagaactttctaaataggggagaaaattttttttccccaagtttggctcctacgtcctttgagactataccgtctgtgcaggagaatttataaaaagatgggaggtttgggtgccggtttcctttttggaaatggtatttacccagatcacagtgaatctgcctctcgccttaaatggcagaggatgatagggtaggatcttcacgtgctagaaaggcagctggaagccatgtggagacctcaggagacctgaactacaagggtatctaagcaactgtggctgctggagttgaaggagggagtctgaagttgctcttctaggatgctggtcgcatcccctcagtcccctccctgttgttttcagtcacttcagagaggtggtggcagcccgtctacaccaccaagcggggatttaatggaagcatttcatttgcttcagcaagtcaaaagctgcccttttgtaaaaacgtgtaagcatgcctcttcatcctcattcccccaccccgcttctcctcattcattatttaaccagccgcctgggtcttctttctgctctcaagcatgccagtcccttccccacctggggaccttggccctgtctgttcctcttgtttggcatgctgttctccagggccttgcctggctgccactgcctcacttaggcctgaagcagaacctctgcaggggaacctgtctacaccaaactagttcatttttctacctttttatttatttatttttttttaagagacagggtcttgctctattgcccgggctggagtgcagtggcataatcatagctcactgcagccttgaactccagggcttaatcaattctcttgcctcagtctcctgagtagccaggactataggcgtatgccaacatacccagctaatttttttgtttttgtagagatggggggtctcactatattgccctgggtggtcttgaagtaatcttcctgcctcaacctcccaaagtgctgagattataggcatgagccaccacaccctgcctaaaaaatctttttaagatggaaacatataaagtatattgagactttctttggagagagaaaatgcattaagcaaaaaagcatttagatttttttgaattccctattattaaaaataaagttgtattaaaatgtctcggtaatatatggttaaaccatagtctctatttgtgttttttaaggaatttgtaattaattgtggctttcttaaaatcatgaccgactgagttagatgtgccaccatcaatagttgatagctaaaattagtagcaagttaacaatttacttgttcatttccatgggctgctaagtagattttggtccaatgtattttaggggaaaaaatgttacactgagagtcaggagacatggctgttgccccttcctggctgtgtggcctgggtcagtcccttcccttctcaggccaatttcttatccgtggagcaaagataatggacggggggaaggggattccttccagctctccacagtctctggttctatattttgaagccatctgtggggcagttttaacagaaggtctgaaaaaatcagacttggtcatgtgcctcctattccttttttctctctctctatttgccacatcctttccccacactatagaaggatccagacactcgaatcatcaaggctctgttgctctccgctcttgcctgaatatgaaatgagggagtttgctgtcccctgatggagccttcgttcaagcaagccacgggctgtgaggctttcacccttggcttggcaagactgtcagcacggtgcttcccttttagagagcctaatgccaacagaaagggcagttttctagtaatggaggaaaatatcagttttcaaaaatatggataatttttaaaacctcctctttttcctgttgcctagttctctaccattaactccaggtctctcttcagggtctagcagagaccctgctgactgtcctctcactccttagaggccatcaggactctgaaatccgaggattaatggcggccgggaggggctgatgggcaggggagaaagcctaggattaaggatgaggagacctgagctccatctgtggatcctcctctgcctggtcccaggcctttgagcaagcccctggctgtgtctgacctgccttcctccctcaggttgtgctgcagaggggccacagtacagataacacagcacccgtcaacagtgggatattaggaggagaagaagtctccgctcacctgcgtgtgctctctcatcctcagagtcccatgtttccagtttctggaaggtcctcctaccagcctgaactacatgcattgtataacacgtaactgcaatttaaatcttgatttaccctcagagtcttattcggtcattaagtcatcatcataatatcttgtacctgttacttgttcagatttaataatttgtgaagtgtcctttgtggggtgaccaacagtcctggggactgaggggtttcccaggatgtacaatattaggtgctaaaactgaaagagttctgggcacatcaggatgatggtcattcttctcttggttcctctttttctttctggaaggaagtttctctgtaaattgttatttcttcatctgtaaaatatcttgctagtcccgtggcaataccgcctgtctaccccaagtaccctttctcctggactgcttgtatccacttccctgttactgctgtgttttctgcccagggctgaggctgtgcagtgaatgaatcatctttccccaaccttgcttgacatcagtatcaattttagaaggtgagagtgccacattttcttaatccagtctatcattgatggacatttgggttggttccaactggattaagaaaatgtggcacatatacaccatggaatactatgcagccataaaaaaggatgagttcacgtcctttgtagggacatggaggcagctggaaaccatcattctcagcaaactattgcagggacagaaaaccaaacactgcatgttctcactcataggtgggaattgaacaatgagaacacttggacacaggaaggggaacatcacacactggggcctgtcaagtggggagggatagcattaggagatatacctaatgtaaatgacaagttaatgggtgcagcacaccaacatggcacatgtatacatatgtaacaaacctgcacgttgtgcacatgtaccctagaacttaaagtataagaaaaataaataaatacataaaattcttttcaataacaatggaaacaaaattttctaaaattatgagatcatatctgtaaaaattaatgatgatcttgtgtaaaatttcatctatacatagtgaattatactattaatattgatgaaaaaatgtaaacataaatctagtgtcttataagcatgaaaaatgtccaagtattttcaatgttgtgtttcttttgtcttaacaaacatgtcctacagtgttatttgactatgtgtgaattttattttttcaagactgtgttaatataatcctcaaactattttagaagcaactaaatagtgaataaagtgaagagtagaaatgtaatcagaaaaaaaaaagaaggtaagagtgctcacaattgcctcaaaaagaaaatgaggcttcttgaatttgcacttcagcattctctactcagtgcacctgtttgtgtaatttgctcttttcttgttatcatgatgcatgactgtattagtcagctcaggatgccacaacaaaatactgtagaccaggtggcttaaacaacaggaatttatttctcacagttctagaggctgggaagtccgagatcaaggtgttggtagatttggtgtctgccaaaggccaacgttctggttcatggatggtgccttcttctcactgtgtcctcaaatggtagaaggggcaaggggtcaatccagggcttctttcattaaggcactaatcactttcatgaggctctgccctcatgccctaagcacctcctaaaggccccacctcctaataccatcaccgtgggggttaggatttcagtctgtgaattttgaggggacacaaacattcagaccatagcagaccctcttcctaatctgcaggtggttgtcttcctgctgtgtcttcatgtggcagagagagcaaactctgggctctttcttttcttttcttttcttttcttttcttttctttttttttttttttgagatcgagtctcgctctgttgcccaggctagagtgcagtggcgtggtcttggctcactgcaacctctgcctcctgggttcaagcaattctcctgcctcaacctcctgagtagctgggattacaggtgcacaacaccacacctggctaattttttgtatttttagtagagacggggcttcaccatgttggccaggctggtctcgaactcctgacctcgtgatccgcccacctcagcctcccaaagtgctgggattacaggcgtgagccaccacgcctagccctgggctctttcttttcttataagaaccctaatctcatcatgggattagtgtccttataagaccctcatgacctcatctaaatctaattacctcccaaatacattcaaataccatcatattggaggttaggtctttaacatatgaatttgtcaggggacacagttcagtccataacatgcctttgtttccatgtcaccaacacactctatcttcttggccttaatccatttcttctggatggaatgtcttcccaagctacttggatttttcttcttcaaagctactcagaagtgccatcctttatgaagctttcttggacaaatactttctttagttttccatccctagcacttgtacacaacaaaaatagctggagcatttgtatatatttatcatgttttggctaatacccacttgtgtgagctccttgttgcttattagattttaaacactgtatgcaaggatctgctcctcctttccttgtgactctcccaaatctcactgcaagctgttcaccacgtggttataaatgaaatgtttttgaccaacagattgctcatttggtctcagccttggtcagattccaaggaaaacaaattaaaataatactcccttcttctttcgcagaaagacaaatttaaatgatatggttatatataatcattgtgataacatgattacatgattatatcattatctagaaatcatataggttaagtattgaaaggtgcagttatggagagatttgtccacaggctacagtagaactagttaggcttgtgctgttacacacgaaggtatcagtgggtgtcgggagaattcatgttgactcattcggggcacatgtaaatctgggccctgatgaagtacttgttcatgttccacttccatattttaggtattttaaattttgtagtgcagcttttcccagttgtgtcctttgctggtctggagatggcagtaatcatgaacaaatccacaaccctttggttcagtatccatcatctgaattcctggggttcccagtcctaaattgttgctttgagtttagaggggattgtaggtcatgccctctttgctcttccctcatcccctcatttgattaggtttctgctcaggcgatccttgtcttgtgattgcccttgtagaagggagcaggtgtcaacctctgacctaaaatttagttgtgatattgaggctgagggtgccacctgtgcactaagaaggtataaaaagatctgttactcacaaatcgaagctctctgaggagagctgggcaggctctcaggcaggttagaaaatggcttgagagcctcaagggcaactggctttggcttttttttttttttttttttttttgagacggagtctcactctgtcgcccgggctggagtgcagtggcaacaatctcgactcactgcaacctccgcctcccgggttcaagcgattctcctgcctcagcctcctgagtagctggaattataggcgtgcgccaccaagcccaggtaatttttgtatttttagtagagactgggtttcaccgtgtgggtcaggctggtctcgatctcctgacctcgtgatccgcccgcctcggctttggcttttatggtggtcagtggtttgggctggggccaaagcttgtgtggtttgagcttcccactggagccaaagaggtagcacatggctttcctgtcacttcccttggtgtgagtcaggaggggaggtggcaggggaggagcttgaaaactcagggaggctttcctgaccataacttgtgaatacctgattttatatttaaaatctatctaattacagtttcttctgctagattgtaagctctttgatttgttcagcatccaatttccacagctgagaactccccaggcagtcagaggctctcagtagatatttgctgaaacaatacaaaggagatgaaggagtggccagaaaaatgggaggaggtgcctgaaagccaacagaagaaatgattctaagaaaggaggaatgtggctgggagccctggctcacgcctgtaatctcaacactttgggaggctgaggtgggcggaccacctgaggccaggagtttgagaccagcctggccaacgtggaccctgtctctactaaaaatacgaaaattagccgggcatggtggcatgtgcctgtaatcccagctactgaggaggctggggtagaagaatcgcttgaacccaggaggtggaggttgcagtgagctgagattacaccactgcactccagcctgggtgacagagtgaaactccgtatcaaaaaaaaaaaaagaaagataattgtgtcaaatgctgtcaatgggtcaagttagatgagcccaagattccccaatggacttaacaatatggataccattggtgacctcagtaagaccagttttggtctggagtagtgagcagaaaagccttattggaatgggttcaagagagaatggaaagattgaagttagagtcagttaatatggacaattcttctaggtactatagcagtaaaagggagtggaggccgagtgcagtggctcatggctgtaatctcagcactttgggaggccgaggcaggcagatcacctgaggtcaggagttcgagcccggccaacatggagaaacctcatctctgctaaaagtacaaaaattagctgcgcgtggtggcatgcacctgtattcccagctattcagggggctgaggcatgagaatcgcttgagcccaggaggcagaggttgcagtgagcagagatggcaccactgcactccagcctgggtgacagagcgagaacctgtctcaaagaagaagaaaaaaaaaaaaagggactagagaagtggagcccagagagggtttttattaatatgatagcatgtttatatgttgacgctgatggaaacagtccagtggaaaggaagacgctgaagattcaggagggaaggaggaaaattgctggggccctgtcctggagtaagatccagtgctcgagtggaagggccggtctgtaagggatttggtcagtttgttcacaacaacgagaaaaggcagagtgtgtgaacccactgcaggtaagaggggagatgtggttcacttctggtagctcctaggaagctctgtggacattcatgccaagtgacttgtggtggcctcggccctgcgcctccagaggtgtcggctgcatcagcacctgcagggggcgccctgtgcacgtcctgtcctcacatcctctttactaaacacggagatagatggagcaaccctcccgctgcaaacacagctcttcacagctctgacgtttttctactatactgcaaacacatctgtaatcacatttaaaaataaatccacacaagaaaaattcactgtttcttgtataacaagtgtaactgtgacttctgagacaacgctgaacattttctgaaatcttgtcaaaaaccacacgggggcactattcctttaaaatacacagtacggtatgtccaattttgatgactgaaacagtggcatctttgaagttcaatttcctgaagtttattttccttttagaagagaggctgttgtgtcacaataacaaaatattttctgtacttcatagatgatttgagatattccaaactcctagattttttatttaatctggcccctgggcaatcattcttttagtgttacagccacttcctttgcatttaaggcacaatgcatatttgtcttatttctgctctttcttatgcttacaatagaggctgtgagctagcagcgagtccagtttgtgctcatatctggaataaggttgtctgaagtagacagttcgagagaaaatgtcgttgtctttcttggttctcattccaccgttccccagctctcgcctctgaagcttgagctattacactttttatgacaggaaagaaaaaattaagtcttttgaacaatttcctgttttcaggaaagctatcaaacttaatttacacatatgaaagaagaggtttcagaggtagtgtaggattaggagaatagaatttgctcactgtctagcaatagataagctagtatttgcaaataatttagccaaaatgacaaattagttgaaagttaatatcgggcctcagatttctggttttgcaaaatttatttattatttttatttttttgagacagagtctcactctgttgcccaggctggagtacagtggtgtgatcttggctcactgcaacccctgcctcccaggttcaagtgattctcctgcctcagcctcccgagtacctgggattacaggcacgtgccaccacgcctggctaatttttgtatttttagtagagatggagtgtcgccatgttggccaggctggtcttgaactcctgacctcaggtgatctgcccaccttggcttcccaaagtgctaggattacaggcgtgagccaccacgcctagccctggttttgcaatatttaaatgtgtgatgcccaccatattgttgcaaacaatggcaagtccctaagggtgtagcagccttccattgtgtaatgatttgcttgtggggaaatatacaatgatgctgtggatccctatcatagttggtatgctatgttagtaagcaactattggggcaagtatttcttactgctttgtttcacaattcaaagccaaagtaatacataatcttttagtgccattttttagggctatccaataagaaaattacattgttgtctatgcaaaggctttatggaagctacttaaatataaaagaaacagacaaacagaaatgatcaagagtagccattgtcagctaaataattacaaaatcagtctgcatatattcattttttaaccactttgtattttgctcaatttaccttgaactggtaaacaattagttctttttttgagacagctctgttgcccaggcacagaggtacagtggcacgcattcatagctcactgcaaccttaaactcctgggcttagtttgtccttccatctcagcctcctgagtagctaggactacaggcacgtgacaccatacctggctaatttttatttgtattttttgtagagacaggtctcattatattacccaggctggtcttgacctcctggcctcaagcaatcctcctccttcagcctcccaaagtgttgggcttgcaggcgtgagccactgtgcccagccaacactggttcttaaactaaacatgttagggtgctcctgatattttaagcactcctaccacaatccattcattgtgcttcttcatcttaaatgtaaattgtcaccatggtaaacagatatgtgcctccaggacacagttctaattgatctgtgcttttagagtttcttgttttgactttgtgataacataaatgttttcaattcgttgagttgtacgcctaagttgttgttttcacacattgcttcggtggaggaaagctatttaaaatgtaagtccagaaattcatattaaatgctattactggctgggtgtggtggctcacgcctgtaatcccagcactttggtaggctgaggcaggcggatcacctgagatgaggagttggagaccagcctggccaacatggtgataccctgtctctacttaaaatacaaaaattagctgggcgtggtggcaggcgcctgtaatcccagctacttgggaggctgaggcaggagaattgcttgaacccgggaggcagaggttgcagtgagctgagatcgcgccattgcattccagccggggggacaagagtgagactttgtctgaccaaaaaaaaaagcacctctcacttttacggtggcctttatccagagcgcattctctttgtccaaacttatttcagttttatttttcttgggcctccttgatatggtttggctctgtgtccccacccaaatctcatctcgaattgtaatccccataatccccacgtgttgagggcagggcctggtgggaggtgattggatcatgggggcagtatcccccatgctgttctcctgatagtgagttatcacgagatctgatggttttataaggggctcttaccctttcacttgtttgtgctcgctcatgctctctctcttcccccttcctttctctcaccccctcatggaccccctgcacctgtcaccatgtaagacatgcctcttccccttctaccatgattgtaagtttcctgaggttttcccagtcttgcagaactgtgagtcaatgacacctcttttctttataaattacccagtcttgggtatgtctttgtagcagtgtgaaaacagactaatatgttccttaacttttccaagtgtaaatattgtcaaacaacctcaaaacaaccctaaattcctttaccctgatcatctgggttttaatgattacagttttgagtcctgtacatgatcaagtaggagagttgtggcaacaacattgtaggtgatgggggtgctgtggatcccagtagaatattatgctttctatgattctttgctttatgttatttcattaaggaaaaatcataccaagagtctaagtgtaggaggtaaacatgcatattgcatggaggactgaaacaaatgtagagattgcaggtcattaaaataaagcccatgctttcgtatatgcaaatcaagcatattttaaaaatagagatctgtgacatgctggtatctctttgaaaggaatattgcacttcttgtccaacttaaaaccagggaattttagaaaaattgtagcaatagggattattcttgattactgctgatgtttttatattgtgtttgactaaattagttgctttttgcaaagcactctgaagcacttcgcttttatatcattggagacatggattgtgtcctttgtgaaatagttattggtttcacattccctccaccacttctccttgatggctacgggctgagtatgattcatctctgtccttcactcatggtataatgaatggtgaacagtaaacaaacagggcttatttgtaggagtgaaattaagggtagcagtttgagtggtgtatatttggttgaagatgatgcagaggtggttgaaggggagagatgcaagtaataggcaataagccgattgccaaagagaggaggagagaggttctttgtttccccaaggcttacttgatgagctcatgtgcagtcactacaactgtgaaggaacttatctgtaaatgtgctttttaatacaactttggatgctggatcaaaatgacatgtttaaagattagacgcttatacttcttgaatgtatatagccttgactttaaatacctattctagtagagaaaatcttttcaagaagaagataaaacgtaaaaagccaatgttcagcaagataaaagaataagctgtatcctttcttaagagttagatgtgagagttgaattaagaaagaaaaaaagaaacatcaaattacttttagcttttcagttttcttcctttcatgtttaagattcagtgtctagttccttgtgagttgtctccaattctgtgaagtctaaatctaatggtatttttatccttgataaagcatcattgatttacatacgtatgagaaggggaaaaagagacattgttttattatttagaatgaatgtcaaatatttatgcaagttttgacagtattttcaaaagcaaaatattttcatatgaagagatttttcaccatgttttcaccaatagtctactgaaattttgaggcaaatcaaatgttaagagattatgggttgatgcaatgaatatgcctgtttttattgagtcaaactttggctgccagaagggtaacattactccttatttgaagttttaaccctttgagtatctgacctataatttttttaaatttgaaatcattctaaaatggattatgtgtttttctgcttgcttaaatataaggtagagaatatagtttgaaaaaaaattgttttaatgtttcagagttatgtatttatttattttgagatggagtcttgctgtgtcaccaggctggagcgcagtgatgcaatctctgctcactgcaacctccgcctcccgggttcaagcgattcccctgcctcggcctccagaatagctgggactacaggcgctcgccaccacacctggtgtggtgtattttagtagaaacggggtttcaccacgttggccaggatggtctcaatctcctgacctcgtgatccacccgcctcagcctcccaaagtgctgggattacaggtgtgaaccaccgcacccagctagagttatttttttcttcagtctctgtgctagtagtttccgagttattttaagcgttgattttggggataagccttgaatgcaggtggaggatattaaatatttacatttatgtaaagcacaatttaggtgcccgaggttaggtttttgcctgcttccagcagtgtttcagacaagggaatgccttgtgctttcctttccccggcttcctcctctgggtgtgctctcaattctaaccccgttaccagcattgccacctgttaattatcactgttggttatgctcttcaacttcagtctttccctgtcctctgagaacttctcctttggcttcatggcaccaaagtacatcccattctgaaatcaaaagaatagtaaacacaaaaacctactaactccccacaatttccttctcaaattactgctggatctttcttttctttctttatcatcagacatcacaaaagagcaatcttctacccatttcctttatttcctcacgtccaattcacttctcagacaggagcacctggcttcttgccccctcaccctatactgaaatgctctctgaagcatcatcacaacttcattgccaaattggaagcctttagagaatggcacttatccagttctcacccaggagccattaatgggagaaatcctggaagaataggggaagaatgccacccaccatcttgatcccatcaaaacccaaatggacatagaaatgcctgacagcctctttcaattaaactgtcatggccccagcatctcaaatcgatgctgttgggtacttcttagtctgcaaaggctctcctttccctaaagggtagagcccacaataaacaggactggaccaggatctctaggttccagagacattgatttgggaatgtacacataggctgcagggtgaaaatcctggaagtggaggcatagaaacacagtggtttttccttgagtttttaagagcttcatctgcttctgggccttctttgccctctcactctcattctgactgcctctcaatctaaagattcctcttcctcttttggcaaccataggtacagctgacttgcccatatacccactgcacagtcctcctgcctgtctcagttgtgtgagttgtttgacatttccagaataattaataaaagaaagagaaaactaatttcattgaggagcacctctgtccctgagcctttgtataaatgtatatacacaattatgtgtatgcacacacacatttggtggtcatcttaactctgttcagtccacttgccatttaacctcttttaacctttatttccattttttggggagatatcatctttcttgttatcagaaaacacttttattcacttattttttccgttagtctttccagtcatccacctgttcatgtatccacttatccatccatccaccatccacccactcattcatccatctgcccacccacccatccacccatcattcaccaattaaacatgtactgagtagctatgatgtgccattactgccagatatagggagctcaaaatctgagaataatttcccttcattttgctatctcatctatcatacactcatatacatctaactttttgaattagtgctaactgaccatcaaacgtagaagtgagattgaaaagatgcttatatataagatcatattcctgaggcatagaggtaatcagaaatgatctgaaataacttctatcatccaattttactgaaggaaaagaagtgtggttgaaaattactatctgggtaactgtcctgaaaggcctgtgcacaagtcaaaaatactctcaggtgcaagcactaatgcaatactggtctttattcaacatgaaagcctggccactgtgccattgtgaatgcaacctacattttccaagcagcagaggacaaaacacactgtggtgtgtgaattcccctctcctggcccccagataccaatcactaaccaaacctttcccccttgacttcacccacccccatcaataaatttcttagcagctctcttgcctaagagagaatgacctcatactagcttttcagcactccagtttttgtagtatcaattatttaaatggaaagtttcctcaaatatttgatacctttgtctgtgtgtgtgtgtgtgtgtgtgtgtgtgtgttttgagacagggtcttactatgttgcccagggtggagtgcagtggtgcaattatgggtcactgcagcctggctctcccgggctcaaagtgattctcctatctcagcctccaaagtagctaggactacaggtgcttgccacacgctcagataatttttgtattttctgtagcaatggggtttcactatgttgcagggctggtctcgaactcttgggctcaagtaactctcctgcctcagcttcccaaagtgctgggactgcaggcatgaaccactgtgcttgacctttttatttgtcttttgaaaatagtctgcaaaatctaataaatatttgactaccccttctttttgtttttggatggtgcaacatcaggaatattattattattatttttaccacgttatgagaaatagtcctttttttcaggtgtgtagagggctcagggtctcaaccctgatgctcccaggtcttagtgcttctttgaatgttggtatttttaaactttcttctcttgcctcctccctcccttttctacctgctttctttcattgctggctgtgtttctgcctgaggtccctaattcctccagcccatttcatcttttatttattttcgcttctaatcttctgtgattttgaaaactaaatagcttcttagaattgtgtgtaaaaaaggccgggcatggtggctcacacttgtaatcccagcactttgggaggctgaagcgggtggatcacctgaggtcaggagttcaagaccagcctggccaacatggtgaaaccccgtctctactaaaattacaaaaattagctgggcatggtggtgagcacctgtaatcccggctactctggaggctgaggcaggagaatcgcttgaacccaggaggcagaggttgcagtgagccaagaccatgccattgcactccagcctgggcaaaagagcgaaattccataaaaaaaaaagaaaagaattgtgtgtaaaattaaaagaaacagtctttgatcaaaggtctgaggaaattctaaggaatacagtatatgagagctttattgttttaggacttttattttctgcttttctctttttttttttgttgttgagacggagtctcactctgtcactcaggctggagtgcagtggcatgatctcggctcactgcaacctctgcctcctgggttcaagtgattcacctgcctcagcctcccaagtagctgggactacaggcacccgccaccatgcccggctgattttttgtatttttagtagagatggggtttcaccgtcttagccaggatggtctcgatctcctgacctcgggatccgcccgcctcagcctcccaaagtgctgggattacaggcgtgagccaccgcgcccggcccatctcatttttttaaggcttccttctgtttctcaggttttctctggatcagtgaagttgatttatctatctgcaatgactcattagctgagtttgaataaattgttatttttcaaatgtggtctgcagaactacttgtgtcagaaccactaggggtgctgttaaaatgcaggtgcacaggtcccttctcagatacgttgaatcagaatatctggatggaagacccaggaatatacattttcattaaacagccttagttatatgtatgccctagagcttgataactattggagtgggtgctgtgcctgtgttcttaatctgggctaagcttgtctcatgtttgtagttgtaaattaagatgaaatgcctggagaaggaagcctagtggttaaaagtgcaaactctaaagagcaacacctgggttaaacttgcagttctacctttaacaactaaatgatattgggcaatctgtgaaaactctctttgcctcatttcccctgtgtataaaaggaagatgataataaagcctgattcatagggctgttgcattaatatagaaaaataatttaaaacagtaagcacacagaatggcagctattattactatgaatattatatttttgtatagtggctgtaccatatattttgtggcttatccgaagcacagttattgtggctctacataaagatatcctcctagccacatttgtgcctgagcgtgcaaacgtagacatgcatgcctggaacggtgagtgatgtatcgtgacctggcttcagataacatgactgtgggtcatggtcatgtcaacattgctcctatctcttggaaagcaaaatgtctaaattcaaaggaatatcactgtcatgagccttaattttttttaatagattggtttagcctcaaacgatgagactcatcaaaggattcaaaccagagtagtggctttgttttaagttgagacagtgagacagggttcttctgtgtgcatcaaattatacagtaattttgatggaatcccatacagaagtctactggtttctatggcaacctgaattcaaaataggatgttagaagcctcttcagagtagaaaaagcaagtttcattctttctgtagttatggaacatatagtttgtacaaagtattttctaaatggaacttttgtctttttactttcttgccattaataattttaacaattttgtagtactgcattcctacattctttctgtatctctgaatgagaatctcaagccaccctaaagtgcttgttttgctatgaatagctgatgtttcactttgtcgtttatagcagatgcactatatagtttttacttttctaatactatagcaattggtaataggagagaaaacctgttacagaattcctaggttagcaagtcagcctatttttagtggcaactacaaaaaaaagcttttgcgtaaatacctaatttttgtaaacgatgtatttttagcacatatctgtctggaagtattttaaaattggatctcgtaatcctgaagacaaagtctgttgcagatattgactaactgggtgggcagttccaagtataaaggctatgttgggctgtggtaacaaacacagtggaaagtctcagtggcttatgacaaccagagtttatttctcatttgttgcttctgcccgtgcaggtttactgtagttgctctctctgtcatcttcgctctgggacctgggctgacagaacagcccctatctggaacactgcccggcaaagggagaagagtgcaatgaagcaactactgactcttaaatcttccatccagaagtaacgtacatttttgctcacaattcattttccaaagcaaatcccatgtcttgcctgaatccattggttaggtaaatagaatccctctgcaaggcagtgtgtccccagttgtgctaagaagatgtgccatagggggacactagaacttacagatgatatatttttagttaaaaaaaattgttttggctgggcatggtggctcacgcctgtaatcccagcactttgggaagctgaggtgggtggatcatgaggtcaggagttcgagaccagcctggccaacatagtgaaaccccgtctctactaaaaatccaaaaattagctgggcatggtggcgggtgcctgtaatcccagctactcaggaggctgaggcaggagaatcacttgaaccctggaggcggaggttgcggtgagccgagatcgtgccactgcactccagcctgggcaacagagcgagactccatctcaaaaaaaaaaaattgttttagaggtgctggttgaggggagtaatggtggaatcacagaattttagagctggaggaaatggttcatgaaggttttggggcttacattcttttctttctagaattaggaagcttggtttcatggttttgacaaacgagcactttgtacaagagagcacattcagccttggtttacagcgccttgccttccatttgtttttgtccttttgattaacattcctttggataattaaattaagttaaacatttaaatttctaatagtggaacacagtgactgcataaatgttttcataattggttctctgaggcacaaaacttacaagaaatgaaaatggccaacaagacttttttttaagacagtttttccatattaatttaaaattatgattttttttttttttgagacagagttgcgctctgtcacccaggctggagtgcagtggtgcaatctcagctcactgcaacctccacttcctgggttcaagcgattctcctgcctcaccctcctgagtacctgggattataggtgcctgccaccacacccagctaatttttgtatttttagtagagatggggtttcaccatgttggccaggctggtctcgaactcctggcctcaagtgatgtgcccacctcagcctcccaaagtgctaggattacaggtgagagccaccatgtccagccaaaaattatgattctttagattctacgcaaattatctgtaagaagaaagctttagaaagaggcctgtactggaccaagaatgactcttttgtttttgtttttgagatggagtctcactttgtcacccaggctggagcgcagtggtgtgatcttggctcactacaatctctgtcccctgggtttgagtgattctcctgtctcagcctctggagtagctgggattacaggtgtccgtcaccatgcccagctgatttttgtaattttagtagagatggggtttcaccatgttggccaggctggtttcaaactcctgagctcaagtaagtgatcctcctgcctcggtctcccaaagtgctgggattgcaggcatgagccaccacatcaggctaagaaggactcttttggaccatggagtgttgctcactacatcccatcatgtaacagggtagtgtcattgttttcccagccagctaggaaaggtgtgacttgcttaaccagtgaactgacctgcagaacagatggaactgctaagtgaaagagccgtgttggctctggagacctagaagcatttcatccatatggagcaaagctgggaagtctgtaaaaggtatgctgggaagattacattcttccgaaggaaggcactatcccatcccataatgagtagtagcagagtgagcctccttaccagagttaccagggctttgcgattataacacaacagctctcacattcttgctgattccttggtaatggttgcatgaagaggttcaaagaggacctctctatatcctgggggaagggtcctttgcacggggcatgcttttgtgcaggatctcgtgctcaatttggccccctgcgtatcccctctgcagagcctctctgctatgtgaaccccaggattccatcatgggactcacaaggacacaggctaatgggctccagcaggtctaaaggcacctctcctgccctccctccgagcaacctagtactctctgtcatgggcatttctgtgtacctgctgcttgatgacattccctattcataatgatatccttgaagtgctgacaaagacttctgtatgtttggtgtgaattagacatgtttataatttgctgtcttgaaattgtgtaatcctcatatggcctgtgtatattctgtccaaatgagttatgtgataaaactctgtacagtcatgtaccacttagtgatggggagacgttctgaaaaacacatcattataggtgatttggtcattgtgtgaacatcacaaaatgcacttacacaaacctagatggtgtagcctaccacacacttaggctatgtggtatagcctgttgctcctagctacaaacctgtgcagcatgtgagctactggatattgtagccaattgtaacacaatagtaagtgtttgtatatttaaatgtatctacacatagaaaaggtacagtaaaagtatggtgtaagagattaaaatggtatacttgtctagggcacttattgcaaatggagcttgcaggattggaagttgctctgggtgagtcagtgagtgagtcctgagtgaacgtgaatgccagggacattactgtccactactgtagactttatccctgtacaattaggctacactacatttttaagaattttttcttcaataataaatcaaccttagcttagtataacttttttactttataaactttaacttctttttaaccttttgactgttttggaataacacttagcttaaaacacaaacacattatacttctgtgtaaatatattttctatttatccttatatgaacttttttcttttactttttacacttttttttttttttgagatggagtgtcgctctgtcttccaggctgcagcacagtgacacgatcttggctcactgcaacctccgcctcccgggttcaagcaattctccagcctcagcctcctgagtagctgggaatacaggtgcccgccgccacgcctggctaatttttgtatttttagtagaggctgcgtttcaccatgttggtcaggctggtctggaactcctgacttcaggcgctccacctgcctcggcctcccaaagtgctgggattacaggtgtgagccaccacgccttttaattaaaaactaacacataagcatgcacattagcctaggtctccacagagtgaggctcatcagtctcgctgtcttccatctccacatcttttcgcactggaaggatctcaggggcagtaacccacctggagctgtcatctgctatgacaatgatgccttcttctgggatacctccagaaggacctgcctgaggctgttttacagttaacttttttttttttttaataaatagaaggagtatactctaaaataaaaataaaaagcctagtttagtaaatatataaaccagaaacacagttgtttattgtcaatatgatgtactgtacataactatctgtgctatacttttatatgactgacagcacagtaggtttgtttacactagcatcgtcacaaaaacctgagtaatgcctcatgctatgaagttaggacagctacagagtcactaggtgataggaattcttcagccccattacagtcttatgggaccactgtcatatatttggtccatggttgaccaaaatgttgaaacatcattatgtggcgcatgactgtattaggatgttctgtccactgaacctgccctggagtcaccccaaaagtggcagcaggggaattcctgcaagggactgtctcagaccagaaatgggaccgtttgggattccaaagaaagaagcatcaaacaccagggtgatcagtcaaaaacatttattagggggaacttagggagctttagcatctttgtgacagacagtgagaaaagagatattctacccaggtatgttgctactgggacggcagggttctatgagggttcaaagaatttggctcagggtcaggggtaatttctgtgtttagcaacatagttgatttctccgtgcttcaagcaataacctcaacaactttatcagtgcctgggaatgttcaagaccccagcttgggttcgagcccagagtggaaaacatgcaggtgtccaggtcacagagtgatcaaggcaccgtgtttcttggtcaggacctcaaaggaagaaggtggagggacctgggggttactggagggttctataccagataactgagcctggagtttcagttagaagggagctgaaagtttttcttgaattctagatgacttcatctcaatgataggtgggctctcacctgtacagatgcagaccttgctacctcatgagacagtgactcttctggaataattgttctgtgttcttcattgtattgaacctacctctgtctccctctagttttgattttcttcgaccctatttctgttttctttgatcacccaagggtgtctgttcctttttctaccttgggagctcttaaatatgaggggagcagtcatatctccttgtaacatctcatctctgggccacgttttctccctcaccatctcttacaggaaacgttttagttttgcctccctgctggttgctgtccttgaggtgtgttcccacagatccccagcctccaccctatacagtgctgggctgggaacagatgcaggaccccagtgccaaacgccgccgggccatcattgaccctggttgggcagggtggccctcatggaaggggcccaggctttgccctcagatgcacctgggctcaagatccagctctgccacttgctagcagagtgacccatgcaccgtttatctgttcttcgaatctcaagtttattcatcttgtagagagggaacaataattcctccacttaaggggtgctatacacaataaggcaatgacatgtgtgaagtctctaatatcagtgtatggcaaataatcttttctcagtaaatatttgccttcccattgccctagtcattatatttttattagttcagtataatattatgtcagctttgtggttagccatatctcccctgtgccacaccgaacttgtaatgatctcaagtcccaaagccttccacgttaaacccgtctcttctatcctgccagtgtagcaagtattccatggagataataacacgcttgccatgtctagaacatagtacaaagaagaaatgctagctgtaaaactttattatgactacctgttttagtgcagattgattttaatggtgcttacttccctaacatctacattttgatatcaacaaagtgtgtcatattcaacgaagaagcttattggagaaatttagagagaaagaagtcacccctgttagaatgagcttagttaaaggttagcgcaacatctggaggaaggtagtggcctcccaataaaacttagctccctatggtccttgactttggttgtgactcagtattaatgttttcttttaagaacagatataacttaaatgttaatctcaagaaagtacatttcaacacagggaaggcagagaagagagtgctggaagatttctcactgttgctgtgtccccagccccagtttcttgacgcctttttagcaggtggctccctcctctagggaaaaaggtgaggagccagttagaaagcagaggcctgtccccgcagagggaggccaaactgacctcagattcagagacagccagctgtggaccgtctttcctcagagctacaaatgtgtcattttgattccatagggtcctggaggcacccgtgcattgcactgcaggaaattaatggcacaaaggttacttcctgcacgtttgctgctgagggtcatcttgatacctgcctcttctctgtctccccttctttaataaactttgtgtttcagagttgttttagatatacaaccaactgtgacagtggtacagagagttcctctataccctgcaccgagtttcccccgttagtaacatcttaccttactatggtacatttgtcaccatcggtaaactgatattgatatgttcttatgaaataagtccattctttgttcagatttccctaccttttacctaatgaccttttttctgtcccatgatttcatccaggataccacatgacagtctcacccaggataccacatgacattttgtcattatgtctccttaggctcctcttgactgtgacagtttttctgtgccctatttttcaatctgnnnnnnnnnnnnnnnnnnnnttttttttgagacagggtctcactgtttcccaggctagagtgcaggggcacaaacacagctaactgcagccttgaactcctgggctcaagcgatcctcccacctcagcctcccaaagtgctgggattaaaggtgtgagccaccatgcctggtcctttttcacatttttgataaaggcctgatggtggtggttaaaagcgctgttcattttcttcattaatcctccagtcagcaaacatttgcagagtacttaccagatgaggtcactgaacttaatgacagaaccaagggaagttgcctttccccgtgctagtgctgcccagcgcttcactggagatcttgttaaaatgcagattcttgttcagtagttccagggcagggcctgagattttgcattcccaacaagctccccgctgcacccaggctgcaagagatcatgcttggaggatcaagaccctagacttgggccagactccatattaagtggcagtgagagcaagggggccaggtgggagatgagagaagagttagataaattatatatcacagtttctgccttcaggaagttcgtggttctatcagaaaaataaagaagactggctgggcatggtggctcatgcttgtaatcccggcactttgggaggccaaggtgggtgaatcacttgaggccaggagttcgagaccagcctggccaacatatttagtagagacagtgaaaccctgtctctactaaaaatacaaaaattagctgagcgtggtggtgcatgactgtaattttagctacttgggaggctgaggcaagagaatcacttgaacccgggaggcggaggttgcactgagctgagattgcaccactgcactccagcctgggcgacagagtgagacttcatctcaagaaaaagaaagaagactgaacaaagcaagggagtaaaagtaaattgcaaaatggagatgaagacaatagacagtagacagttcacaccactgtgatggcttaaaaaaaaaaagaacaagtgttagaaaggatgtggagaaatgggaactcttatgcattgcttgtggaaatgtaaaatggtgcagccactgtggaaaagagtacaggagttcctcagaaaattatgtagaattggcagggcatggtggctggcacctaatcccagcactttgggaggctgaggcgggcagatcacttgaggccaggagttcaagaccagcctggccaacatggtgaaaccctgtctctactaaaaatacaaaaattagctgggcatggtggcaggtgcctgtaatcctagctgctcaggagactgaagcaggagaaccacttgaacccgggaggtggaggttgcagtaagccaagatggtgccactgcactccagcctgggtgacagagcgagactccgtctcaaaaaaaaaaaaaaattacgtagaattaccatatgatccagcaattccacttctgaatatatgcccataaggactgaaagcaggaatttgaacagatatctgtacaactgtgttcacagcagcattcttcacaatagccaaaatgtggaagtaacccaagtgtccatccacagacggatggctaaagaaaatgtaggatacacatacaacagaatactatccagccttgaaaatgagggaaaagtttgactcgtgctgcaacataggtgaaccttgaagacattacgctaagtgaaataagccaggccccaaaggaagaatgttttatggttccacttatatgaaatatctagagtagtcaacttcagagacacaaattctaatagtggttgccagggtttgggggaggacagaatggagagttagtgttaaatgggtacagagtttctttttgaaaagttgaaatggaagatggaaaagttctagagatggatagtgatgatggttgcacatcaatttgaatgtagttaatatcactgaactgcacacttacggatggttaaaatgctacattttgttatgcatattttcccatgatttgaaaaatggttaaaaaaaaggcacatacacaaaaatacaataggtggtagagttgtcagcggagagggataaaatggtaacagtaaggccttattgacagaccaggtgtgacttgccggcacaaagtacttattaactcatctaacttattgctcatctccagcaaccctctgaaacaggtacttattagccctgctttatagatgacacaactgagaaagggaagattacttaaggctctactagtcaatgggaagtttctaaggtagccgtgtaattgaaggtggaccttggaggagaggcaggattggggtggaaagaggataggaggtattctagatagataggagctggctaaggaaagatccagaaactggtgggaacttaaatattcagctgccatgacgatggttggtatgtagggttcgtatgaatgaaacgtgactaccagggcagataatgaaaggctttcaatcccagagtaagagatatagggccaggcgtggtgtctcatgcctgtaatcccagcactttgggaggccaaggcaggtggatcacttgaggtcaggagtttgaaacccgcctggccaccatgtcaaaaccctactaaaaagtacaaaaattagccagatgtggtggctcacacctgtagtcccagctacttgggaggctgaggcatgaatcgcttgaacccaggaggcggaggtttcagtgagccgagactgcatcactgcactccagcctggacaacagagtgagactccatctcaaagaaaaaaaaaaaaaaaagaaagaaaagaaaaaagagagatatggaacgggggcatcaaactcaaactcaagtgttttcagaggccagcaggtaacaaatgtgagacaagtggcttagtccaggtgacagggagtagtatggactgtggcaagctgaatagagcacatcccacctgagacattcagatctcaaacataaatcctgggcaatgtgggccactgatgggcttggatgacattgaacttctgatggtgaggttgctgtgccctttgaaggcatgcagagtggtgtcgagggcatatgcaagaccacatggtatatgaggcatatcttcctggctgtgtcaatagcactagaagattatgggtaaaaattgatgcactttcactaagtacttaaaaaatgatttttatggtatgacaaagacaggtggagtagaatactaatgatagcgaacattgttgaatgctgactatgtgccaggcaccgttctgagcattttgcatatattatctccttcagtcctccaaatagcccatgtacttggttccattgttatccctatttacaaataaggaaatggaggtgcagaaaggggaagtaacttgcccgaaatggttgtgacagaaatctgggacacagtggtggttgcacttgcacttagaattaactctgagtttcctgaaagctgtttctcatttattttgtcatggcactgtagtccaagagtaatttaagaaatgtttccatttttattgtagatttagaaatacatgtgcaggtttgttccaaggacgaggttgtgtggtgctgaggtttgtgtttctatggatcccttcacccagatcatgaacatagtacccaataggaagtttttccgcccccctcactccctccttttgaagtctccattgtctcttgttcccatctttatgtctgtgtgaccccaaattttagctctcacttataagtgagaacattcagttcttgattttccatttctgcattagttctcttaggatgacagcctcctgctgcatccacattgctgcaaagaacctgattttgttctttttatgactgcctagtattccctgatgtatatgtcccacgttttctttgtctgatccaccactgatgggcatgtaggttgagtccatgtctttgctactgtgaatagtactgcgatgaacatacacatgcatgtgtctttatggcagaaagattcattctcctttgagtagatacccagtaatggaactgctgggttgaatggtagttctatttttagttctttgcaaaatttccaaagtgctttccacaggggctgaactaatttgcattcccaccaacagtttataagcatttcttttttgccacgacctcaccagcatctgttattttttgactttttaataatagcaattctgactggtgtgagatggtgtctcattgtggttttgatttgcatccaagagtaatttaaatagggaccactagatgtcactacccagtgctccttaagaaagagaaacagacaagaaacgccgctgtggctctgccttgaagaaacagaaaaactgcttaaccactgatatttatggtcttcctattgaagaatgctgatgtgacctggttgccacagtgcctctgactcctcccctatccccattgtccagcccagctaagtggtgctgcgggagccctattctgctggtagattttgtaatttcaggaaaactagaagggactctgtcatttcataagtcaactccttcctgcatcagctgcccactccactgaaggcaggaggggcaggattgactgaaggaggttttggttgttagcatgtgtgtgtgtgtgtgtgtgtgtgtgtgtatgtatgtatgtaaagtaggggggacacgggggttgtttccagttttgaataactcaggacctgctcttgcacattggtctagtgctttcaactaagaccttccttaacatggggcttgcacagggcagaagtgtgaccaatatatgctaaattaagttgcacagaagggcaggaatggggcttctgcacagaacatcgaaaaggagaggaggatcttggaagggactaggtagtgcctgaacctctcagggcagtgggtaggtagaggagagtttgccaggggttcattcagagggaaataaaggaaggtgtatggtgccctcctcacaggtacccgacttacttattcaggatatagctatggaatgtacatgttcttcaggtacctacaaagatttgtcaaagttgagcaaatcaaccaggcacggtggctcatgcctatagtcccagcgcttttggagactgaggcaggaggatcacttgagcccaggagttcaagaccagcctgggtaacaacgagatcctgtcaccagacatggtggcatgtgcctgtggtccgagtacttgggaggcagaggtgagaggattgcttgaccccagaagtttaaggctgcagtgagccttaatggcaccattgcactccagcctgggtgacagagaccatgtttgtttggtttttttttaaagtaaggtttttttttttattaatttctctttaaaatattccttttcctccatcccagcatcctcaactaacttaaaaatcttccttctttactgtaaatatttcaagaattctgtatatctaaatatagtcaatacaatgatgaattacatttttatccagttaccttgaggctggaaaacgaagagaggtttctctagaacactgtgaaaggtaacccataccaaaatagagcagagaagggggaggagggaactgccgcagaaaaaccttaaagctttcactgaaatgtgtctcctttcttttggagaggaggtcaaaatataataagcgcatcaagagctgttttgaaaaatggggctgtgtaagttatgagaacagctgtagagattttttttttttttttagatggaatcttggtctgtcgcccaggctggagtgcagtggcacaatcttggctcactgcaacctccacctccctggttgaagcaattcccctgcctcagcctcccaagtagctgggattataggtgcatgccaccaggcccggctaattttttttgtatttttaatagagacagggtttcaccatattggccagactggtcttgaactcctgacctcaggcaatctgcctgcctcagcctcccaaagtgctgggattacaggtgtgaggcaccatgcccggccgagatatgtttttaaaatctggataataaagcaaatggtatagatgaatgtctttaaattacaggaagaaaatggtatcaggcaaaactttatattttccatgggccctggagatggaaattcatttgcttgggagtggaaagcatgctttgcatgatgttcattgatggaatgtattttaaaaatgcagaacctaattggggctctcaaattttctacccttattaattcaaatggagactttctgctaaactcaaaaatgcaaatactaagttatttcaaataggaatcctgctaacactagtacctctttattgcatgtaaccacagatgcttccttttgagtccttggtcatcactaacaccacatagaatggtatcaagctcattttgatgctgctgtatctatttggtgtgaatgataatagccatactgcacatttgaatcacactatcacatgtggttacattgaattcttacagcaactctgtgtggtataaggtacacattgttaaatatatttgatagatgatagaaccaagtctcagagaggtgaattaacttgaccaaggcaacaattagttagttggataagttgcatatttgatctcagaagaattcttattaaaatgaatagattccaataacattttgctttggggaagtatctgcaaaatcttccactgcagctatttaggccatggtcgctgtataacctcgacagtatttgctgtatatatgaacagagaaagacccacacagatacatctttgatttatatcagctccacatgatttggtattaaaaaaattgtcttcctaaaaaaatcatattcccaattcattgaatcaagaagtgccatcacatgtgtgtgtatatgtatgtgtgtgtgtgtttcaagtaagaggacgaaagaggacagaggaacaaaaaaagcctcttctctttaaaaatgttgctgtactgcaagtcagccactgctgaaactctgagatggcttttgttttaaaatctcctgggacttgcagatcgtggaggtgcggcattgctgttcatatccatgatcatgcctgaagcacacacggaaaggttgtgagcagtccctcttgtaggggtgtgtggcatgtgaagactttggtgtgctgtggatcactccttggagaaatgctcgttgttagcacagttaggtttttgctggcagaatggcagaagccagctttctaaaatgactacctctcccgcacctccctgctatttttgcattggcatcctcctgatgaggatagctcttgctgaccatttacacttatttacattctattccacagcccataagagccagctttcctaagctccttccctgacatcccagactcatgtaaacatcatcctccggaagcacttgttacccgtaaaactcattctctttttttttttttttctttcgagacagagttttgctcttgttgcccaggctgaagtgcagtggcatgatctcagctcactgcaacctccgcctcccagattcaagcgattctcctgcctcagcctcctgagtagttgggattatagccatgtgccaccatgcccggctaattttgtattttttttttttttttttttttttttttttagtagagatggggtttcaccatgttggtcaggctggtctcgaactcctgacctcaggtgatccacctgtcttggcctcctaaagtgctgggattacaggcatgcgccaccgtgcctggccgactcgttctttaactgatggacgctaccctgccagatggtggttttattcaggtacatacacatttcatctccctgcctttagtgtgaatttccagagggcagggcctgagtctcaggccccattcttgctgccctctccttccaccaccccttggcactcagcctttggccaggcccagtttgttgagaggcaagaggcaggaggctgtggttaaggccatgtgctctgatcccgacctcctaggtttgaatcctgactgctacttactgaccgtgacctttggtagctcagcctcttaatctgtaaaatggaaatcctaatggtacctgcctcgtagggttgttgaaaagattcggtgagatttgatgtgaaaactgcttagcatggtgtctggtatgcagtaggcatgataaaagccatacctattgttatgcttcaggaagaatctgctggaggtgggaggctggaggcccatgaggaggcctctggggcggtgacggtggaagagccacatctgcgctggctcaagagcccgcgcacttttctgcacatcctccgcccaggccatgagcatcagtcctcgctgcagtcttgtcccagcccaagaggtcaggggcgtgtgagtgctgggaggggagagtaggtacagagtgctgtcactgggagggaggatttggtggctaattggatatacgaaaagtaaatggggagttaaggattcctttcaggtttccagtttggacaactgggttgacatggatgctgttaactgagaaaggaaccaagagttggaacaggtttagaggggctggtaatgaatttagttacagacgtcttgggtttgcaggatccgggatgcatctagatggagccatccagttgtaatgacaacagagaacatatatggaatatcatgttccagtgtctgttccaagcccttcacaggtttgaatccacttattctcacaacaaccttatgaaggaggtacaattcttattcccattttacagatgagaagactagatgcagggtgctttagttacttgtgtaaggccacactgctaacaagagatggtgcagagattgggacccaggtagtctggtcccagatagcccccacattttgctgctactctacacagaccctccatctcgtttctgggaggataggtctggacatgtaggtgtggtgaagccttggcagggaggacatagctcgaaagcccctgaagagtgaggtgggtggtggaggaaagaaactcaatttgctgatgcaaatgagcatcattgttgaaaattcaggatcaataaaaggtatgactgggaggaaaggtcaagtcggagtatgatattcttgttaatatctctaagtaaaggctataggattgatgacacaatgctttgatacaatacttatgtgtccatttcagtcaacaaagtttgctcagatggctttcaaattcctttgattaacactcttgtgaggtaagtaggtgggaagtgttattactgagggtacacaggaagaaatgaatttgggaatagaatcctagccagactctccccgccaagagttttatttaacaaagcacacactgatagaaggtgtagattgcaaagtactagttatgtcctggagttgggttagtaattttcaattaactttttgggtggcatagccttggtacctaaacaaaatgaaatggctgctaatgatttatttttactctacaagctgccttaattataccaagaagaggattaacacattggctctcggctctggctgtgcgtcagaatcacccaaggggctttaagaaactgcattcttaggccccacctctgcaaatttccattgggtaaattgggttagaggtaaaggagtggactggggctgttgttgtgcattttaaaaataggtgctcctttgtcaagatgctggaatgacataaatatttatttccttttcatcccagaatctcactgaaatgattcccccaaagggtataagaagaaaaaaaaaaaaaccataacagggcgggcagacagaataaggtaccatcaactggaaagaaattctgaggattgtcccgaaggtaccagcagatgggactggggactggattttaaaagatagagcaaaaaacccagagggggcggacatgaactgtccaaggggagcaccgttctgggctggagctgggaagaagcaccacctgcgccatctagtggaggtcatgagtaggccatggagtgagtgattgattgtctggataattaattaaaagacaccctgttcctactgattccttatgccaagcagctgacagccgcatttgttctcaggctaaagctgcaagaactgttctccaaataaaattcaggctcagccccggggtgtgagtccctacattggcaccaaggtgacagagaagcagaaggtacttttgcatcttcgtgagggtgaagctcaccaagctccaggggaaagcttttcacactttggtggagaggtgggtcaccctcttgctcactgctcagacatccattgggagacctggctgcccaccgatgtccctattctcatagactagggtagacagccctcgaacgcaggggagaggctcactgtgaaaatagattttctggggggtgtgctgaatacagcattccaatgatgcagatgtgggatgaccagcctattattggctgtatgcattgctggtcctgctagatggacttagtgcccccgtggaggggagacagaatactgagaggaaggataataagcaccgtggatttctgtacaggccttatcatttccacatctttcatctgagcctcataacaatcttgtgaggcaaatggcacttatgttttcattttaccaataagacagctgaggttctgagaagttaaggaagttcagggacttgatcaagttcattcaggtaacatgtagcagagtaaggaaccaaaactgggttttgctacctcagatgatattctctttctacttatcgcatattttccagtttacataatttacttaatttcaactttttttttttttttttggagatggagttgcccaggctggattgcagtggcaccatctccactcaccacaacctacgcctcctgagttcaagcgattctcttgtctgagcctactgagtagctgggactacaggtgtgcaacaccatgcccagctaatttttttgtatttttagtagagacaggggttcaccatgttggccaggctggtcttgaactcctgacctcaggcgatccccccaccttggcctcccaaagtgctgggattacagacatgagccaccatgcccagcctatttcaactttttgataaacattcatttctggaaggtagagtagacttcgggatctgtagataaatttgtgccagtgtaatagagtaatgaggctgaaaaacattgagaaatattctgaaatgatggctcccacgaaagtgaaaaagatagtatcatgtattaaaaagggattaatttaggaatttgactgtggttgggtttaggacatacttgtttcctgaggttgctgcaacaaagtactacaaagccggtggtgtaaaatagcacacatttattttctcacagttgtaggggtcagaagttggaaatcaaggtgtcagcagggttgccttccttggaaggctctgggggagaatttcgttccttgaccttccagcgtctggtggccgttagcattccgtgacttcttggctcatggttacatcactccaatctcagcattcatcttcatgtcaccttgtcctctgtgtcttctcccctttgtccccttcgtctctttttttttgagacagagtctcactctgtctcccaggctggagtgcagtggcgcgatctcagctcactgcaagctctgcctcctgggttcacgccattctcctgcctcagcctcctgagcagctgggactagaggcgcccgccaccacgcctgcctaattttttgtatttttagtagagacggggtttcaccgtgttggccaggatggtctcgatctcctgacctcgtgatccgcctgcctcagcctcccaaagtgctgggattacaggcgtgagccactgcgcctggccccctttgtctcttataaggacacttgccattggatttaggacccattcaagtaatccaggatgatctcattgcaacatccttaacttaaatttgcaaagaccctttttccaaatgaggtcacatttagaggttccagggatttgaatgcagatgtatcttttggtgtggggtcatcactcagctcactacagggtgtatttatttacttaactttttcatagtgaaatgaaaaaaccccttggcccttataccctgtgatgtatatttatacaaccattggaacacctcatccctagggactaggtttgtgttatttttttttcttaaacaccaacaggtaacagctgccagtttgaaagcaggtgcttctcttgagcctttcctgtgtctgtctgtgatgacatttctgtgactccatctctgcctccttttctttagtttcctgggcaagacactaggattttagaaactggtattcaaaagggaggaaatcaagtgacagaaaataagaaaaatattctgaggtttctgccttctttaatcatggaaaggaatggcaggtttactcagcccagattggaaagaaaggtaaaaaccttgggacaggaggggatattgggctatttatttttgagtcactcacattcttcagtttgaaaatggaaaaaactgaaagccagaaggattatgtaaggtcacttggcaagttgtgggctgacatagcattaagactaagagcttctgagttctctattcttttttttttttttttttaagagacagggtcttgctctgttgcccaggctggagtgcagcagcgtgatcacagctcactgcagccccgatgagttctctgttctgagcttctgaatcacagtgactcttgagggggtctcactctattaatctttggttgtctaagcagtatatgagggtcttgacactcacagccaaatgagcacacaggagaggttaagccttgactttgctgtgtttgatcttcattcaataaatgagtaaaagaaatgaatgctgtggttgtattcaacttgtttccaagctagccagtagtgagaagcctgtaagcaaatggatttttaaaatttcatactagtatctattacgggcaataccgttcttgaatccaagtgaattgtctgaaggattaccatgtctggtgctggtgtttgtagacttatataggaaaaataacaacaaacagaagccagcctttcttcttcataaggacttgctccgaccattcatctaaaagtagattttctctttgcagactttgaactgctttgaacttgtttgcaaggtcagccctccactagttcaggagaatgaaagctatttggagagctggagtaaatattgaagtaaaccagcccaaagagcagtttgccttgtctcaggagaagttgatagctttaccaggtactggtaggtagtttcccaacatagggcccaactgccaggcaatgttggtaggctctgcagacttctaaatgacagactttattttattttattttatttttgagacggagtctcgctttgtcacccaggctggggtgcagtggcgtgatctcggctcactgcaagctccaccttctgggttcacgccactctcctgcctcagcctcccgagtagctgggactacaggtgcccgccaccatgccaggctaattgtttttgcatttttagtagagacggggtttcactgtgttagccaggatggtacagactttaataaagcatgtctgttaagtgatattatgctttgaatcattttgtgtatgaacttacttccttatttttttggctaatgcctattaaatctaatgtattctgcttctttttgtgctaagcacatgactgaaaggctgtgagccataaatcttacactcaaaaaattcacatgatgttttctcattttaccttgtaatgactttggccttgtggtttattgttatggcctgggagtgtttttgaggtacatttttatttttgtcatataaagtacccaaaacgctcctggtgtgtgtctaagggatagccttgggcggggggagggggcagttactttggcatttatgcttgcaacctttttggcacttatatttgccaactgagtaggccagtaataatttggaatatgtcttgttgagcatatacttctgagagatgtaaaaaccaaagtttctgcaaatttatttaattccttgtttgatcagcatcaaactggacctcaagtttaaatttaatttctattttcacttgggaacaaaaattattgcaagaattgacaaggcagctagatatggtggctcacacttgtgatctcagtactttgggaggctgaggcagaaggatcacttgaggccaggagttcaagaccagcatgggcaagactctgtctctaaagaaaaaaagaaagaaagaaaagaaaaatgcatttgcaaggctaatagaaatcaggaggctaaaaggaaaacctggcctaaatgatgtatctcctagatgtaggtggggcaggcagtcatatttgcttaaggagcctatgaggcagcctgtagaaaagggacaggcgcctctaatcccagctccttgggaagctgaggcacgagaattgcttgaacccaggaggtggaggttgcagtgagccaagattgtaccactgcactccagcctgggcgacagagtgagactgtgcctcaaaaaaaaaaggggggacccttttggctgggaatggtggctcacgcctgtaatctcagcactttgggaggccaaggtgggcagatcacttgaggccaggagtttgagaccagcccggcaacatgctgaaaccccgtctctactaaaaatacaaaatgagctgggtgtggtggcacacgcctttaatcccagctacttgggaggctgaggcagaagaatcgctttgtaaagcatgatcatgccactgcactccagcctgggcgacagagtgagacagtgtctgaaaaaaaaagaaaagggaccctttttttctggattccagacaggaaaatttaatcctcggtggtgtttttttttaagaaacagagtctttctctcttacttaggctggagtgtagtgattccagcatagctcactgcagcctcaaactcctgggctaaagcaattctcctacctcagcctcccaagtagctgagactacaggcacacaccaccatactcagctaatttttaaattttttgtagagatagggtcttgccatgttatccagagctggtctcaaactcctgggctcaagcaatcctcatgccttgacctcccaaagtgctgggattacaggcatgagccactgtgcctggccatttttcannnnnnnnnnnnnnnnnnnnctgaccttgtgatccgcccacctcggcctcccaaagtgctgggattacaggcatgagccactgtgcctggccactttttcaactttaaaagtggtccccggctgggcacagtggctcacgcctgtaatcccagcactttgggaggccgaggtgggcggatcacaaggtcaggagttcgagaccagcctgaccaacatggtgaaaccccgtctctactgaaaatacaaaaattagcccggcgtggtggcacacacctgtactcccagctactcgggaggctgaggcaggagaatcgcttgaacctgggaggcagaggttgcagtgggccaagattgtgctactgcactccagcctgggcgatagagcaagactccgtctcaaaaaaaaaaaaaaaaaagtgctccccaacctatgcctccgtgttcagagaagtagtctctggcactatcctgtttttctggttccttacctggcccctcttgtaatttgtgtgcctcatctggcctatgaattctcactgctgtgtgtttcatccttgctttggcactttgccctgtgtaccttctcgtccagttccactttcattggctaccatgaatatcatttctcctgggccccaggctcctatttcctgtccctgaaagtaggtctgggcttcttgggtcaaacaaaaatggtatctacaaattactttgtctcaaggagtgtttctagatatagttagtgatcaaaaatgtgcttccaaacaaggaggaaagcttgtgggtaaaagccttgatagtaaaaaagatgtttaaaaaaaaaaaaaacaaaaaacgtggcttactgtctctgactctgaccttattcaagatgttttcttgtcccttcttcccacacctaccaaaaaagacaccagagctgagaaccttgtgagatccactcaatttcagtccttttcgtgggtgtgaggaagacaataattaccagatttggaagctgatgaaggtgtcattttgacagtcctgagaacttaaatgttctgtttgcattgcttgcagaactatttgcaatttaggaagcggaatatttccaaagcatctttagtgacatggcttaaccttgactttggaggagtaagagtcagtcaaaggatgtgaaatactcagcttacattggctaagtgctcatagcatcaagtttctctaggggtgactgaatgggtcccagttggaatgaggtgagaaatgggactaaggattgcttcctgattgcaatggtggctagcttgtagctttcccagaaacttaaatttgctctgctcccccgggtgctggtttgcattcacatatctcagcaactgtcataatgacatgcaacagccacgccatttacagaaaaagctagaactctgtgttggtaagtaaaagccctccagcataggtatacacttagttgttccttccagtggttatcatacttcttttcttgccatagttacatgctaacaacgtcccaaagctatagttgctcttgcattttgttcttaattcttgtaagataaactaataatacagggagtaaatgtgcactgtttattaattaaaatccccgggacacgggataaactgaaggaaatcgtgctttttgaaaagtaggtgtagcttgccatgctgcattgtcttatacccacacataactctggctggcactttttgggtgccaggctgcatgcatctccctgacccactgtagacttcagctgcagctgtggtggacagtgcttatgcatccagcctgtttgccttctctcttctgcctcacggttctcccttgaaggagtttactccatccaggcctgtctccaaatagaggaaacttaatgccctctccaccaatggtgaaggggggtcgaggattaagtactctagctcattgtccttcaggggggccattctggagagcattttactctcgcttagaagttctcagtggactgagtcccagttacctctctgcaatcggaaatcagttatgtattcttcattgacttttcctccttcctggattcgctcttttgtttccctcattcctgcttcctaagatcccctccgaaagtcgttatcttaggttctgctttgagggaggccaaattaagacaatcgccattacagaatgataaacaaatcactagaagcatctcttttagcatctccttttgactccctatagagaaagatagtttttcacgatttttttaaaaaatggaagccagaaaaatagacagatgaagaaaaagattgtttgtttcttattgtcatgttaagaaaaagaagacattcagaagccctgcattcctatggttatgctttagaaagcaagaagcacattcttcacaccccatttttcagtttttggcatgtcatttagcccattttcagaattcgtcacctaatggctactcccagttcaaaaccacatgtggaaaattataacaagagacaatgaaaagtcatctggctcagtgctccatcttcaggtgagaggaggactcaggttagagaaaaacatgtaaagagatttcacagtgagcttagcagaactgtgcagaccagcttctgggaaaactggttcttcaggatgggttccagaatttggattttggattaaatgttattgattaataagaactaaattggatctccaaaatggaactactgtactcagagtcctaagactagtctggagccgaactctgagttagaaggtgatgagctgctcacctccagtgttcagagtccaagccttctctctaaagagagttcatcactgctagcttgatgggagcatgctagagagaatctgagcttcatcaggagcaggctcctctgagatattttcaaatgtaaccaaaggtctaagataaataggacttagacatgcaatttttgttgaaagaaatttagtataatttgtattccatatgtaacacactgcaaatttgttcctgctggataatgccattttatatagccacacaattcaccatctcccaatcagaagacaacattttaaaatgacctttcaaacagatattagcaaggttttgaatgggcttatctgtcatcttattaaactaatttttgaatattctctcattccttgggagagtctctgcctacagacatctctttctttctaaggtaatcaactgactgcttccttgtcctgtttgctcactcagttgaaattgtgacttctggtcagagttgtgcccatggtgtattagatagaatcagaaggtaaaagggatcagaatgtgttcactgatcatgagattaatcccagaatttgcagaactctttgttaaaagattggggggcactttctatgtcacaggcactatggtaattgttaaggaagcaacagtgcacaagacccggtccctgttcctcctggagctcacattgttgcctgagtgaggagggcgaaccgtgggaaatgctgtgatgtggtggcacctgagagaccccacagcagggatgtgtaatctctaactggagagggttgtgcttttggtagggaagtgaggagatgtctgggctgacttttgaataaccagtaggaggaagttatgcacagggaattaggtggtgagatagtttttgaggagcaaggttcaatgtgctcagaagcctaggacaagaagtgcaagaatttgatacaatgagatatggctggagcatgtgtgaggaaattatggcaagagatgaggctgggcacaccagaagtggcttgtaattttttcctgaaagaattcaaattttatcttaaagaaagggaggtgtcatggatgttgtgtcaacagagtcatctgattggacttgtagaatattttggtattcaaatggaaagatatatgggacttgaggggtgggcacagttggatgcagaagactggtaaggaggctgtcacagggaacaaattgggagagcctcaactgtagagactgaaaaaagaggagaggttcaaaagttgttagggggaataccaacagaacataaagtcagtggagagggggaagggaagcatcaaggatgattcctagatttccaaattggacaactgggtgggtagtcactctgttttagaatataaggacttgattttcgaaggagatggaggtgagttcactattgcacatgttgagtctaatatatgtggaccatgggacatctgaggagaggtatctggtaggcagttgaatatgtggttgttgaacttcagacctgtatttgaactggatgtgtttatttatgaatcatcagaagatggaacgtagttgaagctaagggagaggaggtgaaactgtgaaatttgagaggtggccagagggtgaagaacccatgaaggaaatcaagaaagaatggccagagaagtagaagagaaaccatggagagccataccatagaaaccaaggagcaggagagtttccaacgggagaaaggtcaatagtgtcagaggtcacataagacgaggttctattagaaattgcaacaaagaggtcactggcaaccttggcaaatacagtttgagtcagagatagagataaaggccagattattgaaacatgaataatggagaagaaatgaagacagagtgtagaagcactctttggatgttggctatgaaggacagatagaagtaagttgatagctggaagaggcaaggccagggaagtgttgttattctttgaagtgtttgtgtgttaaggctaacagctcaaagagaggtgtgggttgaagttatagtcaagagagcatatggaaccagattcgtactgaggccagagaaattgggattccaaacacaggtgagaagatcaatcttagaagaagaagggatactttcttccactgaaatggaatgaaaagaggtatttgtggggtggaacaggatattgaggaattgtcagttgctctattcacctctgctaatggtaaaagaagagagatgaggtaagagtcttgaggcgattggtgaagacttttgtggattgagggaaaaaactcataatagatatggaaggggtgctgggcaattgctatcaactacatgtttatgcctccctctccccagttcataggttgaaatcttaaggcccaaagtgatggtagtgggaggtggggcctttgggaggtgattgggccaggagggtggagcccccatgatgggattagtgtccttatagaagaagaggagaaaccagagcctcctctctctaccactcaaggatatggcagggaggtggccttctgcaaaccaggaactgggacctccccagaccccgactctactaccttggtcttggacttctcagcctccaaaattcagagaaataaatctttgttgtttaagccactcagtgcttgattttttttatagcagctccagctaactaaaacagcagtattgagagactagtagaggcccaaggttatgaggctgcactgcatgattttattatatatatttattatttgattacccactctcatgtagggtggggaaggtttttagaatccgccaggatgtgggtgaagtaagcacaggaaaggcagatgtatgaggtaaaattggaggcatttagggcctagagagctcagtgggtccagaatgtaagtgaatatgaacaactgagagagaaatttagagggattagtagtggaagtcacgtccttgggtagggagactggtttgtctaagcctttgccgcaaccgttgtccactttgacttttctttagaaaaaaaaatacagtagcagtaatttacagctaatcacttgtaacaacttcccattagaattttaatttactttgatttctagatcattttaacaatgtgttttcatcttaagcttcagatcttaaaaaaagtatttcagttggcgataaattacttggtaagaaaatgggagtgtaaaaattatttaatggaatcattttcaaaaggaaagttacagtttctaatgaatatatgtagagatttttcaggcaaattcatgcagatgcataaatcctcaagaatgaacaccagaaaatgatacatggtgacggagatattgtcattggaaatggaaatatacaaagggaagacatttaaattggtgggtcgcatcgaaactgtgattcattctccctgtgcctaggtactaagttatctgagttagcagcatgtgtaatgactccaaatttagaaaaataaaataaaatgaagaggagggaaagtgctggcatggcgatttacagtgacacacagctaatgctgagatgtgaatgtgtgaccttgtgattacacttttggctatatgtgctgttttgctaattccagtcaccaagtttggtacacttgttaatgcttttttctttgacttaattcaaaacatcaacaaagtgcctttcttttggatccatcatcccgatttattatgctcaggaatgtccaggcttttctgtcctgaggcttttttgaggatgatgtctgcggtagagaccatccaaaggcaggcaaaatagcccatggagagagagaaacagaatggaacagagtgttctctgaactcaaccaagcccagagattgtagtgctgccccccactgagctacgggagtatactgtaaagaatatcattgccatattaagacttacgttttgaagttcaggtagcctatccatcattgtcaattaatttgtaccaagagctcaaggtggttggtgtagtagtgctcatatgttgcggaggttgtctgcagagcaaatagaataattcatttggattcatactttacctaattttgaaaatccatcccttacttttcatgttggaaaattggaatgaatttcccactaatggatttgttgaggaattcagtttcctctttgcatttgacccaacagcgcactggttgtcagcacttggtgttcctccatctcttccttccagaagggtctctgtatggtggtaggagatgaccactttgagcacctgagagggaaaaaaacaatctctgaagcaactcctgctgaacttcttataccggtgatttgtaacaattcaatgtgtgactccccccaaccccagtaagagattagtctggaggtggcactcagtccaagcaatgctaggagaatcagactgggccaggctgctcttatgctagcatatccccgtcagatggcattgtaccaaagtctgatatgaagggaacttttctctctaataccaggcctttgtttttctctatatattttttcttcattagaatgttaactaacctagctctgaaagtaaatcaagggtacttcctaagtccaggttatatgaggttgatgagtatgctaaatgtgaccccaatatcaatagctatagatgattctagtatggtgcttaataatgtggagtggaataattggtggcttagagatgggagtgggattgggagtgggttgaagggttagctgagatttcacatcttggtaaacctcatcataaatcggtaaataatatgaacacttatcactgacccataaaatacagacagaggctcttcttgagttggaaggagccattttggaaattcaaaccagatgcttattctgtctactgtataaatatttcctccaggtgttgggtatataagtaaaaggcatatcagtgtttagattacttttttttcatatgaaacaagagcattcttagaaatgagactaacagcaatgggcactattgtgccaccttgtgaaagtagatcacacaaggtaaataagtgctttattttgatgtaaggtcagtaccgtagaacaagatgatagcttagggaataatgctcttcttcatatgcctaaggaagtgcatgtagtagctttttcatccaccagatatgatacctaactagggtagtcttagctcagtcgtctcattcatttgcctaatagaacgactttggaatttttagaaaatgtagatactagaacctttactgagcttgagtttctggagtgtaaatggatttttcaaaagctccagagatgattcagattttctgccgttgttgagagccattaccttaggtgccaatgtcataagactttccaaaaagagattagagacatgaacaccacagtctctgttatttagatgtggatggacattcctcactcagagacagtaggttaagtatacttatgaaaatacgtagcattatatatactcacattcttgctcattggcaaaaaaaaaaaaagaaaattaaggcagcggtggatttctactattggcatatcaaattaacagattaaaaaattagacccttaggtccctgtttgtcgtattgttggtgataaagctgagagttggtacttcacattgagctaataggtatgtaaattggcagagtttttctgtacaacctttggcaatgtgatcaagaggcttaaaagcattcatatactttgacccaagaatatatgggaatctagcccaagaaaataatctgaattgcagactaatagaattccagcattatttacatgagtgaaacaatgagaactgcataggacatctatatggtgcaatagtttgtaattgtaataaattatgttttgaggagtttttagtaatgtggggaacacttatgttgttactgctaagagaatgcaaaagtttacatatagcatattctagatgtaaaacaaatgcctacaaagatagaaaaacaccaaaatattaacagcaatcatattttagtactaagactacaaattttaattcttgtcttcttactcttttgaattttccaagttttctgcaataccactttttaaaaaacatattttacttttataatcagcaaaaaaatacactcatgggaaatgctttaaaggcaagtattttgtggaagaattggctgtggaagatctcataaatgggggaatcgatctgtgaagggaagagatttgaggaaaaatttcagtagaccagaaaaatgcttaagttgttttccagcataagaagaaacaggaagctggatcataagcatgtgttttgaggaaagtataatgagtggctgaaatacgaaatatgagaagtatgttgtagagatggcaggaggcaagttgatgctggatggatataatgaaaaatatatttcattctcttcttttatgtcttcagagttgtgtgatgttaggaaactttcctaaccctttggatcttcatgatttgtttatattcatcaagtatatggttaaatgaagtaaacacaaccatcaaaggctgaatgtgaaaggaagcagatgactctactggttctgaaatgactttcttcttctaggccttttgttcttctccccaaactttaagaagttgataggcttggttggggataggataatgattcccaaagttgctggttgtttaatatgttagtattctagaagatatctctttcaaaagtgaacctgtattagttgaggctcacaggccatctgtctgacattgtcttttttagtcaatactttgatggaaagctctaaaggtacctggttgagaaaagctcataatttctcattaagttaggtaaatctgatcatttactgacaatagcccttttcctaaagcctactaagagccataacaatgtatttatgaattttccctgggtttttggaatggactgtttgtgtttgttagtatctctttcgttgcatgtcaacatttccaaagcatgttaaaacaattgctccatgttcaagcaattcgtaggtttaaatggctggttaggggagcccagtaaattcagggggcattatgattcgatagagctctggaccgactggttattactttcctatcttgtggtattgcacatttatttaaagctaatttgatattaaaagagtaacaagctattagaaataatttttttaaaactaatgtttttgaaaattatgatactattgcctttcttagtttaaaagagaatggatttctgaagtacacaagaccagagggtcaggtagtatttatagcttgctctcccacgcaaagttcagaaatccagtgactataggggtgccgtgagatacatggctgcgaaagatttatttggatcttgctattttaaatttttcaatctatcttaaaaatttgagagttcattttctgttatgaagaaaaatgcattactaaataacttgcaaagccctgtgtgtgtgtgtgtgtgtgtgtgtgtgtgtgtgtgtgtgtgaccaaagtttatggcttttttatacttttggacttacgagacatacctacaaatataagaggtccttgattttttttacattctcctctactttctatcagtaccaatgtacattatttttattatttggctccaaatttatactgttttctatgtagatgaatgttattttccttaaatatttgatgcaagaatcacttctgagaattggcatttagatcaagtaattcagtttgtttccatttgcgcctcttggggaaaggctttggacttagtgctccaactaattttccatccaatactgcaaaggaaatgaccaatcagactgagaactaagagaaattatatcaaaaatccaaatcttcatgaggaattacttatggacttggctaaaaggtggcggatatttttctctttgtaatgatctacttaagctcaaaaactcaatagagttgaagatttttctttgaattcatttgggctttgaaaaagctgtgtaaaattggcaatttatctgtgtatgtgtttttagctcacaaacattttgttttggcccatagtctttggtttcagaaagtaagcaggctaacatgtgcatagcactgttgtgtttttaatggggatgatgggtttaggtggagatttgcagtcactgactaccatcttgggcttgtcagcatttcatgaaaggagaattagaagaaacagtataacctagtgaggtctttttttctgagtccagttcttactttctgtatgtatttttctggttgtctttattcctattctactgacctcaatatttttacttttgcagctggaattagtcaggttgagccgctcaacaagagacccctaaataaagttgcctcaataagatggaaatgcctttctctttcatctaacaatgcagaagcttctttatcctattaacttttcttccctaaggtgagttcctcatctgtatgctggaagttgtttcatcagcaccacatccaaaggaatgggaaggcagtcagtatcttttttttttttttttttttgagacggagtctcgctctgtcgtccaggctggagtgcagtggtgcaatctcagctcactgcaagctccgcctccaggttcaggccattctcctgcctcagcctcccaagtagctgggactacaggcgccagccaccacgcctggctgatttttttgtatttttagtagagacagggtttcactgtgttagccaggatggtctaaatctcctgacctcgtgatctgcccgccttggcctcccaaagtgctgggattacaggtgtgagccactgtgcccggctggcagtcagtatctttttaagggtgtaatgtgtaagttggacacatgactttcactcctattgtattggcaagaacacagtcacatctagttgcaagggaggctgtgaggtataatttctagttgaagaaccttgctaaattttagccttgctaaaattgaaggtggaatggcttaatgctaaatgggggaaatggagaaagaatactggagcttttagtcatctctgccacctagaataatagagaggtcaaagttcagcagtgtgcacccaaacctccattttcttcatacctgacaccatgttgcagaaactgaaagcttgcaacctgagggctaagactaatccattgcttgagataattctatccatgtttagcagtactttaaaagctttagatctgcttgcaggagggatctagaatgagtgtcgctactctaagctcagtattttagagtcagctagatttttctactccattgttgaggttttagcacgcttgctgcctggtgcttgagacatgtggttccttcagtgaatgctctactgtgaagattatctatattataccagcttagttggctttttgcaatgtagttattaaactttaactatttttaagttgtaataggcactgcatcaaaagaggggtatatcaacaagatgagtaaaacatagttcctgcctttaagggatacatgctctggcacactttttcaaaggtaaataagtgtttctccaaaaatatgttctgaggaaaatacctcaggaccttattgctaccatctatccattatctaccaatatcccctcttcccatagattccacccaagaagagcccctaccaccgacaggagttccgctcagacctgaattcctgacatcagtttccattttgtatttgttttctaaatctgcagcggctctgaaattgacctcacagatttccttggctcactgactgactttaaggcctcaaatgtctactagactaggctgcattatgatggaggcaacgacatcaaggctcacagtgtgaattttgttttcatgtttgctgttcagttccttaaccaatatttgttgaggatcttctatggaatgaagcatgtggggtgtgaagctgagtaagacatggttcttgctcttgagctgttcatcttgtaatgaaagaattacactattatgtgattcgcccactggtagaggtgtgggagatagagtgttatggaagtatgggagaaggactggctaatgtctgagggggttggagaagttagtgacatttacatttgaccttaaagaaggaatgagttcaccaaatagaagcagtcggggtaggggacagagtgaaggtggcctccctgacagaggggacatcttgtgcaaagggtgaagtgtgaaagatcatgggttcttgtcctcaacactaaaaaaccaagaaccaaaaccaaaaactccatcaacgcactataaatgatgtttcccttgaaataaagactctgttaaaacaactctatgtcacacctagattatttagttcgtaagaatctgaatctgaacaggaccattgtgtcccaatcaggacatgaagacagtttggtaaggaccctttagggatgctcatgttctgggttttcttagctctaaaaaatacccatatttcactttgtgagctcttttgccagtcactgcactgttttgtcaaccaaagtgcaaaggtagccaaggagctcagggccatcattaactattcacgtatttgtggaaagcctatgtgctaggcagtggggatataatggtgtgtaaaaagatatcctggtctgtcttcccacagaactcacatttaaaagacagctattaattcaccaattgcactaatgcaaactaatgggggcagattgagaggaggtgtggggctctaggcaaggggctcagaagcaacaaagcccagtggtgggaaggggtgtgatgtgtccaagaaggccaacttggagagagtgaaggggaaaggctcgcaaaatgagggctgtcagaagagaagtgttggggccacactacacactagaccttgttaaggatttgggtttttcgatgggaagccaccgaaagattttgaaatggagctgactgatttttgtttagaggaaatattaggtgctaaacaagcatttatggatgcttattattaatcgtgttatcaaatcaaagagaaaaactcctgggaggcaaaaacataaattgttacctaaaagcagtaacaaaatagaaaataaagttttactaattttacgttaaacagttttgtttactctttatagcaaatctggaatcatggaactgaaggagtcccaccttttagggaggtggtttgcgcaaggctgagtagtaagttggtggctgatttatttctgccctgctccatgagtgacactgttcctttccttccccctttcctgcctcccactcctgctgaagctttgcagataaggaatcaaattactctctggctctcatcagagcttctcaaaatgtgagagctttgattgcaaccatctccttggttcaatttctgtcttcaggatcttcagtgttgctgccacgccatccctgtctgtccccagggagatgccatcatttctcattgatcttcacattccagtctctccagtagtgtggaccagtcaacaattcgaagctgtaattggtagatcagcactgataataatatcagctaaacaatatataggcaatgggaaggtgaccagctgaactaatctcctagattcattttggagaatagtggaaagtaaagttgggtagcattcatgaaaattgtggctttatggaatgtgttttctaagagattggctcttttttttttttttaactgaaattttagaaagagctttctgagtaataagtcaatcacagagagggatctgtcattttctggcaagttgaataggccatgggaattttttttaccttgcctacactcactctcttatgaattatgaagtattatttttcctgaagccatcaagaatggcagggaggaggggagctagtccatatattcacttttcctctgcacgtctctagggttttctgtctctgcctctttatccctgtctccgcttgtttctctctgctgttcttcctcttcttttgcctctttggcatgaaccagcagtagcatttgttacaggattttcatgaggacggtcttctgggcagtgttttgtgacagggtggggtggtccaggagtggctggtggggatgatggagcaagattccagacaattgaggaggccagtgggagagcgctgggtacacccaggtacagaggaaacacacagcgttcagtggggtggctgagggcgggggtgctgtcactaggtggaggaggtctgggcaagcatgacagccttggcacgaggagcagtcagcctggccagatagagcaggtaggctgccggcaggagctggcatgaaggtatgagggcagcaggaggctgggctcagctctggcggctgagacctgagactctggtgggattgagaggaccaggccggcatcaggggcaaggtttagcaatcccaccctagaggcaagggcatcagggctttaggccagaacccaggcggagaatgatgagaactaccatagcagccctgtgcttgcttgtggagcacagttggtgccaggtacccatccgaacgttttattagaccaaggcttttaatttgcacaatcttcttgatagaatcctcattttgtaagtgaggaaatggaggcacaggaaggtagagtagcttactgagcgttaccctgctgggaagtggcacagctgggatatgcaggcagtctggctccagggtccctgctcataagcactttgcttcatggtattcttgttacatatcacagggaggaccattcacatggggtgcatggggcccttggagctgggcaatgtgggctgccctgattccatacttcttcccttaaaaaaattaaaaaggccaattcttccacactgcctcctatgtatctttcatatcttaactcattaatttcaaaactattatctccatggtcttcatggggcctggagagactctggacatgcctgcctagttggtaaggtctgagctccgcctcagagaactacagcagaggactaatagaagtggaatctgttgtctgtagtttttttgtttgtttgttttgttttcattcccttgtctgccctgttgctaccacctatctgatgggctccagggaggaaacagggttatgatattcattcttgcaatgccacacagatttctagaggcaaaggagtggagtactattacttgcagagcagaagatgagaaaattcatctagcacactgtagtcacttagtaaaatttaaacaaaaacaaacaacaaaataattcccaaggctgaattggcaaacagagaccttgggcttgtgttctagcccgtggagccaacaggagggctagccttggctgagtcccaacattattcctttgtctcttctctgagttcttgcagttctgctatagaacgcataactacactggctttgaaaagttaaattcccgagaaatttaggtggaaaattagaatcagaattgccttttgcttctaaatctgcaccagtttgtcttgatcatggctatttaaatctcatagctaatagctaatcttctcactttggcttttctctccttcttctctctgtccaaacaagtggaaaacagaaatacctgtcctttgtactctactgtcaatttcatgggttcactctatgataaagcccagcacgggtaaggaaaagggacttaatatccctaagtttgaagcccatgaaaaagaactgaaaataatgtgtccttgtgatacaaaatagagctgtcctaatttgttgagggacatgccatttcctccacttaatttagctcagtggaggcatttgtcaaattgcaaggataccttccccatcatgaatcacgtggcatttataaacagaatcatagagatgatgctttttcatagggctttttttgactttgaactgttgatcataatgagagataactggaaaagagttgagtcagaaacacatttaacagggcattctcagaatcagaggcagcctccttgaggctatgcagttttggaggctactcagtaatgagaggtaggtgggttcctgggaagcaccagcacaagatgagccccaaggttttcaaacttgttctcactgtaacctcaggtgggagaagtaggccagaaacggggtggtttctctttcatcttcttgaccatcattcagctggagaactgttaaagtcaaaaccaagaaggtgccagtgtcttggttgcttttcactacctgctgcagtgaagtgtgaaatttggccctaggaacttgaacttgctggaatccatagacccttttactaaaagctggggactggagctgatctgaaacaggctcgggaagctcccagggacgtctcactacttctcagcctggtctcagtttagagaatcttggggcagagatagtcagttctaagatctttctagagttctgagctcacttttctggaactccttagagttcctctggggaggttcagagctgagcgtctcactggggttcctctggaactctgggatcagcccgagtattgggttgaaacccttaggtgactcacaggtgtggtgctgattctgtgtagatccagaccctaggggaagactccccaacctgtgatctgatttttagttatcagctgtgggtgaacaaaatgacttctgatgggataattttttagaatggaaggcgtgggaaaaataggaatttccccaaaaaagtgacttctctctatttcaccaaattcctcttgggaacacgcctactgcccctcatcttgaaaactcttatcacggaggaagtgggggaaggaacactccagtatagaacatatggctttgaataaagtaattgaacctttgtaggcactaaaaggccagataaggcaactcctggtgttttcccacctcttacagtttatgattctgagtccagcacatttctgacttcctggaaagcaggcagagcctgccccttcacatctattcttagttagaggggttgggtgcaggagcaaccacaggctgctatatgtgatccagtgcctccctgctaacatccctccctggtcagactcgctgactgcatgcattagggtaccgtaaagtgcgcccctgctctttaaaacttcctttaggccctcacattggctatagggagcgctccacggcagccatccacagaagagccgagctatgtacagtttatccagttgggaacaatttgtctcatcttggtgaattgtgaaagtgggctgcctctgtcttctccccttaatttagatgtccattttaacacaatcggggaatatctatacttgcaattgaagtggtaaagtcgggaaatgatctggagaatttaagagaaaaaaagaacctcttgtctcagttttctgttgattctggttgaaataccgtatggctgtaattagagagttaataattaaaataagagtctgacacatgaatttgagcacagcagccctttgatctggtcctcttggtgtatgggggagggaaccgaggttccacgtggccagggactttctccaacatgcatccttgtcgacaggtagagccagcactgggtttctctctatggaatcccgttgactgcactcatcccctgctgctgtcctccctccatgggggcacaatctcagaggtgacaatctgttcaaaccctaccattttaggattctgaaggacagcaatatcttcttgctatcatttatatttgacagtggactaggtattgatgccactcccaagatgtgcgactgtgattgaaagacatgaacgggtcagcacagacctggaagaactatgctctgctcagctgttgtagccgttgtgttattattttgactcaggtttgttcctttaagagttacgcttttcagagatactggctggaaggacaggcctcctttcctagatccagggccagccagttactcttgtgctgagctcccatgaactgcagccagtgccttccagctgacaaagcagcttctcaatggtaagtgtttatgttgcactttagatttgcagagttctttccctaagttatttcttacctcattttggcgggtgaagaaaccagagcccatcaagatggtgactgactggtccagagtcatctgaccaattagtggcaaagctgatacaggggacttagagcctctgagtttctgggtcattacttacccagtcagtcatgcagcttctctaaaatatgttctgtgctcctcaccagcttctttgtcctcctgaatttagctggctacttttagagtgggccataaagctctcctgtttcaaagctgcagctttttttttttttttttttggttgaccagaaagttctaagtacctagagaaactcatcccaggctgctgcaatgtgggacctgtcctaggtcacctgagttgcggtgtggagcagcaggcggagggagtctgacgtttctatttgggttttggggaaaagaccaatgccacttcaggattattaaagatttgtgcatgggaaggggatgaagaatttacgtgaagacattggctgttgcttaaagttgatttaaaaacattcaactaaagagcattaaacatttcacatctaaaagttgagaagtttttggcttccttttcaaacttcaccagttgggacacagagctcttttcttgccagtgaggcagagagacttcaacgagaatattgaaaacttttactatagaaattcccacaagaaatcttaccatctgtttattctagtcatttttttcttcacattgggtgtaaagattttttttatgactcattgcccttttgacttaaatgcatctgttaagtacagatgttggatgagattagtatctgtttacctgtctttacatgatattctctgaaaataaaatctttcctttgctcccttctccaattgtgaatttaattaagaagatgagcagttgtgtttggagtattcaatagtttgcctttccaaacattccacgcagccttttggatattgataagtgtttattgtagaactaacaatacaggcgaaacaggaagcagctctttgctgggtaggatgctccgaggcgccctccactctccgagggaacgctcttcagctgactgaagcagggaagccgagccaatcagaggccgctttcctagctcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgtaagtattttcatagatagctaattccctctcccctcctcttcctcctcccactatcccctccacccccccgcttcttatttcttaggcaacgcagggaacatggagcagaaagctaacatcattctggggcttgctggctgctgtgtaaatgttctctgtgtagtttataggtaactaaaattatttattgtcaagcaaaaaagaaattagggtgatggcaaagcattcaagagtgtaggctgtttgaatttatacattaccgggtccacgtttgatctcaccaggggtaactgctccttgcagactggtttaaactatgcagaaagtgcctatgttttccaatagcagggttcatagaaaagcctcattcattatataatacacattgtttgttgagctagcatgaatggaagttcctaagctgtggctgtattattatgtgctttctggccaaacaagcagtgcagatatactgcttctttgttaaggatatcagatgctaggcttgtggccatacagcaacccagtgcagaggcagtgggcagtgttcctatactctaccttggaagagcgaagcagactcacgtgtgttttgggttagagaactggactccttctcccccctaggtcaggctcatgcaatctgttaaaatcagggtgaaataatttcctgaaatccctgaaatcataccatagagtgctagcttttaaatataaggtaaagctgataattgaatctttcttttgactcttgctggtggtagttcctatttttttcatcaatacacagaaacctcgcaaggtagaatggctgggggtggttaatgggaagtgctgtggggagtctgaattttatgtgagtgcagtgccaatacatgttgctacatttgaaacaggagtgtgttatataagattctctggctaaaccaccaaataaacaggttataacaaaaaaaaaacaaaaaacaaaaaaaaaccctgtggtatacgtcaatgcagacgtatatgtctaatgatgtgctatccatgaaagatagaaatcctcagttctgttaaggcattccatttttccttcctgtctgtgtgttttctctaactctaactctgtttccgcaaagtctctctgcgtgttgcccaacgtgctcataaatgatcagactgtcagtgtattgtaagggactgtagtctgaaacattggtggctgaaatcaagaaggtccacacttgcaggtggggtgggggaatggcaaaggcaattacaggagttcagtaagccagcttcctgggctggtttcttcagaaggcctgatcacttcttctaccccttctctgctcactcagttatgaaacctatgatgccttgtgaattgtaagttttattttcggccattgattttaaacttgggcaggcagtgaattgcaccgaagtggactggagtcattttagaaatgcctgtagaaactggctgctgtgaagagttggctaggaactaataaatccagctccttgttctccagaactgtatacatttcagatgcactggttcagaggggagccattataagtatgaaaacattttttttttttttttttttgcctttgggtccagtgtcacaggacagctgagtttttctgtaagatgggaagtgaagagtgcagtgacttgactcggtggcagtagttgatggcgggtagtgctaggtactgcagtgctgtactcctggtgactcagtggtggccagcaggctgagatcctccgggctgtgcacatctgtggaggtgaggaaggtgggaaacatgaggagtggagttgggcatctggccaatcctcagttgagagtatgggaggctttcaggtgggcgggattgaaaccgtgtcacataaatcaggggaagacagagatgttcggaggggtgaactgactctgaatgctcatttgagtttatttgtttttataaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctgtaagtgtggggggttgtccagatggaagcagagctctcggaacaggtctggtggataggcgtggaaaggcttttctcagatggccagctgcagtccgagaatatataggcactaaaagctgagtacggcacttcggttgggggtgggggttgggaaccatccgcatatgtcctaccgttctgtgctgttgaaaatgtctttgtggggtgtgtgggggttaacttgtgataagtgattattttcaatgttttcacacagtaagcttgtaataagatcatcttgcctagggacaattttattccgaataagagtaaaccattattatacactgttagcacctcacatccccacagtaggagagagatgttggtactgtgatgcaaggctttcttaagagtttggtccaaaagtagatgttatgctcccagtgccctagattttagtttgtaacctccgtgtttcacatactctatatgtgaagagagaggaaaaagaaacatgccgaaacacacttgagtcaggcattttagattctttttttttttttttttgagacggagtctcgctctgtcgcccaggctggacattttagattcttgagtcctgtggagcctttttgggcaagtccattaacttctgctttggtgtccaggagggtagttaagaatctggattacaaggaagtgcaaaagatcattcagtgccccacagcagggccccacttccgaataggagatttcacacagaacgtcaccttacttcttgtattaccttgacatagatgatggagtgtgtgcttccagatgaacccatacctagcccaggctggttccagtggatcatgcacatcgactcttcctacattagctgctatataagagctgcctattctaccttcactgtccccactgtgtgttaatacaagttctagtggccaagatttttttcatggactgagccccccatgtacactatactatgtgttttcatctgatttgcagtagatttcattagacctgctctttagtgtgtacgtgtatttcataaatggattcattgtgtattttgatgtttgtggaattattctggaaatagatttattttttcattcatcaggtttattacacaaaccgagggatgttcttatggggatccatggacgcagcagagaaagttaccaaaaacctaccacccagaaatagtcattgttaatatattgctacacaccctttcagatgatcaatccacatatatgtaaataggtcagtctcaacctgctactgtgtgttgcaccctattctgtcaaatgctgttcttacttgagaaaatgttgagcatactaggactagaactggcctgcacaggagacactttgcaaaatttaaagctcctacatggaccttctggaattgtgagtagcttgaaatacggattcttagggtatattgtacggtgatgccggggttagttgcacataggagtaatagttcatttctctgacacaattgcttccatttccaaatgcttaaattctaaagcatttagaaagagggacctgatcttttcctgtgaaaaagatgatcagatcatcattcagggcaatttccagagaggaaaatatagtctttaagtgttttcaatcatagaaaggaatcataatatattgattaatactgttagaaattttatgtatgtaaaagttacagcaaagtaaattttacaaacttaatatgtatgtataacaatatctgagtgtatatataaaagcacatacttaaatttacatgtacgtacacattattataagaatagctttgtgttaaactatttattttctataagctgtggaactatgtatgtttgtctcaatgtctgtgcacctctgcatgcatgcgtactgttcaccctggtaccttcacctacattcatatacagatatgttccatgcatcgctaattgatggttaatgctaagtgggagatgtctactgtggagcttttggagatggaaaattagctgcttttgatgtgaacaaagatacccaagagagttgaaaggcaaagcagcctcaagagaataaaggattgctcctttcaaagatatagtaaagttattttaaatatgaagatatatccttgtgcttgctagggaggcggataaacttcagacagaaggatttatatgtttaggggccttcagaagacactttagggatttaaggattagatttcttttggaaacaagaaggccagaggtctctatggtttggtggatcagagcatctcttctggagtcaaaaagtctttctggcctatttatagagaatgaggactgatctgtaagagaatccaaggactggatgttggcatctctgaccacagaagaaaaccaaatgttgctcctggtttgtgtagggaatttgactgagaaaaatcaagttgttttactcagctgagctgtgttggtgtttggctaggggtgtgttaagtaaatgacaaacagggctttctcttcaatcagcaatgatggttttctaaaatatatattgaaattatttctagatataattggcatggagccaaagagagaaattccttgaatcgatcagatcccatgaatttgctgttccagcttgtcaatcttgctgctttcttgttaattttctatttttgagtcacagaggcaagaattcggatcaatcctcgccaggtacttccatgtctccttttctgctgctgttattattattattagattatgatgagtcaatccaggattttagaatatggccctgtgactccctttgtatgtactcaatggacattccattattctgtggtgcaagacattctgtaaaagggtcagcaataaccgtgaaaaatcattattttagggtgaaggtggggaggcttcccattaccttagctcttctctttctgtggggttcagcttggaccttatttctatgtcaacagttctcccattctggtcactgtctcccctttaccgtctcttacccaggtgaacaaggccacttaaggaggacaagaggatataactggactggttatcatcgttcattctcttctcttccctctcccacttgtcctttaaaataatcatgaagccatgaactcagatatccataacattaagttaaaaattgtaccaaggaagcgctacagatataggctctgtgttctcatctacatcggctgatttaggggcctttcatgtgtttgcatcaggctctggcggctgtgaaaacagcaacagctgtaacctgccacactagaaaaaatacattcattgggtggatccccgagttctcacaggaggctggggcactgccgtgtaaagctagcgccctgccctcagaacaacttagtgtgtaaaacctaaaggagcttacagttcatataaaataatgacaactttgagctttttaagactttgaagggcgtgagtctaagataaaactgtgtggctatttttacagcatgtattggtatgccaaaagaaggtagcccagatagctcacgtgacaatttttgacatctaaatagaccaatacttgctcttgctctacattttatattcttttataacataactatatagttttagttataaatattttcctctctttttaaatggtgccacattatcagtacttcctgtgtccttttttttcttttgtgtctgtcatgagaaatattgaaaagtcttatatttaaaacaggatgttttgaatttgcttttagccttttcattcagaggagttgatccaaggtatccactcagacatggagattggcaactgtcaattactcaggagcttgtctgtgtagtttgtggaaaaaaaaaaacaacagttctcttattttgcctttcttatgcctgttattccttaatctctcttttctttttagcctgagcatcatataggaaaaagattctgaccttctacgttattactctattggcagctttgttgaaaagtttggtgagtgataaggttgtagttgaaattgtttctagatctttttaaatctccataagacttaaaaaattttgccttctattgggcatatctatcagccaggaaaatttctattttactttttgtactttgtattatgaaaaaatgttgtagtataatagtgtcatgattgaaagtggagacagaccaggcgcggtggctcacacctgtaatctcagcactttaggaggcacagatgggcagattgcttgagctcaggagtttgagaccagtctgggcaacatggcaaaaccccatctttgcaaaaaaataaaaataaaaaaaattagtggggcatggtggcatgtgcctgtagtcctagctactcaggaagctgaggcaggaggatcgcttgagcccaggaggttgaggcttcagtgaggcctgatcatgccactgcacttcaggcttggtgacagaatgagaccctgtctcaaaaaaaaaaaaaaaaaaaaaaaaaatgtggagacagcgccatattgccaggggttgaatcctgactttccctttcctactttgtggccatgggcatatttcttaaactttctgtgccttggtttcctcatccctgtcaataatgatagaacttactttttgggtggttttgaagattaagttagttaatgtgtataaagcccttaaaatcagatatatattatctgccattattgttatacatataatgaatatacttacagtttcagtaactaaatatgctcctccttctataggttctgatagtcccaccaagttttttggtttattttcagagcccttgcatggtttttgacagtgatttccaacaatcttatagtggttgacaggtgaaagaattcagtaatccccaaaggccttatgattagttcattgtattttgttttagaaaagcatgtggtaaagtgtaattgaaataatgctgggaggctgggcgcagtggctcacacctgtaatcccagcactttggaaggctgaggtgggtggatcgtgaggtcaggagtttgagaccagcctggccaagatggtgaaaccccatctgtactaaaaatataaaaattagttgggcgtggtggtgggtgcctgtaatcccaggtacccaggagactgaggcaggagaatcacttgaaccctgggaggcagaggttgcagtgagccaagatcacgccattacactccagcctgggtgacaaaagcaaaactccatcttaaaaaataaataaataaaagaaaaaagaaagaaagaaagaacccgctgggagttgggaatcttggtnnnnnnnnnnnnnnnnnnnnggctgatgccgagggcgactccagaggatccctaaataaataaaagaaaaagaaagaaagaaagaacgctgggagttgggaatcttggtctttgccacttcttaacagtgaccgtgggcaagtcacttaatctctggactctgtaatcctcagtttttccctcgtataaaatgaagacatttggagtagatcattttctaaggtttcttcacatgcaaaattttgtactttttgctgataagcagtttcttcaattaagataaaaatgtcaccatatgccatttgctttttaaaatgatcaattaccacggtgttttgtacatactgagtaaggtatcagtgttcggaccttgagtctggatgtttggcctattcagaatctttgaaggaagcaggtatatgtggtacatatctttgagtagagtagatgtttgaaaaggaaaatgttttatttaagacttttaattctagaagccaaaaaggatgctttgtctattgcttgttcgcttgccaatacccatggtgcacttccagcccacagtgatttgagcttggaaacacttgagtctcatctctaaaaaaaaaaatcaaaagcaaaagctttctgagaagtaaatttctcctaactcttactaatgattgaggaaaggtaattctgctttaaattatttttccttcttggctaaggtatctgagctctacactaccagagtattgatataaaaatattttaaattattgttttgtgattatcctgcttaatcatcaagaatatttgttgttcagtgttttcttgctttacagaattttcttcagctcattattattatcctttgggatgtcctaaaaccaataattcatcagttgaaaaaccccaggaatacaatcaattctaggagacagtcattaattttaaaagtcattcattacttttaaaaggaataattgtgcctcacctggttaagttccctctatgataaagtgaaaggatgcaaagatgagagagaaaaagtcagtcctgacttgagcccaatctctcaaacatccctttaaataatgttcgcatgaagtaagggctggaggcaagtatttgtcaagctagaaaactatggcgaatgtcatgctaaaatggttagtgcataaacagattagttccctagcttatttccaaagagttattattgatagcttaatatcatctaacttcaaatgatgtcctggagattaatgtcttggggtttacttgattcaatggttctattgatccaagtgatagaattaagaacctgttgatcaaattttcaaatcatctcacttgatcatgttgttaacgcttcgaatataggaacggaaccaaggtgaagttgataaggtaggggagcacagaaaatttaattatgatgcacagggccctttgtgaagtgctaggatattgcagagcagggtaaggaatgaaagcacacagatcaaggaaggctgggtagacattagatttcaaaaagaaaagaccacatgatagtcacatttcatatttagttaactaaaacccaaaaatttggtacgtaaaacataatgcatattcctagagtgccaatggcggtatttttctgtattgtcatatccctaaagtcatattttgtactttattgatccaagggcacacttttcctcccatgtttaacatgtctaacacagggctacatcttaaaactaatgttgtcttgcagttatattggcagctttttccccttagtggtacataatctaatgttgaatcttaaaaatattgatatctcaaattcagtgaaatgggaatatttgggggaaaaatctttaaacaatacaaaaccatagactgtaaaaaataagtcttccttgatgacatcctaatctgctgtcctccccactggtagccattcttaacaattcagtggatatccatttctatgcattgacaaacaggaatatttagaaaaatgtacttacaagcaaacgtgtcatatttgtaatctttaaaaatgcacataagatcataataaatattattattctgacttgctttctttacctgaaaatgtactgtggattttttttcatatcaatggattcttcttaataaaaagtgacataattgctgtgcagcgtggtttagccatgatgaatttttcccactgatagagatttagactatttttcatttttcagtcctacagttaaatgctacagttaacattcttttttttttttttttttttttctgtgagacagagtcttgctctggccaggttggagtgcagtggcacgatcttggctcgctgcaacctccgtctcccgggctcaagcaattctcctgcctcagcctcctgagtagctgggattacaggtgtgtgccaccatgcccagctaatttttgtatttttagtagagacgggagtttcaccatgttggccaggctggtctcgaactcctgacctcaggtaatccacctgcctcggcctcccaaagtgctgggattacaggcgtaaaccaccgcacctggcccaacattcttttacatgaatcattgtgtacacatggagcatttctccaaaacagcttcttagaagcaaaattactggatcaaaggattaacacattttaagacgtatatatattggtgagcattgtaaaacatttttacattatacattcttttttggttcagaaaaaaaccaatttagttcaacctttttaacttgaaatgtaagacttcaaagaagtttcttgattgtggagagcaactttaggatatgacctccagattctataggaagaatttatttactctctgttgtgataatttgttttggtttaaaaataacacacaaaaacttgggaagttccatatgccctcatcatatcaaagatgaaacagttgaggcccagagagattaggccacttgtttagaatgacgcaatctgtagtagaagtggacctagagccttcctcacatttttttttttttttttttttttgagacggtgtctttctctgtcacccaggctggagtgcagtggcgcaatctcggctcactacaagctccgtctcccaggttcacgccattctcctgcctcagcctcccatgtagctgggactacaggtgcccgtcaccacgcctggctaattttttgtatttttagtagagacagggtttcactgtgttagccaggatggtctcgatctcctgaccttgtgatctgcccgcattggcctcccaaagtactgggattacagacgtgagccaccgcgcccagcccacgtttctttctagagcaatattctttttaggatgccaaattccaaggttagtactataaaaaactggaataaacctgaagagtggtataatcgtataatttgtatggtttttgacagcttacaaaacagttgggagttgggagaatctccaaaacagagattggattgctctctgacccaaatggtgagaactttatctacttgtagaccagatttgcttcccaatttctttcaagcgtttgtttgatgttgctttatgatatggtttgaagtcccaagttgctgatggattagaatgataatacacccataaaacttaaatgaacataaaatttcaatgctagagaatgtcacaaagacgttttgtgttttagggaaatgttagtgttctcatgatttgtatgcaggtcttgatgacagttgcaagttactgctacgtttggccttagccatgagcatccgaatttcatttttattctctgcctttctcatttatgattcatctccatgagcttccaattcaaagaaacatttgcatgattcagtagcaatattttttaaaaggtaaaaggaacagcagtatttgtaaaaggtacgaggaactgtaagttctgggggtgggggtggagagagtgtccctgacaacatgctcaaattaggataaattgagagggtttaataaaatgaaaaggtattggtagggtgcaaggaaaccacaagggatagtgctgtacccccatggctagtaagtgcattcccagaaagggtgtggttataggaacctgggaggactgagttgcatccagaaagctaccttgagaaggatgcagctttccctgtggatggatacagccagctttgaagcatcccacaaggaggaagccagagaataaataccctaatcttagtctcccttactctgatccctgctagggtgccttttggccaaactcagccagaagccaaagagcagagcttaccggttagccatgcagtgcaatagcagagtggggaaggatgaagggtggtttagagaggtgatttggttccatctgtattactgtattgtctgagtgtatattcacacaagttgatgaaagcatgcaattgggagacattctttttttattttttttgagacagggtcttcctctgttgcccagtctggagagcagtggcgcaatcatggctcactgcagccttggacctcctgggctgaagtgatcctcccacctcattctcttgagtagctgggactacaggtgcatgccatcatgcctggctaattttttatttttttgtagaggtagggtctcactgtgttgcccaggctgatctcgtactcctgggctcaagcagtcctcctgcctcggcttcccaaagtgctaagattacagccataagccactgcgctcagcctgaagccattcttaaagcacacctctgaagatgctggtgaggctctgaaggagctgttgttggtcgtcttcctttggagatgtgtgttggctttcatatgtgggaatagtttcactgcaatcagtctcctgggttttaattcctgtactgttgctttgacgaagaccttcagcacttcaacaaaatgtctagcaataggagcaaataaaagatttaaatgttagttttgtggagaaagcttgagaagctaagctaagagggcttccatgactgccttcaaatacccagaggtctctgtggagactgagaagataaaggaaagtgcgaatgagaccaacttgtgtcttagatgtgctccattgtcatggccaggccagaataatttttgggatctctccaaatgtcatcacgttgtgattcccaccacatataatagtgagaggagtggtgggaacagggattagcaatgtgagatttttacatttctgatgacagcctccttattaaaagatatgttgaccgggcaggggtgggaatgctaagaggagcatttcctttacatggatgatagtagcttggaggccaagtcttgccatttttagtcaagctaaaacagaccccatgtgtctgtatttaaaaatcaactttggctactggttttatggtgtgtaaaatatgtgaaaatccattgatctacatgtatgatatgtgcacatttctatacatgtgttatactttaattagaaattttgggagtgtcttttggggaaacaagtgaaactaatggaattctgaaagctgtgatcaggattaggatggatataatgaaggcccttactttccattgctaagacttacaaaatgtggaagggagtagattcatgccctcactagatgctggaatcctgagtgcagaaagagcactaacccttgactggtggaccagttggccaaggattgggacatgtaacccatcactgggatatggtaagagcatgcccctccagtctctggaacagaaggtgctctcattggtgatgttcatggtggccttttgcttcactgccctccctgggaccgatcgcaatggtggtggttatgtgcccagccagcagatacctcccctctctgaatagccatgattcttaagataaggcgaactcgggggaagtagattttctccttgcttttagcagtgtctgcagggtcaaagccaggctgttctcagtggtgagagctggtccttatgcttacagaactgtgccagtggccacaagagagagtcaattccagcaataaggaataaaatgattgccatgagtctcagttgtggtttattttgataagattctaaggttcagatgtttactcctggaagggtgtgtgcctggcatatggtatacagagacactcactagagaggtactgcatatgtctttaaatatacttaaggggctttctgaaagctaagctagcatacatgttacatgaagactgcttggattgtttcattttcacagtttaaggacttaaaataatctacttaaaattgatttctaatttttataactcaaattcttaaattattactagtgtagagtgcagtgttataagaacggtgaggcagatcttgtaactgaagtacactgttaccatttgttatgggtgcttttcatcagttcagctgtaatattttgaataactatgtgtgtctgtgaaactccttgaatcagagctacaatataaagaactatgcaaattatgcaagatattataacaggactttattaagattgaatagtatgttgataaatatgatattgttctgctttggttttgaaattacacaggtataaaaatagctaaaaaattgttcctcccacattccaaatataaagtaggtaaatttacccctaaaatttaagagcaagaaaaaaaagagtcggatacaaataagatagaaaaaggatgagaaatgcataatctagattctatgaatgttttgatttatattgcttttaactaaaatatgttctggctgtaagatgtacaactagttgttacatttttcatttgagtgctgcatttacatagagaagctggctttcaaaatgccagccagcagccaactcaaatgtggaatatttgagtctaacttagtgactagttttgtaagatgtcttgaggaggttgggggaagggtacgcatgggacaccttgttctggaaactcagccagaattttgtcagctgtgattcatctgattcttagggtatttgaatttccagttcctaatttagagcttgcaaagatactgtgaacccaaagcctcacctccatgtatttaatggaagatgtatagttttgaagttccagattgacttccggcagaaaatgaggacattcagcaggctctggctataaactatatcatttctttagaagtataaaaagtgtccattatcctatcagcatttgtgttaaatgacttctgagattctctaatcaaggatgttgatagactttggaagcatttcccagattactgattgggccttcctcgaggtccttagactccaaggaattattggacctgtctgctatactgggaacagatcagacactgataggtagttgttatctttgtacctacatttaaaaatacctagcctcccatttgaaaggagccctttttctgtgatcacatactgtattgatgtttcgcagaacatactgtgagagaaattatttgcagtaggtaattgggagccgttcacagatttttaaactggaaagtggtttgatcagctgtgcattggtcagggtagaagatggatttgaggagaggaagaattcaggcagggagtccaaataaaaagctgtggaaatagtacaggtgtgagctgatggaagcctgaactagggcagcagtagtggggatggagaggaggaggtgaactgaaaaaatatttaagtcataaatgcagcaggtttaatggctaattagcttatgaaggaagaggaactcccactttcggcttaggtgactgaccggttggacagtgatgccactgagattggaaaactaggccatttcttctgatatcttttccactgaccctggggatctcaggttagaagccaggtcccggattgaaggcctcaaccctttagccattggtttctggctaagaaagttactgacttcatcccaagatcatgaaatagtttcgttctagacagctgggactcccggttaccaggaacttgctgccaaataatcggttatggctctatctgttccgggcctgtacctatcctcatataccctattatgccatgtttggaaactatagaggaagcttgccatatattatccttttacattaaatatttctttttctatttagaagtagattgtaacattttccagagtctctcatacttcttatatgtggtagatgagtttctagccattaatttatgcgcctgttgatacatgtgaaaaaaacaggtccctagtcaaataagcttgataatcaccatactccgtccctttctcaaaagattcacagcacccagtagcccactaatatctgttagcattccacaataaataaaccaattaaattttatttaaccccaagatattccaaacttacttgatctcagaatccatttttttccctaaagaatacctattaagtacttgaataactagtatactacagaatacaattagggaaatgctggtttagttatttacaccaggcctcataatcactgcaaaccatctcagtgttgtagactggaaggattttgtgggacagagtgaagttaacgttaaatagatacagtatatatatttctggggcctccctcttaggagactttgattcagttagtttggagtaaggcttaggattcatatttttggcaaacgctccccaaatcactttcatgtaaattctttgagaaatactgggtcaaattattgtcttggtcagctcgagagtttgtgacagtgcacacagcacttagtttccctgttcttttagcttcttgtccacttatttggggtggtaagcactttgaagtatgaatgtctttctttaaataaaatgtaattggtttattcatctccctatccttaccctacccttgcttgcctcaagacgggcactcaataaatggttgttggaatgaattgaaattcaataactttaattcctccaggaatcaagaggaatctagggaatggtcagaaatgattgaacacaatatattttatcagggattcccaagggacacacacacacacacacacacacacacacacacacacatacacgcccagccactctactttttttttctttgaaaaaatcaaagtgaatttaaaattgggggttagcaggtttaggaaattaaaaggcctatattctttcttttttttgagatggagtctgactctgttgcccaggctggagtgcagtggcacgatctcggctcactgcaacctccatttcccaggttcaagtgattctcctgcctcagcctcccaagtagctgggattacaagcatgcatcaccacgcccagctaacggctaatttttgtatttttaatagagactgggtttcgccttgttggtcaggctggtcttgaactcctgacctcaggtgatccaccgccttggtctcccacagtgctaggattacaggcatgagccactgtgcccggctggaaattaaaaggtctgtattcttaaaagagccagaatatgatgagacactcagctatattgattgtaaaaataattggtggtagtgttagtctccctcctcgcctacaatcctagaccctattccctagagtaaacacttgatagtttgtttctttaataacagcttcactgcatataattcacataccaaggaattcagccgtttaaagtgtacaattcaggggttttactatattcagagtggtacaactacaatcatcaccacgaccaatttagaacattttaatctccccaaaaagaaaactcattcctattggcagccactccccatctccttccaactctctcagccctagggtgtgtttgtgcatttgcctcttctggatatttcgtacattgggatccacacaatagacagccttttgtaggcttctttcacttagcataatgttttcaggatccatccatgttgcagcttttatcagcatttcatttctttgtattgccaaatattattccattacatggatatatcacattttatccattcatccattgatggacatttgggctgtttccactttgtggctgttatgaataatgctgctgtgaacattcatgcacaagttcttgggtatgtgtggatcataaatttcttcaccagtcacatcaaaatgcgtcatctttaataatttgatgtatactacaagtatatcgaagatacaaggtgttttagaatcccactccactggcctgaatggccatatctcagctatttccatataatcctgctcttgtcagtttgtacgagtaagcaatgctcagtctcaagtacaaaaattgtggacattactccctccttttgagaatgctctcttctcccacatcctctttatagactttatagactttgaattgctcaaagtctaattctttttttttttttctattttttatttttgagaccgtgccttgctctgttggcccaggatggagggcagtagtgcaatcatggctcactgcagccttgacatcttgggctcaagcaatcctcccaccttagcttcctgggtagctgagactgcaggcgtgtaccaccacacctggctaattttttattttgtggagatggggtctcactatgttgccggggctggttcaaactcctgggcccaagcaagcctcccacctcagcctcccgcctcagcctcccaaagtgctgggattacagatgtgagccactgcacccaatcaaagtccaactcttattccacttcttctatgaggttcctctgcttttccagcctcttctgaattcccatagcagcatctgccccattcacttgggcattagccacctgcagtcttggatggcttcttcaccatttcatgtgtctgcatcttatttctgcaaacataggactctagagggcaaggatcaagtcttaccattcttttctgccttccttccctcaactccaactatgcaagggtagagaatgaattaaaaaagacatagcacaatgatacacaataagttaatattgaatgagtggatgaatgctatagctctatgatattgatgttctcagtgcatagtaagatgggaatggtttgcaccaaccagtgaggaaatgacgagtgtaattaattaaaccaggtgcagctctgaaattgtgaggtgcttatttaaaagttgctgacttgttggctgggcaccggtggctcacgcctgtaatcccagcactttgggaggctgaggtgggcggatcacaaggtcaggagatcgagaccatcctggctaacacagtgaaaccctgtctctactaaaaatacaaaaaaaattagctgggcatcgtggcgggtgcctgtagtcccagctactcgggaggctgaggcgggagaatggcatgaacctgggaggcggagcttgcagtgagctgagatcgccccactgcactccagcccagacaacagagcgagactccatctcaaaaaaaaaaaaaaaaaaaaaaaagtgctgacttgtcacagtaaatgctgaaaggcattctatttagaaataatcttgtctgtgtatcatagtttctttatttcttcttgttctcatttgcaaggacatattcagatatattgtcttgaaaataggattctttcaacttcttctcttttatttccaagttcagatcataatttagtgactgtattattatcagagttattatgtctgtgatggccatatccgaaatctctgtgacttttcaggcaaggttagttatttgaatgaaccccgcaaatgaactttctcatgttaatctctaaagccaaatggaaacaaacaaacaacaaatttcaggaaatcagacacataaaggtacaataatttgaaacagaacaaagatattttagtttttctcactcttggcaatgaaaatttctctataaaatctgctcttcagacatttccccatggatgacagaattaagcaaatcatcccagtttgttctttatgagctgcttatgaaacattccttggaaataattctgcctaaataaaattactctattaattcatagccttaatttttgtgtgatgttgaaaagaactaaggaataggacggtctcctttggtagtaataaaccatgccactctggtttagaacgaggagcttgctgaaggttggagaggcagagtgtacattatagtgaagctgcggttgttgcttcagggacacactgataaccctggtcacagttgcaagaggtagatggcagatcccttccacaggtatgtgtccttgtatccccatggtcattcatgttaagatgggaggcatctgggtgacttccttaagttcttactgtgaagatatgttgacatatttgttcaaaagacagatagaatttgttgtaaagacatctgagctttgtaaattaatcctggatatatctattgatggccttcatgtggggtgaacacgtttgtcagagtgttaccaaaggactgtttacagatgcattcttttctgagcatctaaatgaaaagttcacaagtacctatggaacttccaacactgtgctagagatgataactcttaaaagagtcatagaaatagaaaatattcctagtagaaaaattcttagagtgaaatcaggaggagatctgtgcatttgaaaccaccaggagggagcatagagtaagaggatggactttgtgtttgtaaaaagaactggacttacaatgctttccgtttactaactgtttggatttggacaattgtgctccacacaaattctttcccttaattttcacaatgaccttatgatgtagatatttttgtcacacattttctaggcataaaaaaagtcatatgattcgtccagggtcatacagctagaagacaagccaggatttgaacccaagtgtcctactctagactgtcttcctaaaacagggaagggaggagttggagggcttgaaaggagagcatggcaggctgaatgaggaaacagaacaagagaaggagcaaacaaggtacgggcacacgagtaaggatggggacctgctggtgtcggacatggccgtgggacccacaccagcaggtattggacagatcccgtaggcaggagggagcttcctttgcactggcagaatcctgagaacatgttggtctcacattactgcctccatttcctttttgaattcctactgatgatgactgagccacttcatattcattttctgtgtcaggataaaatcgctcatctcagctcagtcatccctaattttcttaggtttatgacagaaattgcactcctaataccccacctagtattcagtttcctctccgtaaacatatacccagtcttcttttctccacaagtcattctgacttattcatctattcattcagcccagtctgaacgcttgaagaccgtgctagcaaagcaatgagcaaagaaagctagaaaccggttttcatccttctcacatgattccctgaaattcacccctcttcccaggaatataagtgtttcaaatgtttttgagtaacggtgccagaacgtgaatcaattacatcataaaacaggcttttagttcagctgacattttttcccctgtcacaatcctttctcgatgaaggaatcagggcgttgatttgccttctggtgcattcgctcctgtttccttctggggcagcccattaagttctggactagctgcttctcgggtcccattatttggagcctctagcgttctaaggcatattattagttttaaatatacctcagtcatatttacattttctttgcgcattccttttaaccatctgggaaacaggatccattctgccacccttcctggagatcacctctctacagaggcggagtatggtaaagcgacagagaaagaggagacccccagtaagagggaccttcagagtcttttctagattgtgcatggctctgtctgtctgtcttagagctatcaaagagtagtctgtattttgcagaaataataaccctcagaatcctatttctagctgtctcttcaaaatcattactccccattgtaggctttctatgagccgtggactgtttcagggctgctttgtatgttatttatacatctcgtaggtaggacgtggctgattccattctgagtggatggtttagatcgttgtttactctgattagttgatatttgtatcacagtagttattaaataatgtgaatagtgcccttcactattctgaataccctagatggtgtatatacatatatcatttaattctcaaaagagtagttgaggtaggtgttattatccctgttttacagttgaggaaactgaggcacagagaaggtaaatgacacacagtctatggcagaattgatgttcatacccagagcttccaggccattcaattatgccttgctactttccaagccctacaaagccctttttcagttctcagtatgcctaaggaatttttttgcagctttgtttactagaaagttctctcagaaagcctccttcttgaagaccagaggaaggaggtttaatcagcttccttgtgcagaggactccagcttcctcgttagtcttttatgttaggaagaaacagaggtgcatctgtggcagaagccaactgctgcagtctgcaggcatctttcaagatgcctttccttgaagcctgtgggccggcctctgtgatgggagctaagctgcagtgggagctaagctttctttccatgtctccccttgcctggacctcatcttattgccctgacttatgatatatctcattctcttaaactatcaggttccatcactcaaaggagcacaccgaaacctattctcactgatctttctgatgctgctggctcctttaaattcttagcatccttaaaagaaattggaaaatgtggtcgtctggggctgtgtgctggctctggagggcttcctcagtcaatgtcagccatctagcacttgagtcatcagagatcgattagagggggaattgggtaggggaaagaagagggtgacatttggttattagttgtttttttttttaatttttagaaattcaggtgagattcacaaaccatgcaattaaccattttaaaatgaacagttcaggcaggatgcagtggcccatgcttgtaatcctagcactttgggaggctgaggtgggtggatcacttgaggtcagtagttcaagactagtctggccaacatggcgaaaccccgtctctactgaaaatacaaaaattagcctgtagtcccaggtactcgggaggctgaggcaggagaattgcttgaacccaggtgacggaggctgcagggaggtgaaattgtgccactgcactccagcctccagccagggtgacagagcaagactccgtctcaaaaaaataaataaataaatgaacaattcagtggcatttagtacatttagaatattgtctgaccaccacctctatctagttcggaagcattttcatcactccaaaataaaaccctgtgcccattaagcagttactgcccactcccttctctttctactcttggcaatcaccaatctgctttctgtttctgtagatttacttattttggatatttcacataaatgaaatcatacaatatgtgaccttttagtcagacattcatgtagtgtaatgtttcaaggttcatccatgtcagagtatgtattagtacttcattccttttttatgactgaataatattccatttatggttagatagcccacattcatctgctgatgagcatctaggtttgttcaaccttttggtgattgtgaatagtgctgctgggaacattcatggacaagtattcgtttgagttcctgttttcagttattttggggatatacctaggagtcaagtggctgggacatatggttgttctctgtttaactttttgtgaaactgccagaagactttccatagggcctgaagcatgggccattagttttgatagagatctttagagcagacatcaatgaagtcaggaaaggacatatgactgtctctatagaaactctgtgcatcttggaacaaggctaaaaatgtacattaggatgcctttattgagaaataaaaatatggctctgtatgtgtaggggcagaggttttttttaatgtctccccaggtccatctcccactaggatgatggaaataatctcttctttcatctctatctctctggccttgtccctttctttccagtccttctcttggggtggtttcctctcagaagactattttctatttttattttattttttatttatttattttttgagatggagtcttgctctgttgcccaggctggaatgccatctcagctcactgcaacctccacctcccgggttcaagtgattatcttgcctcagcctcccaagtagctggggctacaggcgcgtgccaccatgccaggctaatttttgtatttttagtagaaacagagtttctccatgttggccatgttggtctcgaactcctgaccttaagtgatccaccgcctcagcctcccaaagtgccagtattacaggtgtgagctaccgcacctggccagaatactgtctctttaaaatgcaaatctgatcatgttatttacctatatgaaacccttcagtagtcctccatggccttcagaacccattgcagatgcctttccttggcacatcaggaccttgacatcatggcccttgctaggacctcagcctcggcttctccctctttctcacagccatccttgcatatcagccacatcacctacttggtaggtccctgaacggaccatgctgttttataccttcttgcctttgcatatgtgtcttcttttggctaccgaactaactgttccatctccttcaaggcctgactcaacatcacatcctgccagaagcctctcataattccctagtctgaacttttggtactttcctctgcactttaactccttgtttgcttctctgtatcttttactaggctccgtaagggcagggatgcttactctgtttagtccatcatgtgtctgaaatacctgcagccttgcttggcaaaaagaaactcacaaagtagttgttgactgaactgagtgtcagtcctcttaggtcaggatggcacttttttttttttgttacctatttattttgatacctatttgaaagcaataggtatcatacgtgttaattgaattaaagtatggaaggaaagaggaagggacaaagaaggaggaagtcagggagaaaaggtaggaagagaagaagaggaaagaagaaagcaggtcaggcaaagaaaaagaccaaaaaccaaaaaagagagcaagcagaaagaggtaggggaatgaatgaaactgggaaagacaggaagtagataccaatgacatctacctttaaacaaatgtactatcattcaatttattctctagatctcataattactacattaaactgtgtgcttgcagagtagaagggtggaggagagaagctggagaagtggagggcttaaatcccaggaatgaatgcctcccagtcccaccttattccacttacactctgtactgtggccaggggcaggggaactagtagtttcaaaatacccaagggtacagggcacttggcaggaactgctgcttccattacatctgtcattttagactttttttctttttttttttgacaggatctcactctgttgcccaggctggagtgcagtggcacgatcttggctcactgcagcctggacttgctaggctcagatgattctcccacctcagcttcctgagtagctgggactacaggcatgcatcactatgcctggctaatttttatattttttatagagacaggagtctccctgtgttgcccaggctggtctcaaactcctgggctcaaccaatccaccctccttggcctccaaagtgttgggattacaggcatgaaccactgcacctggtctggactgtttttaggaccttcaggtcagagcacagaaagggacattcaagactgaagtgggagtggctgtcttctgccttttgcttacctgttccaggttatataatttgcacctttgctagtgatgccactcactgccttttgattgcagctaaactgcaaggctcatttaggaaatgctggctttggggtaggagagctttttaaatgtagatctctaagaaaaaaatgacacccggtttgttcctagtttctcatgagagattttaaggcaaccaatccaaatgcaataaatacaccaatgacactatcatccatacccacattgccttatgcatgccaaaaactgaaagcccaagaaagccgccaagtgagtcattggcttcttgaaggcctgagctcctcagtggagcaccagaatgccctcgcctacctccggcagcctcagccaagactcctcagtatgccatttctgcactctggtttgctttctcttccctttttaagctactgctgcttgttttttataaaccagggacttattagccaacaaatagacattctcataatagtgagtgaaatctgatcttatctctctttctgctgggctccggggcaggtgcctgcaggaagtgctgggtggtctcagaagaggcaagtggaactggcagtgtccattcccaaatagaagccttgctgccagacccggacgacctcgcagctttttgcaaatgaaagaaccttctccctaccaagggagccgtgcagtaaacgtttctggcagcgcttttgaaaagtgcatagacattctcaggccacttgggacctgtttctgaagttacttattctatgtgtgatgcggaattcttatagcagcgactcttaaagtgtggtccacaggccactctgcaatagaatcccgtcccccactccccctgcctagggaaactggttaggaatgcagtttctagaactccactcagaatccgctaggggcagcagggagcagtatatttaataagtaccccacgtgattcttctttgccccctaagttccagaaccactgttttgcaggtttacagaacagcagatcttgaaaggcaagcaagccctggacatcttctctttccatcttctgttgcctgcatagccccatccctgttgtttcacctgggtgaccctgtgttacaggatgacgctaccagccatgaagtgccttctgcaggctgtggagggctctccttctggggatccggtttaatccattcttttcatggggttgctttttctgaggactgctcttttttttcacattgaccatacacagaatgtttttcatctggtgtctctccttggggaattggactgaaatcaaatttcaggctgtgagcacatgtcacaccaggatttatggcacaggacaccagaatttactcagattttgttttctaaaggactcagaatcaccgtccttcagagtcataatattccttccataaggatctattgaagagattgatgaaattgtattgatgaaatttcatcactgaaatttgtatgaaatttgatgaaattataagagagaaacagcttatatccctgggacggtgttttcttttttctttctctcctccccatgggacatgctggccctgctttccaccccattgtaccaggtgccttgtgccctgctggagccctggggtgctcaggacacaccctgaagctctgatctttctctgctggttgtccatcagaatgtgtctgtcatgtggctcacgttctcagaattttgctaaattgatgatctcattatatattgttaaggaatgctaatggtttaaagtgcatccaacagccttctgataacatttgcatctcagtaacaacctttagtggagtgagtaatgtaggattttgaggccccttaggtgactagccatcagggtttgcctgggactgtcctgtgtcctgggaaacactgaagtcccaggcaaacaggaaggttggtcactgaagcctcattgggagcctttttttttttttgcgacagagttttactcttgttgcccgggctggagtgcaatggcgcaatcttggctcactgcaacctccacctcccgggttcaagtgattctcctgcctcagccttctgagtggctgggattacagcacccaccaccatgcctggctaatttttgtatttttagtagagacagggtttcgccatgttggccaggctggtcttgaactcctgacctcatgtgatctaccagccttcgcctcccaaagtgctaggattacagccgtgagccaccgcacctggccttgggaggcattttattataataataataataacaacaacaatagtagcagcagcagtagtaataataatagctaacatttatgtagtgctttgtgccagtgctgttctaacttctttgtatatacacacacgcgcacacacacatgtaattctttttttttttttttttaaagacagggtcatcttgctccatcacacaggctgaagtgcaataatcttagctcactgcagccttgaactcctgggctcagctcccgcctcctaagtagctatgactacaggcgcgtactattgctactttacatatattaactcatttgttcctctcaacaaccctacgggctatgtactaacattatcgccattttaaatttaaatttaaatttatttatttgaaacagggtttcactctgtcacctaggctggagtgtggtggtgcaatcacagctcactggagcctctacttccagggaccaggtgatcctcccacctcagcctcctgagtagctatgactatggcacacaccaccacacccagctaatctttataatttttgtagagacaaggtttcaccaccttgaactcccgggctcaagcagtccccacctcagcctctcaaagtgctgggattacaggcatgagccatcatgcccggcctatccccattgttaagatgaggaaacagaaatagagacacccctgggcaagtgcaggcaggagaggaggatttctggaatttctaaagttggcaggagtctgcctgttctacctgtgtgtaaggctgctgtgcaagaggtagtcctgggataaaactatcttcaaaacctgagtattttccactatcccagatagctttccttttgatgaactttttgtttgtttggaaatcattttaacaaacaaatacattgagacaccgagtgtctcagtcacttattgggactaagttcaatatttactggaagttctactgagaacagagaaacccagactgcaagcgaagcttacacccctaccccatctcctgtgaatagctaatgaggaaatcctgacattttatgttatgttaatgtattatgccattttcttcctattcttattaatattggcccaatctagaccctattgtctcacaactggattactgctacagcctcatttttgacttcctgggttctagtcctcctcctcctcttctttccaagaagacagtttctgctagaactgtcttcagttgtaactttttgttgttgaaacagagtcttgctctgtcacccagcctggagtgctgtggcaggatcttggctcactgcaacctccgtgtgccgggttcaagcaattcttctgcctcaccctcctgagtatctgggattacaggcgtgtgccatgacacctggctaatttttatattttaagttgagatggagtttctccatgttggccaggctggtctcgaactcctgacctcaggtgatctgcctgccttggcctcctcaagtgctgggattataggtgtaagccaccacacccggccttcagttgtaacttttatcatgtctctctcctgtttaatacctatactctctttttcttccagatcagacccaaataactcaagactaattttttctgtctactgtattctcctgtatttctcatcataggagctcagcactgtaaaggactttagaaagtacaatcccaggccggacgtggtggcttatgcctgtaatcccagcgctttgggaggctgaggtgggaggatcacttgaggccaggaatttgagacaagcctgggcaacaaagcgaaactccatctctacaaaaaaagttaaaaacaaaattagccaggtgtggtggcgtgtgcttgttgtgtcatctcagctacttaggagactgaggcaggaggataacatgagtccaggtgttcgaagctatagtgagctgtggtcactccattgcactccagcctgggcaacagaacaagaccctttctctaaaaaaaaaaaaaaaaaagaaagaaagtataatcctgtatccgataatcagtgttccacacaaaccatcattcaggggcaatttttaacacctccaatgacaggcaacttatggaaacacatttcatttacacattttgtcagaaagttctttcttgaatgtaggtaaaattggagtctctaataattgttcatcagcctttgttctgtccttttttcatctgccagcctctgaatatttgcataaggctatcatgtgttgtcttctccaaatgatgcataatcagtttcttcaaatgatcatcaaaaatcctttaccctcctggctattttctggaggctttcccagttggtggagctcctcctaatatgaggcacccagaactggacgaaccccttattagcccttggaagtgggatgacatgattaatattagtcagttaaaaccacattccctttcaatgaatatttgtactgcttttaagccatgcctttcatgactgtacttggatagttttttttttcttccagaaataagtgcattaatctgtacttactccatcttatccaatctggccaacattttagccagaagacctctttatagattttccatctgtcatcttatgtgtgagtgttctcttccagtgtcatggtcaaccctaaatttgatcatggattccatttatgttttcagcaaagcttgtgataatgacaatttgggcagaacacatttcagaaccagcagcactattgggggaaccctcccccaatatttcaacgtaggttctttctattttccataagtgtcagctggctgagaaataaagagaaagagtacaaagagaggaattttacagctgggccgccggaggtgacatcacatatcagtaggaccgtgatgcccacctaagcctcaaaccagcaagttttttattaagggtttcaaaaggggagggggtgtaataacagagagtaggtacaaagatctcatgcttcaaagggcaaaaagcagaacaaagatcacatgcttctaagggaataggacaaagggcaaaaacagaactactgataagggtccaacaaagatcacaaggcaaagggaaaaagcagaactactgataagggtctatgttcagcagcgcacatattgtcttgataaatatcttaaacaacagaaaacagggttcgagagcagagaaccggtctgaccataaatttaccagggcagagtttttcccaaccctattaagcctgagagtactgcaggagatcatggcatatctcagtccttatctcaaccgcataggacagacattcctagagcggccgtttatagacctccccccaggaatgaattcctttcccatggtattaatattaatattccttgctaggaaaagaatttagcaatatcttccataattgcacgtccatttataggctctctgcaagaagaaaaatatggctctttttgccggaccctgcaggcagtcagaccttatggttgtcttccttcgttccctaaaaatcgctgttattttgttctttttcaaggtgcactgatttcatattgttcaaacacacatgttttacaatcaatttgtacagttaacacaattatcacagtggtcctgaggtgatgtacatcctcagcttacgaagacaacaggattaggagattaaaataagacaggcataagaaattataaaagtattatttgggaacggataaatgtccatattaaaatgaaatcttcacaatttatgttcctctgccacggctccagccagtccctccatttggggtccctgacttcctgcaacacagcacagttctagataactatggatctagatctatctagatagcctggtatttgttacagtggtaggcatcctgtgattgttcaggcactggagaatctatctgttcacacagtttgtgttttaccatcttgtgaatgactctgttaaatgtcttgatgagttctagatagcatttcttatagctgacttagaaaagaagagcattgaaatcatggtggagtccttgctgcctagcatcccctccatgttagggttactttggggccttttttcatcctttctgtctaaaggctctctttttttcattttttatttacaatcatagtattatcttccatggccagaacagctgtatctccttcaagaagccagcactcactcctttccattaattctaggcattaatttttggtacataacacaatttagcacataaccttaaggtgctttgcattgtttgtacattacttggtattatgtgtatgtccaggatgaaatgcacacttggtaaatacctgttggatgaatgaaggtaagtcttatcatcttgatcagaccatagcaataagattcttgaggggagatgctagtcttacaattctttttttttttcccttttcaaaaattgagacgaagttgggcacggtggctcatgcctgtaatcccagcactttgggaggctgaggtaggcggatcacctgaggtcaggagttcaagaccagcctggtcaacatggtgaaaccctgtctctactaaaaatacaaaaattagccaggcatggtggcaggcatctgtaatcccagctactcgggttgctgaggcaggagaattgcttgaacccaggaggctgaagttgcagtaagccaagatcacaccactacatttcagcctggacgacagagcgagacgcaagctaaaaaaaaaaaaaaaaaaaaaaaaattaaccattttaaactgaacaattcagtgcttataatttaaacttttacacaatgcatgacaactggacagaagatgctcaaataggcatttgctaacaattacctgatggttcctccatagcatgctgtgactagatagtaactaataactaattacccagatcctttgaaatggatttataaacatagccagttttttacttttagaaactctaagttgtagactctaggaagccttattctgaaagtattagacactcccatgccatagagacagagagttcttctggatgaggaagtagcacttagaaggtacattcccatttactacctgcaaggaaatgtcaaaaatgaacccagccagaccaggactgagttggacaagagatactctgtttcggctgttttcctagtctatttggacagcctaaaagaagagcactatagccctggtgacaatatattcatgcatctctattccaagatcctttataatcataccaccatttggcaaaggtatgtttgcccaccatagacagttaatatcacataaccctcccttgtattccttaatgccttatagttgacaaaagatcttcacctcaaagattacccccattttatacatgaagaaattgaagttccgataggataaatttcttgcccagagcccaactgttagtatatgttgaacctgagacttaaattcaatcctgaacctcccaagtctgtggatgtcctgatgaaactactagcactcagatgtgcccaagccatgaggggtcagaaatatggcttcctactccagcatactgttttggagaagcagttttagcaacaattttctatttcctcaacacttaaccctttcctgcctttttacctttgctcatgtcatttctctcttctggtaccacttacccattttctgtataaatcctactgaagttcagaggttcctctttgggggagattctagaaattcaaggaggctcctgtgtcatgctgtttggtttgaagttagcaccttgtacctcatgtctccagtatatagagtaaggactcagaacatgatctgtttataaatgttacattaactagaaagagccatacctcttaagaaaacttgattccattattattaatctgctttttgcttgtgcacatatatttatgttaacacttgccaatcatgtagataaactaagaatcattatttgggcaaattttattaggctagaacaatttttttagattgatttcaaaactaacgagtaaaatttagaaattaggcagatttttggatataaaattttatatacttctcagccaggctcttataaaagccaaagaggctaggtttttttttctttaagaaatatgaaatcatttttttccatatttgtttcttaattccttccatttgtgtagcttttgtttttgctttcccaagaactttcataacagggtgaatttcaccattgtctagattaatcagttttttgggtagtgtggggtgctagtaaataagtgccttgggtcactgcaaagagaggggtattcacatggagcagtttggaaggcactcagcaaattgttgggtcatgggtagtcactttggtgggctcattccagcatgcagtgcccgtaactatgggtgcaagttcctcacctgccagagagaagagcacagcccagagacagagggagattacagaaatggtcacgggtgatgccttgtctggggacttccagaccttttcttttaaggaaagtccttggccattttcatttattttgcatggaccctcaggtctgatccccttgtctggggcctcctgcaaacctcttccaaggtcaggccttgtttcacctccactcctcctgactctcaatggtaggtgactgtcctctgctttgctctttgaacatcttcctgttgattttcaagggcgctttattctctcaaccaaacccactgctttaaaacaagcattttggctttcaaagctgttgttcgtggtgaacaaaaacacatggtgtataaaaacacaatcattttggaagtcaaaactgagggtagactcttttcttctccctgccttcctgctttttggatgccagtaataattcctcttgaagcactgtgggtgctgctgactgaggaggagcatctccaacaaagaagggcaaaaaagaaaagccaaaaggttaatgtcttgcaacaatatccactagctttttttgattctcataggagtacacagggaaggtattatatctgcagatagagaaaggagttgtgagatctgacagaggtcccagagccaacacggcagagctgatagaacttaaatttcctgattcccaatccatctctcctttcaacagaaatccatgccagttcgaatccttgaacctttccattgtatttacaacaaaatcagacatctgatgctgtgtttgcaactatgttaccatcccttccccccatgctccaaaaacaagagaattgctgattattcttatttttgtgtattgggggtaggagggttggtgaggagacgaagaatagcagtttagcctttctcatatttcaaatgactcattggttttttaaaaaaatcttgtattctcgatgacattctgacatccaggtaaaactttgaaatgacacgaaaggtcttacttacagaaatccagcctaggtgaaagtagaaatgaatgactttccaagcaccaatgataccctgtgctcatctgtgtgcaagtggagcagggtccattccttcctgacaccacctctacacccagatacaacactactctggaaagacacagatgggcaatggaaactttgattggggagggtgtcatataactcgtcagaggctaagtaagtaggtccaagatttcacaatgttctatttcatattcattctaaatagcagatgtaaatagctatattcccatgtctgctggacagagttgacatagttggccaggtggctctattagcacattacactttgagagaagacctctggcaaggtttttactctccttattaactaacagttgctgagaatgtgctacagtttctttaagtcaaaagcagtgtgtttattattcaccatttctggtacatgaaagactcaggggacatgatagctgtcttcagctctttgaataattgtcatgtgtaaagggtgtctagcttattatgtgggaactcaagatattgggttaggaccaatggatagaagtcttagggaggcagatttttgtaaaatataagaataaaatttcagaacgttctgaaaatggaatgggtgggttcctcagccctgcagatgttccagcaaaagctggaagaccacttggcttttattatatagatggaattcagttctttaattggcagatgaactctctaaagtgccctctaaccttgaaattagtgatcatgtgtgccaattagaagtcggactttggaatttgaccattacattggtggccatttagcagccatcaaatatggcaccatgacatgagatttcattgttccattgcaaatctgcaagtcaccacttatccactgtctacagaaatggggagcatgaatgacccccagcagaacattccccagattgtagatgtagatgtgatgcactggttccttagaaaccttgccagctttttctgatttctgagctggtaccattccagaatatcctgtttatccataatatgcaaaagcacatgtcaaatataaataaactgagaagggcttccttctttttgggaggccttggcatctcagatccctccctttatctccaggtagccaggaagtaatctctgagttaatagctgaaaaaaagcttaatataatgcctctcccagagttctttgcattttcatagtgtaaggcagcattaaatgaaactctaacacttaaaaagaatacttcaccaatggtagagcttgaccctgggactggcagaaagagatttgatggagagggggattggaaaggagaagagccttcctggcatatagttattacacccagccacttacaaggcctgctcggataggaattcattgaaatgggttaatttcagtggtttccgatgagaaaacaatgaatatggagtggtacttatttgttgctgaaactgggttgaaatgtaatttgtgccttttccatgactactgaatgtctcctctgagaaggcctctctgagtcctacaaagaaaacttattcagtgagacgcataaaaataccaaatacattctcatgtaatggccaccataaatcaactaaagcatcttcaatgatttatgctttgagagcccagagagcatttataatcttgaaacataggagggtttttcgaaggtttgtagtggcagttctggttcatgttagacagaatcatagtggtctgcagggagagaatctcatttttactgatgatgtaataggcattttgttttcctaatgagaggtggtccgggccctagggcattcccaaccacgtattactgggagagaaagatgaggaggaggctttcacctttgtagacctgctccctgcaaggctgccttttatccctgaaggaagcaggtgataggcaaatgaccaaggaattaaataccacaggacatccgaggcacagaacacgttcatacacagagctgaaattaaacaacatgatttcattttcagcaatcattttcacaacatgacacagccttttactattctttgtagggtgggaaccattaaagcaaagttatttgtacaagatttctttggagttctgactaccatttcatgcttctttggccaaggtctttgactgagattccctaaggaagtggcaaagaagcagaatgtgctatgatctctgaatgttcctgggagcctaaacatgatctttccttgcaagaaagtcacagttctctgtgtaataaacagagttggctgctccccagaattctccagtcaaggattactatctgcgagctgtttgaacttctgctccttgggaaattaaggtgggctttctggcactctgcgttatgcaaaagctgtttacatttctgtttcaaacagcacagaaaaatccatgaattgcactttacaactgaaatttgttatagactgagttgcttagttgaccaaatcttgggaatcttaaagttgatatagttttgtttgttagttttgtttttgacggctggtttaagacttccttcattcaccagcacctgaaaactaaatctatactagtttgggaatttgaaaactgggtagattcagttataaggaaaattataacaaaaggatttagtcttttggaaagcaatccagatctcctttgtctaggcattttatattccttgaagggaaagctttttgaaaagttgatacttcagttgaataaaagaacacacccgatcttgaagaatatctaatagccttatcaatgctatttcttcaaatgttatcagaagtctcatgtttatattgacatttcatgttttgataatttgtagtagaatgtaaacacagaataacttgaattttcttgagtgagttcagcatctgcattcaagtaaagtggatttctatccgcatatggatttgtctgtaactactgtaatgattgtttctaaaaatttagttatagtaacacagtgtgcttcgctaggttcagataaccaggttgtatttaggctgtttttgtgttaaaaataggaaagactacacaggctaaaaatcaaagcctaaatttcacatattcagagacaacatgataatttccatgaattcggcctcatgctaagggctttgatgcattgtctcacttttactcaagaaatcctttgtggtatataagtgtaataggagttgccttattacgaatgaagaaactgaggcttagaaaattagtcagatatccaaaggcaaagttaataagtagcagtcaaggatttaaatcaaggtctctgattccaaaacctgtcactcttcagtttaagaagcttccttccatctgcacaagaaagccttgtttgaagctgtataatactatgcaagtgagtcattattttgaagtactaatggttctaagagttctaccttagttaatcagccagtcaacagacatttatttttcactcacttgtgatgttccaggtgagttctaggaaggtacacagatctctgtattaactatacaaagaaaaacatcactgctacctttacttggaaagtgtgaagcaaatatgtgtggcatattcatagtggatgtgtgtgtttagtcataacatgaattaatcaacagttaatcaatgcatattattgaatttctgtatagaatgtggatcatagaaatggtaaataaggattttttcttttttttgagatggagtctcactctgttgccaggctggagtgcagtggtgcgatctcggcttactgcaacctccgcctcccgggttcaagcagttctcttgcctcagcctcccaagtagctgggactacaggtgtgcaccaccatgcccagctaatttgtgtatttttagtagagacggggtttcaccatgttggcaaggatggtctccatctcttgatctcgtgatccgcccacctcggcctcccaaagtgccgggattacaggcatgagccaccgtgcccagccgtaaataagaatttttaactgagtctcacgtctgtcattcttcagttctggactttagctgagttacttatgtctttgaacctttgtaaagtggaatgagatgaacgagacaatgctgttaagcacctagaacagtatctggtaggtggttggctgaaaaataaagcactctgccatactttgcccacttcacctgtgtatccaattggatgtgtatctgtctgtaggcatagcctcccctgaactctcactggcctctaaatctgaccaagcggcgacattcacttccttggacatttttacatttcccaagtttacaaagtttacatgacatagaaagagagcagaatagtcttggtttcacataggtaacactccctttcccttttgtcccctgtgatcacactggtggagacagtgacctcaagttcttattattcaacctagaaagcagctagctggtctttccctcagggccggaaaacttttctgtctgcattttgcaaactttatatagttcagctattccttccttctcaggcaccttataactctcttcagagtaggacaggagtgtcgtcagggtgttgtcctcctcaggcttctgattctatagccatgagactgcagatttcatattccacagcagtgcctgctttaatgaatttgatcactgaaattttatatattgagttgctatgtcttaggaatagctgccttagaaaatcttatccatcatttaaaaaattgcttcaatagtttctttaatgtgaccctacaattttttttaaaaccctcaaaatatatggagtttgatatcaagtgccagtacaacttgattaaagaatgaaaatattgcaaaactgtgctttactgaccatggcaccaccttctgggcctgtgagggggagcctgagtagaagtagtagggtctggtggttcacacagaagacttgatgttgctcagacccagctttgagtccaggcttctagttgtgtgatcttgaatgcattgcttggtctttttgagccacagtttttctatctgttacaagagggatgacagttacaataaaaccaacaccctcaaaggttgtggtgaggcatatataaaataatgcatgtacagctcaatgttgattatttagtaaataatcaaaatactagctcattgtaaagtgagacatggtcaggatgccttactgtcttttgaagagatggcatgtgtccacagaacaagcagagaatatcctgttaataacatgctaaattatgtaaaatatctaataaggccaacatcgagacactgagatttctagtttaccttattggatactattaggttggtgcaaaagtaattatggtttttgctttttttttgtttttaatggcaaaaaccacaattacttttgcaccagcctaatatatcagtttcttggagctgccataacaaagtaccaccaactgggtggttttgaaaacagaaatttattgtctcacagttctgaaagctacaagtccaaaatcaaggtgttggcagggccatgttccttctaaagcctgcaagggaaggagcctgcctttgttcttagagcttctcatagcccaggtattcttggcttgtggcagcataatggtgttctttctgtgccactttacattctcttccctctagtgtctgtccctgtgtccaaattccccaaccccccaccttttttttttttttttttttagatccagtctctgttgcccaggctggagtgcaatggtgcaatctcagctcactgcaacctccgcctcccaggttcaagcgattcttgtgcctcagcctcctaagtggctgaaattatagttgcacgccaccacgctaatttttgtagttttagtagagacattttgtcatgttggccaggcgggtcaaatttccccttttaatagacaccaatactggtttagagcccaccccaatgactgcatttcaacactgattatctttatagggaccctgtttccaaatcagatcacatctgagatactggaggttaggacttcaacatatctttttcaggggacataattcaactcatatcagatatgtgttctctagcattgtctataacctcgagctccactggtgaagctccttccctcttgtggggtatatcgactgctattaactggatatttcagagtttatgggtcatgtttcatctgtagccttgagatctggtaaaaatttgtcatcctggcacagattctttcttccaagatgtgttactttctcagtggcccattttactgagttcccccactcttataatttgtaattttagttatattttaaaatatatattttattacaatttataaaagttatttaaaatgtttttatattttatgtgcttattgtaacaactcagtgatatataaaagcaaaagttagctgtctctccccagcttccttccatttttatcttctccaatattaaagtcaacattaacagcctggtgtctctccttctgtatgtttcttcatgctcaatcatgtgcaaatacctcttgtcatatttttggttgtttatttttacagaaaatggtattgtgtcatattcatacttagcttgcttccacatcaatagagggagagttatctctctttaatagttgcataatatactggtatactatagttttttagtcgttaacttactaatggaaatttagattgccatttttccattttgagctgtatgaaatgttgagaagaggtagaactcatcttttttgtttgcttactgtgcaacttgaacaatattatttttaaagaaaaaaaatcctgaaatgtcagttcttaacagttacaggaatatctagaaggatttcctagagtgatgaaagaggtcacccccccattgccacttggttgccttatgccttcataaaaatgacagagagttcctgggaccaagggggagcttccaaatgtgctttgggagcttctttgagcctgtaatttaatgatgtctgaatgtcatgaatttgatgttgccatgttccttttgtgagcctgaaagtaagcctttatgtgtcacatactacacatgctgttgccaactagactggataagcaggccattcaggaaaaataattagaacacagtaaacagaccctggattttaaagctaagcttaactaaatgttacttgccactttagggcaacttcggggcttagtttgtctatagaaatatcagtaataggcttccagatactgtattccagtgactagttagcattactcatataaactggttctacttttggagcaagcacaggacagattccttagcaattcttgatcaatagccagctggtatactgcagtgacctgggataacctgagaattcaaccagaggaaatgggtttataggtttatatattttaactgatgaaacagaaaatgggggaagagggagtatgccttacttagatatggttctggcatgttttgtgttttctgctttttaaaagatcatgataaaaacaaacttcaaatagtgtagaaggatatgaactatcaagtaaagatctagagtcccataattctaattcccataagtagttgataacaaccacttcctatcttcatgatgtattaagtgggcaaatgaatgttgtagaatattatagagagtattatgctacatatattacataatgaactatatgtaaatattacatatatactgtatgtaaatatatgcatgtacatatacatacatatgtaaaaataaatgggtttaaaaaataaaggagtatagagtgttctggaacttttccttttcagtaaacaatattacctttaacccatttccatatcagtacttctagatctaccccattgttatcagcttctgcctagcaatcctctgctgggttgtgtcataatatttgtttcaccaatcccctactaatgagcaggtatgcagttctcagtgctttgcaattacaaccaatattgcagataacatccttacacaactatctttgtgcagtcatgtgtattaaattttatattgacaaattcattcatgatttttaagacttcaaggatttggatcatgctttaatactccccatatcaaaaaattttagttttatatactttattctgacactattttagtttaatttttttaccctttaagtctttaggagaataacaaagtaggaatccaccctaactttttcgccccaaaagccagccagcttttgcaacatctatcattaatctgtcatctccttatcccacttcagttttgaagagcttcatttaccatattcaaacacccatatatgacacgtagaactttctctgaactctgtttagggttattttgtctgtttctgggttagtattaaactgtttcaattactgtagctttataatacattttcatatttggcagggttagttctcccattcacttattttttcctgacagttttcctggtctttatcacgaatttatttttctgtataaatctgtgtatgattttgtgaaaatgttccccaaatcttgtttgtattttgattatgattatattaaatttaatatgggaaagattatatttttattatattgagtcttctcaccctagaacaaagcatgaccttctattcaattattttatgattatcaggggagatttgtttttcttcatatagagcctggaaatttctccccaagtattctacatattttgtttttatcctaaatggttgctgtttttttctctttgtcctctgtcaggttattagttggataaaaggaaacgattagttttaacatattaatgtagtaatcaatttatgcagttcttagtttttttagttgatgctcttggaattcccaggtatacagtcatattatctgcaaataatggtaattgttgccccttcctttccactatggagatttattttccatgttgataaatgttgtgtgctattacagaacaaagacaatggtatcttttgtttcctaattcacataggctaatgatttcaaactgcaggttataacccatttgtgggtcattaaagccttctggtatattatgaccagagttttttaaaaatgaggtaaaagtagaatagaaaaatatcagagaacattacatatagtaagggttatgagtcttaccttttagttttacgtatgtgtgtgcatttactgggtcatatggtaaaatttcttactgtaagtggcagtaaaaatatgtttgaaatgtactcatatcagtgattttttttttttggaagttacagatacttttcctcatcttctggaagttagaggatagtgtctcctcttggttccatctctccttgcttccccctgagtagtaggaggactgagtagaattatgtaagcactgtgatggcttttcagccttagatggaatgacagtaggtagccaaagctctgggttggaatgcaatatcttcagcagaatctccacgagttagagaccaaagccagcttactgaaaagaggcagaaagtgaagaactatttgttgagttcagacagtatagtgagtgagtccatttgcattatgttttttttttttttctttttgagacagggtctcactctgtcactcagcctggagcacagtagcacaatctcagctcattgcaacctctgcctcccaggttcaagcgattctccagcctcagctgggaccaccggcacataccaccatgccctgctaatttttgtatttttttagagacagggtttcaccatgttgcccaggctggtctcaaactcctgaactcaaagtgatgtgcctaccttggcctctcagagtgctagaattacaagcatgagtcactgcacccagcctttttgtttgtttgtttggaactatttaccaaacgaagcacagagattgcatatccacagcttgatttcgcaactacctttctgactacttgggcaactcagtttctcaaggaggtagaaatgggtgagatataatcagggtgtaatcccttgagagttatcacacctgtccctttagggactgcctaccaaacacaaagggatgtcctaggaggcacaggaataaatgaggcatggtccttgcctttatggggctgcttttggttctgttacattagagttattcagacacttctatttagtattcaggtatctacaatttaacacaaaatgtagaaagcgctgtaaaagggagcatcaaactggtcaaaagctcctgtttgtaagtcgatagtcattcagtaatagaaaggtattcttttaaaattaggcaatacatgactatcatttgcttttatactctttaatggaaatagatagctgttcatacttagagttcaaagcagccccaggaaccaggttctctgccatgccctgagcagccggagctgatggagcttctctctgatgtgcagcccttcacatggccaagtctgctgctggttctgctgcctcatacccagctccagcttgtgcttactcacagcccactcctgcctctccattctgtggcctttcagtttctgctgctgcctgcgcaaagattttcctttttcttatgtttgactctcaagaaagaaggagtgaggggaaaagcagaaagcagaaataaatctgtctggtcaagctcaccgctactgtgccagagctttttattttccagcccatcagcctctctttgcagtcttgctgttctgttgcattgtcttcacttgcacaaccctgattatatccaaccctccacctactcagcacctgcgttgctgcagctggataagacttgggtgaagcacgcaattgcgctgactcacctgcagttcgtgatcattgatctcaagtgagttttcagtgctgttcaccagttgtgttacccctcaccagtccattcactgtgctacttttctagacaaccaatttgttcataccttctgctctttccccaaactccagcacctcttcccccatcctcagtctcagctgatgaccttgcttcttattttaatgagaagatgggagcaatcagaatagagcccacatagggtctttccaccacatcttcccagcgagtggctctgcccatattctctgccttctctcctataactgcacgagtggcccacatacctatcttagcccagcctctccccttgtgtgttagattcatctccttgtgcctgctcaagagcattgctttagcagttttccctactcctgcatcaccaatttcccctctctctactgaatcattcttatctgcaatacaaatattctcttatttctcccatgttagaaaatcctctgtggatgtttctttctccttctcctatccatttctgccttacattttcagaaacatttccaaaaaaattcctaacttttttgtgccataaagacctttaatggtctggtgaagccgtggactccttctcagaataatgttttaaagtgcttaaagtgaaacataaggctaaaaaagaaacacaggatattaatatactgatcaaaataactttccactgttgtgatacggtagcatgttacaaatgaagaaactgaggcttagagagttagacacccaaaggcaaagttagtaagtagcagtcaaggatttaaatcaaggtttctgattccaaaacctgtcactcttcagtataagaagtttccttccatcggagcacttgtagagcagaagagcacagtcacatgagacctagtgatgggtacagtaattactgtaaatttgaaatagtaatgagcatgatgttttgagatatatgtaacaactataatgtaatatgaaaatatccacaatttctataggctatgaagtaacagatgctgctattatattattagttgaagaaaatgctgcattagggaggagtcaaaatacagatgtaattttttttccatcaaaatccctgagctctctgaattctatccatagattctttggggaccctcattttagagactctgctttttatagcaaaattccatttcagagtttttctattccctgccttctacttctcttcaccctttattgagtctgctctgatcaggcttttgcccccataatctagtgaaactgttcttgtcagggttgccaatgacttccatattgctgtggcccatgatttgcttgccttatgagcagtatttgagaaaactgatcattcttctttacttttcttcacttgtcttcaaggatacacactctcttggttttcctctggcttttttggcaactagttctcagatacctatactgattcctcatcttctgactgctagattttggagacccagcactcagtccttcaatgtcttctctttctgcctatatacattctttcatttatctcatccatccttgaggctttaaaatattcaatgtattctaacattcctcccaaaattataactttggtcctaacctatctcctgaattccaactgcctactcaatacctccatttggttgtttaataggcaaacaaattaatcatgtccagatctgggttcacctgcttttcctgtggtctttcacatcccagcaagtggtatgtcgattcttctagttgcttgggtcaaacaccttggattcaggtttaactctccttctcacatcctgcatccaatccatcagcaagtcctgtcagttctgtcttcacagtatattctgaatgttacccttctccaccaccttgctgttgccccctacaccagcctctaaggccctttccctggaatttcaccctagcctccccaccctccccaccccctccctgctcctcttttctatccctatatttggatgtttgcaaatcctacaaacaacctatccaccctactcctttgaattcagaagaaatatgcacagttgccaaacaaaattgaaaattcttccaggtaccagggattgctaatgtacatgattccaaaatgatagatgttttcctataagtgacttatggaattcattcagcagcaaaaacattaacttgataggattttaaatgcagctctgtaggtttggtacccatagaaagacagtttcaaaagcatggtacttcaactttaggaccttacttttaaaggacgttcagaaattgtttcacatgtacaaatgaaattgggacgtacatcctccaaatataaaggaattatttctgatatgtgactaccaaataatacaaaatgtgttagctaatagctgtattcttctactgctcattctctgttataaaatcagaaaataatagaaatgcttcaagtagcttagagtgcaggtaactttccttaacaattaattaagtcatttgttcactaaccactgtttaatggcttttatgtgccaggtactccactgggtgctggggatacaaagaagaataaaatccaatggatattcttaaagagatcacagataagtgggagaggcagaggaataaacagctgagtacaatacaaatatgatccatatcataatagaggtgataaaaatggaattatcagctctgtttaaataggtcagaaagtttcatccggaagcattgcgtgggattccttgaaaaaaacgatagaatcattgtcacaatgtgtaaagggtacctatccttaccacacctcaaccgtgttacaaaaaggagttggcttggaattctaaggatgaaaaacagatatcatatgtgttataaacaccctgtgttgaaaaaatgccagtctggcattccagaaagtggaatctgttctgaaacttcctaaaactttctaaggtaaatatattccagaacttctcttattcatccagggattgagaatgcttcttagggattcctaatataagtaattcaccttcatcatattacaacttttctctgtggtggtgtaatatatacatattatatgatgtaattatatatatatactatagcagccatgatggcacacacctgtagtcccagctactcagtatgcagaggtaagaagatccctccatatattattatatgtatataatacaaattatattatatagtggcaatataaattatattgtatagtagtaatagctgcaatgtaagagatttcagaatcaattttctataatctactttaagagatttcagaatacactttgggagggcgaggcgggcagatcacgaggtcaggagatcaagaccatcctggctaacacggtgaaaccccatctctactaaaaatacaaataattagccgggagtggtagtgggcgcctgtagtcccagctactcgggaggttgaggcaggagaatggcatgaacccgggaggtggagctagcagtgagccgagattgcgccactgcactccagcctgggcgacagagcgagactctgtctcaaaaaaaaaaaaaaaaaaaaaaagatttcagaatagattacacgcacgtatgtatgtatgcatgtataaatgcatgtatctatgtaggtatataatgtatcatagagtcacattaaaaaaccagtccctctgaatggagatgagatggaaactcatggagaattactagaaattaccgaattatactgcctgagtatgtgaaagtattaccttgctttaattttactttacttagtgttgggtccatgaaatcaggaaacaatttcccagtcttccacattttagtcgtgaggaaacagatcaatttttagaggtgaggaactttcctagggttacccagccaatctgcaagagggttaggaatagaatccaagtttccttagtcttatggttcttcttgcattttgtaaatgagcttttattggctgatgcttagcaaaaacgtttcccattagaattctgtaggccagtctgaaattatctggccaagactgatattttgtacttgaagaatggaatgtcagctagatgccatccgggcctccacccaggcttcctccagctccctgcacctagtttctataacagcaagtcatgtgctcagcaaggggctacacggggtcatgggcctgctgccaagactggggagcaaagcacggaagttcaagtctagacagcaatgtgttgaaagccaagctagcaggtgagagatccagcacataaataaagaccaagatgggatggcagagtctttaaggacaccctgccctatgcaactgagagggcaaatgaggtgaggtctaaaagcaaagtagtggagtcctctggagtttaggtgttggacccagtttcagaatagaagcaatagctaggaggaggagccaccacatagtctggaggctaactctgacttgcagttgcttttgtttggttgagcatagttgttattatttcttaaaataatgcttacctgaaatactttcatgtgctctccatttcaccatggttccacctgttgcctcacacccattcagacaagtccgcaatgagcccagccttgctgtttcttcagagttctgggtattgcacaactgggcagggagtgagcacagttccttaagacaagctggcaatcctcatagactcacaaatatgaatgtagagagattccaacttgaggttcttttgcagtaggcaaaatcaacaaacgctcagtattgactacatttgatcttttaggaatcaactcaatgttttatgaaactgacttgcaaaattcaaaaggtctaaaaaatattagaatgaaaacaggatttgtgagttttaccagctgctggagtccacaaactgcaactgtcttggtaaatatcttttggaaagttctgattgtcagaaaacttcagactatacatgccaaagatctgatactggaaatgtcatgaatcatataagcccctgcctcacacagggcaaatttcatctaaactcctcatgctgggcagaacaatggctgcccaaagatgtccacatactaatccctggaatctgtgaatatgttgggtttcatgagaaatgggagttaaagttgcttattaactgggtatcatagttcacgcttttaatcccagcactttgggaggtggagccagcaggattgcttgaggccaggagttcgagaccagcctgggcaacacagcaagactccatccctacaaaaaattataaaattagccagccaaggcagcacacgcctatagtcccagttacttaggatgcagaggtgagaagatcccttgagcccaggaggatgaggctgcaatgagctatgatcatgtcattgactctaacctaggcaatagagggagacccccatctcaaaaataaaataaataaaaaggtaaatttacttatcagttgaccttgagatggggagattgtacaggattatcccagtgagtcttatgtaatcacttgggttcttgtgagtggaagagggaggcagaagagagagaacaagagagatggcattgtgaggatgactcagtctgacattacttttttgaatattgtattagtccattctcacactgctataaagaactacctgagactgggtagtttatgaagaaaagaggtttgactcacagttctgaaggctgtacaggaagcatggctgggaggcctcaggaaacttagaatcatggcggaaggcgaaggggaaggggaggcaggcacatcttaaccgtggtggagcaggagagagagagaaaagggcgaagtgccacacacttttaaataaccagatctcgtgagaactcactatcacaagaacagcaagggaaaaatcagccccataatccaatcgccctccaccagaaccctcccccaacactgggaataacaattcaacatgaaatttgggtagggaaacagagccaaaccatatcaaatatggaggaaggggcctatgagccaagggaggtggctggctttagaagctggaaaaggccaggaaacagatcctcccttagagcctccagaaggaacacagtcctgctgacaccttgattttaggccagtgagatacattttggacttctgacatccagaactacaaaatattaaacttgtgttggcttaagccattaagtttgtggtcattcttacagcagcaataggtaagtaataaactcttagatgaagaaaggtcagtgaggcatgactagattagtgtggctcatctgctgtcgttcatgttgttttaaaccaagattcaccatttgatattcattatttggcatttgcagctgtcatcattttttagatgatgaaactatgccttgttttcatgggataatgtttgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggctgcagtgagccaacattgtgccactgtacctccgttgtggacaacagagcaagaacctgtctcaaaaaaaaaaaaaaaaaaaaaagaagaagaagaagaagaaaagactctagactggtaaagtaaaaaataaacataaaatgaaatcattttactattgttctattcctattacaatagaaatagaaattgttctattcctattacaatagaaatagaaattgttctattcctattacaatagaaatagaaattgttctatttctatttacaaaggaaaaacacattctgacacctaataatttctaaattggtgtgacacttattaggttgccataataggattaacaaacatataggaggagctaattgcaaggcatttaacttggaaatcacaaccattgccaaatggctttatagttggcttttgtggttgtcatggacaggaagaaaaatgagctatttaggaagtgagtctcgtctgaactttccaagatatattctagtttttgtgtgaggaaataattcaggttttgttgttgttgttgttgtttgtttgtttgttttccaaacttgcacttaagtcatacctcttttaaggtggatccagtcttaatgatttcttttggcatggctagatcctggttattaaaagtgtacatggaggaatgatgtacaaattaaggggggcgtcaaggtaggagggaggcaaaaaaggagaggtaaacagggctgggagtatggcgaggcagtgaggagcctaagtagacatttgaggaggcgctctctctctggactatcacaagccatccctgtacttgcaggaccctgagggggagtgcccccttaagagtgaggtaggagtgccctgttacattttgcatcttagacctctcttgcctcaatctcaccctggaggtgacagcatggctggtgatggctgtaatgagggatataagcctgcctgtagcttggaaagcatgttttgtcctcagaatcctcatacaggctgggcgcggtggctaacatctctaatcccaacactttgggaggccaaggcaggaggatcacttgagcccaggagtgtgaggctgcagtgagctatgactgtgccacagtactccagcctggatgaatgagtgagaccttgtctcactcaaagaaaagaaaagtaaaaagagaagacaatcctcatgccatccctctttggcaaaacctggactgttagagagaattcccagaaggcctaacttagtatggccccagatcaatgtagaactgaacatgatctctcctttgaaacacccctcctgaggctaccctggtcaaggttcaaggctcacccctaaagagaacttacccctgtggttggctctaggcgaaatcacaccttccatatattacggaacttcagagaacagggattcattcagccctcctacataccttttgatttaggaaggctttcagtgaatgattatccaaatttgtactatacaaatggaaacatttaaaattttataaaatctgtatgaagtcggaatgttgatatggtgaacatgatatttgcatctctggatgtgctgcctttgtcagttctgcctatgtgtgaggggttgcttgcatgcagtgctaatgctacacaatgcagatataggtttgatttggaggagaattcataagcagccatgtagcagtacgcacacaatcccttgaactctcaacctgcatcctaggctaggcatggatatctgtatgcaccatagccacagctctggtagataatgctctactatttatagggtcagtaggcagggagcatctatgtgcttgtgtaacagtggaggctctctgatcagggaagtgcccttattggagaaggaaagcccctggagcccagtggttggtatcagcctatttttttgttcatttgtttagctgagccagctttctgctaagctagcaaaagagggaaggaaatgagtctccggagccacccagatttgtctcttgctaaccacaggttaactgttctctttacctgattgtaagcaatttgggaggaaagacaaaattgtatagatctttgcaactcccatggtgtcctacctgtagttgaatgcttagtacgtacttgttgactgagcaaatgatataatagacttcaatcaatgctgaatgactactgtaataaaaaataaatattaatatatgctttgtggcaacttgaaagcatgggcaatgccttcataatggccaactacatattttggcagataacaaaccagtacatatggttgagggtggctgttgtatcttaatgtggaactcagtagcacccttttcccccccagcctttttcacttttgtttcaaaacatttgtttctgccatattgagagggggagttaagataaaagacctcctttagttgtcagtgcattggggtttccagccaactttctccttaatgcctttctagtagtgcatagccaaagcatatggaaggagaagtttaggggtaaactacagtgttcatttcagaaatgttctttttttttttttttttttgagacagtgtctcactttgtcgcctaggctggagtgcagtggtgcaatctcagctcactgcacttccacctcctgggttcaagcaattctcctgcctcagcctcccaagtagttgggattacaggcacctgccaccatgccttgctaattttgtatttttagtagagatggggtttcaccatgttggccaggctggtctcgaactcctgacctcaggtgatccacctgcctcagcctcccaaagtgctgagattacaggcatgagccactgcacctggccagaaatcttgtgtatatctggtattcatcatcatcctcactgtagcaaatatatttttaaacatttactgggtctgccctgtgcggagctctttatgtggattgccttacttagtccacaatcctgtgtggcagtacgctttattaacccacatgtctagacccgagctcaccttgggaagagtccttccaggtgtttgttttctattccttatactccagaacctgtcttatatagggattatactaagagccaaacaggttttgcttgagttttcccagtgccttccaaattggcagtcatctttttatccattatgatttcagtctttcatagcagggatatgatattcaaggggcatatgacccaaactcagtttatacatattgtttaacattgtattaatacccccacatcctagctgccttcttattgaagcatttgttttaaaggaaagctatatttgtttggttggtaaatagtttcttgttaatgagaaaaacacaaacatgtttctaaatatatccatttaattttgaaaaagcaaaccgcatattaaggagacctagtggttttataccagagtgtctgaactttggcaccgctgacatttccgactagataatgattggttggggagacctgtcctgtgcattgcagggtgtttcgtacctttcctggcttctgcccaccagatgtcagtaccaactcctcctcccaattgtgagaatgaaaaatgtctctggacattgtgaaatgtcccttgggggaataaaattgcctccagctgggaaccactgttctaaacccatagtttaaaaagctttgctttgcaccagaatagtagtctgatgtttcctcttgtggctctgcagtcaggtattgtacgtagtttcaatattttggctttctatgtgggtgatcaagtacttcacagtccttatatcaatataaatatgcataattccttcccttcaacaatttgtaatcaagataagatttaacatttttcagtcgactattttaaaactggtgatactttattccactatgacattctcttttttttcataaatggaaaccttttaaaataggcatgaataattttatgcctcaagcactttcattcttccaagtgtttatgtaaatacagagtaaactggttcaatttatatcttttttgatatctcatgtatttatttgttttctctataacaaagagaggggttttatcaggaaatcacacacaagaggaccataagtctctaattttatgcataaaaaaggagataagagaatataatcatttaaagaggcctgaaaaaccttaagaaaggatccaggaataggggtggggccaagatggctgactagaagcagcggcttttggaggctcccatggaaaaaacccataataagcgtgtgaatccttcactggcaaccaggtatccaggttctctcatcaaagttgactagagggctggcgtgacccacggagagaaggaagaacagtgtagtaccgcagcccagctgagagccacacggggcaggggaaccccctccccccagccaagggaggtggtgagtgagcgcactatccccccagagaaaactgtgcttttccactcacgaacccaagccacccaccagggcctagcgtcccaaccccagaatgtgcacattcttttttttttttttttttttgagatggagcttcgctcttgttgcccaagctggagtgctatggcgcaatctcagctcactgcaacctctgcctcccaggttcaagcaattctcctgcctcagtttcctgagtagctgggattacaggcacctgccaccatgcccagctgattttttttgtattttttagtagagatgtggtttcactatgttggccaggctggtctcgagctcctgacctcaggcaatccacccgcctcggcctcccaaagtgctgggactatatgcatgagccactgtgcctggccacgagcacattcttacagcctctcagctggagtcagcttaagcctacagaacccccgcaggggaggggcagccagcacccactgtggctgcctgctgtctcagctgtttgagctccttgcgggagggacagcagcctgcactgggattcgcactgcctaacacgctgagctccctgggcgggggaagggcggcacccatttctatacgtccaggctgtactttttccctgctggagccagggaggctggacagcttggtcccaagacttgtccccacagcccaacagaccggctgtgttagtttgtggccagtgtcccttcaggcctgaccctgacccatccttactcattgggtgaggcttccctgcaggaactccaataacttcagccagaggcttagggacagaatctggatgtccctgggcctgagcctctagggggaggtgtggccgcagtctctgtggaccagcaaacttagcctctcctcttggtagttctgaggaatctgggtagcccagatgagtgggtttcccccagcaaagcacaccccctccaccaagggacaaagtgctttgttaaatgggtcctgctccccgtgccactcaactgggtgacaccctccaacaggggttgtcagacaccctatacaggagggatcctgctggcatcaggttggtgcctcttgaggtcagaggtcccagaagaaggaccaggcatccatctttgctgttctccagcctccttgagtgacatctccaggcactggagtgaatcagatgaatagggcctgaagtgaacccccgcaaactgcagcagccctgcagaagagggacctgactattgaaagaaaaacaaacaagcagaaagccacaacaatgcatcatcaacaacaacaaaaggcccccacaaaaaacccatccaagggtcagcagcctcaaagactgagactagacaaactcacaaagatgagaaagaatcaatgaaaaatgctgaaaacccaaaaggcaagagtgcctcttctcttccaaatgattgcaccatctctctgtcaagggcacagaactggacagagggtcagatggatgaattgacagaagtaggcttcagaagatgggtaataaaaaactacactgagctaaaggagcatgttctaacccaatgcaaagaagctaagaaccttgataaaaggtaagaggaactgctaactaggataaccagtttagaggaacataaattacctaatggagctgaaaaacacagcacgagaacttggtgaagcatacacaagtatcaatagctgaatcgaccaagcagaaaaaaggatatcagaatttgaaaaccaccttactgaaataagacatgcagacaagaatagagagaatgaaaaggaatgaacaaagcctccaagaaatatgggaattcgtaaaaagaccaaacttacaattgattgggataccagaaggagatggagagaatggaaacaagctggaaaacacacttcaggatattatccaggagaacttccccaacctagcaagacaggccaacgtgcaaattcaggaaatacagagaacatcattaagatactccatgagaagatcaaccccaagacacataatcatcagattctccaaggttgaaatgaaggaaaaactgttaagggcagccagagagtaaggccaggtgacctgcaaagggaagcccatcagactaacatggatctctcagcagaaactctacaagccagaagagactggaggccaatattcaatattctctttttttttttttttttttgagatggagtctcgctctgtcgcccaggctggagtgcagtggcgtgatctcggctcactgcaagctccgcctcctgggttcatgccattcgcctgcctcagcctcctgagtagctgggactacagatacccatcaccacccccggcgatttttttgcattttttagtagagatgggttttcaccatgtcagccaggatggtctcgatctcctgacctcatgatccaccctcctctgcctcccaaagtcctgggattacaggcgtgagccaccacacctggcctattcaatattcttaaaagaattttcaacccagaatttcatatccagccaaactaaggttcataagcgaaggagaaataaaatccttctcagacaagcaaatgctgaggggttttgttacccccagtcctgccctgtaagagttcctgagagaagcactaaatatggaaaggaaaaaccagtaccaggcactgcaaaaacacaccaaaatataaagaccaatgacattatgaagaaactgcatcaactattgtgcaaaataaccaaatagcatcatgatgacaggatcagattcacacatagcaatactaaccttaagtgtaaatgggctaaatgccccaattaaaagacacagtgtggcaaattggataaagtcaagacccattggtgtgctgtattcaggagatccatcttacatgcaaagacatgtaaagctcaaaataaaaggatggagaaaaatttaccaatcaaatggaaagaaaaaaaaagcaggggttgcaattctagtctctgacaaaacagactttaaaccaacaaagatcaaaaaagacaaagaaggacattacataatggtaaagggaacaattcaacaagaagagctaactattctaaatatatatgcatccagtacaggagcacccagattcataaaacaagttcttagagacctacaaagaggcttagactcccacacaataatagtgggagactttaacaccccactgtcagtattattagacagatcaacgagacagaaaattaacaaggatattcaggacttgaactcagctctggatcaagtggacctagtagacatctacagaactctctactccaaatcaacagaatatatattcttctcagtgccacctggcatttattctaaaattgaccacataattggaagtaaaacacttcagcaaatgcaaaagaactgaaatcataagaaacagtctctcagaccacagtgcaatcaaattagaactcaggattaagaaactcactcaaaccacacaattacatggaaattgagcaacctgctcctgaatgactcctgggtaaataatgaaattaaggcagaaatcaagaagttctttgaaaccaatgagaacaaagagacaacgtaccagaatctctgggacacagctaaagcagcgttaagacagaaatgtatagcactaaatgcccacatcagaaagctagaaagatctcacatcaacaccctaacatcacaattaaaagagctagagaggcaagagcaagctaatccaaaagctagtagaagacaagaaataactaagatcagagaagagttgacggagatagaggcacaaaaacactccaaaaaatcaccgaatccaggagctgtttttttgaaaaaattaacaaatagattgctagctagactaataaagaagaagaaaagagagaagaatcaaatagacacaataaaaaatgataaaggggatatccccactgaccccaagaaatacaaattaccatcagagaatactaaaaacacatctatgcaaaaataaactagaaaatctagaagaaatggatgaattcctggacacatacaccctaccgagattaaaccaggaagaggtcaaatccctgaatagaccaataataagctctgaaattgggtaattaatagcctaccaaaaaaagcccaggaccagacggattcacagctgaattctactagaaatacaaggaggagctggtaccatttcttctgaaactattccaaacaattgaaaaagagggactcttccctaactcattttatgaagccagcattatcctgataccaaaaccaggaagaggtataacaaaaaaaagaagacttcaggccaatatccctgatgaacatcagtgtgaaaatcctcaataaaatactggcaaactgaatccagcagcacatcaaaaaacttatccaccatgatcaagacggcttcattcctgggatgcaaggctggttcaacatacgcaagtcattgatagaacacatctcaaaataataagagctatttataacaaacccgcagccaatatcacactgaatgaacaaaagctggaagtattccctttgaaaactggtacaagacaaggatgccccctcctaccactcttatccaacatagtatttgaagttctggccagggcaatcaggcaagagaaagaaagaaagggtattcaaataggaagaggggaagtcaagttgtgtctgttcacagatggcatgatttaatatgtaggaaaccccatcacctcagtcccaaaactccttaaactgataagcaacttcagcaaagtcttgggacacaaaatcaatgtgcaaaaatcacaagcattcctttacaccaacagcaggcaagcagagccaaatcatgaatgaactcccattcacaatcactgcaaagagaataaaatacctacctaggaatacagctgacaagggatgtgaagaaccttttcaaggagaactacaaactactgcttaaggaaataagacagaacacaaacaaatggaaaaacattccatcctcatggataggaagaatcaatattgtgaaaatggccatactgtccaaagtaatttatagattcaatgctagtcccatcaaactaccattgacattcatcacagaattagaaaaaaactattttaaatttcatatggaatcaaagaagaccccatatagccaagacaatcttaagcaaaaagaacaaagctggaggcatcatgctacctgacttcaaactatactacaaggctacagtaaccaaaacagcatggtactggtaccaaaacagacgtatagactaatggggcaagaacctcagaaataacaccacacatctacaaccatctgatcttcaacaaacctgacaaaaacaagcaatggggaaaggatctcctattcagtaagtggtgctgggaaaactagctagccatatgcagaaaactgacactggaccccttccttatgccttacacaaaaattaactcaagatggattaaagacataaatgtaaaacccaaaaccataaaaaccctagaagaaaacctaggcagttccattcaggacataggcataggtaattaaagagcttctgcacaacaaaagaaactatcatgagagtgaacaggcaacctacagaatgggagaaaattgttgcaatctacccatgtgacaaaggtctaatgtccagaatttacaaggaacttaaacatatttacaagaaaaaccccacgaaaaagtgggcaaaggataggaacagacacttctcaaaaggacatttatgcggccaacaaacatatgaaaaaaaacacaacatcactgatcatcagagagatgcaaatcaaaaccacagtgagataccatctcatgccagtcagaatggcaattattaaaaagttaggaaacaacagatgctggcgaggctgtggagaaataggaacgcttttacactgttggtgggaatgtaaattagttcaaccattgtggaagacagtatggcgattcctcaaggatctagaaccagaaataccatttgatataccccccaaaataaatcattctactataaagacacatgcacatgtatgtttattgcagcacgatttacaatagcaaagacatggaaccaacccaaatgcccatcaatcatagactggataaaagaaaatgtggtacgtatccaccatgggatactatgcagccataaaaaggaatgagatcatatccttgaagctagaagccatcatcctcagcaaactaacacaagaacgaaaaccaaacaccacgtttgcactcacaagtgggagttgaacattgagaacacatggacacagaagggggaatgggaacaacacacacagggcctgctgggggttggggagtgaggggagggatcttagagggtgggtcagtaggtgcagcaaaccaccatggcacacatatacctgtgtaacgaacctgcataatctgcacttgtatcccattttttgtttttttttttgtttttttcctccctgagatggagtctcgctgtgtcgcccaggctggagtgcagtggcatgatctcggctcactgcaacttccacctcccgggttcaagcaattctccctgcctcagcctcccgagtaactgggattacaggtgcccgccaccatgccccgctgatatttttttgtatttttaatagagacagggtttcaccacgttggccaggctggtcttgaactcctgacctcaggtgatccgcctacccttggcctcccaaagtgctgggaatacaggcgtgagccactgtgcccaccagccccctcttttttaaagaagaaattatatatatataaatatatatatttataaatatatttatatatagataggattcagggatagtcaatggtaaaaacttacctaaagtttttttttctttctaaatttatccaattaatatttttcaagcataacacctgttccctttctttaaaaaaaaattaaatcctttgtcacctttgcacctcaaagaaaatgcggaaatatctaaaataccagcttacttccatttaaatatgccccaaatgaagggaatttgagaaaacacttagggcatgggatttgataacctgcttcagaaacctagtcctgtgcctgataacctttactgtcttagtcagaaaatgtattcctatgtctgacttaaatctctcaagctgcagcaaggcatgttttctttcactctgccctcactgcgaaatggctgtctgccagcccttgagtttgagcctttcaaattcttaaagtatgttatctaaagtcttcccttggctttttatctacagatgagttggtccagattttttgccatgactttcataactctttcatcatctgcagcttcccccatgcttccttcaggatcttcttcacttttctttgagttgcagattcctaaaaccaagcagggttgacaatgccaggaaggtaccttagctaacagcctacactcacagcacctgttcaggtaccctgattggccttaagtgactgttctaactggaataaaatcctctctttatcatcaagcaaaatggtcagcttttctttgccttcagaatagtctctgcatggtgtctgctttcaaactttccaaagtgcttagtttaccacctctccctaaatataccactgtctatcttataaagcccgggaacacagaaattagcagcaaatgatctccttattttctgtttttaatgcctgtgcaccttaacaggttctttggctgcaatcagactccctcctggcgtctttgttccttttccctgggccctgcctctctgactgggctttgacagcagcagagactcttaccatcctcacggtctcctcctgcagctctttttttctaatccgtggcagcaagctaggcttcaggacaaaagcctcttggagaatatttgagaactttcaatccgcctgtgacccttttgaaacaccaactcaggatgctttttattcctggttgttatctttgcaatgatctctactctacctcagtttcttttctttagaaactgtgtgctgacctgattgaaatattctcagcccacatgagggaacagctatgacagccagtgaagaggactttccttgctgtgctcttcctggctgagaccaggaaaggagggccggcctatccatcacatgtcagagaaagaaaacaggaagaatggccgagatgtttaatcactttttgaagctgtttttcttattcaaaatcaagtcaatatttgattttaaaaaacacacactaaatacaatatggtattctgaattgcaatgctcctggaacagaaaaaggacattagtagaaaaccagtgaaatctgataaagactggcgttttattaataataacgtgccagtgttactttcttatttatgacaaatgcaccttggttatgtaaggtgttaacattaggggaaactgggtgaagggtatatgggaactctgtactatctttgcaacttttctgtaaatctaaaattattccaaaataagattattttaaaagatagcctatattttttctttccagtaatttgggttattcacctctatttctttactggttagtatattaaggacctgattcaggaaaaaatatgaacataaactaaagcttttgtatgcagaaaagaatggttaagtctatagctagctgatctaggtccctaaatgaaaatacctgaacatatattagggtccttgcttgttctgttttccctacctctgttctctgattacctgtaaattatttactcatttccatgttttctcattcagtaaacatttataaaactaggtactgagtttaactcaaggaaaaaaaaaagagatggataaaatgtggttttcacctcagagtacacaagctagtggggaataaacatatagagataactgctgaataatgtaagtgcaatgataacaaatgtacacagtaattttaatgggaactaagcaagcctgaaaaaggttatcagaaaaaacatcctaaaggtgacacgcctccgccttcaggatgagtaggagttaggatgaatgtaccaaagagacacgtcagggtagcaatctacatgatgtgttcagggagctagggagtgacaagcttttcagcatagcatgagggaagactgataggatgtggagggagatgaagctggacaaaagacaagagcctgacttagggccatcagaattaggaaggccttctgttgctggacaagactgtagtttcaccctttaaatcataagcagatgaaagtaggacagcaaaagataaagaccagagagtttcatctcacctttattctccatcagttacagtggctcaggcattttctgaaaatatggctaaccccaaaggagctattcttgccatgaaggaagttagtggcttcatagatagagtaactgctcttaggctcttaccctcttccctagcagtggggaacagtggtttatttttaaagtttatataggtactaatgctcaatgattgctacttacaaataatgcataagacagtgattttcaccccctgcaaaagaaatgttttgcttttactcatagggcaaccagtggcttcaactgctttctatttttgaaaactcatgtgatgaaacatgagaagttcttatttaaaggggttggtgagatgcttcttttaaatgctgtcacactgttgctcatgcttgaattggagctaagaataaaaattcaactgagtaatttctgttgatgtagcgtccctcaactttttggagaaaaatgtcaagttttacattctggtttcattgcagttcctggaggctactgagtaggaagaggatagcgtgatgtgtgtgcatgcatgtgctcatgtatagaaagacaggatgaggtagctgcttatacagagctagaaggaactctagctaacttagagttttgactaaacactctttttacttaaaggtaatctggctgtatcagggtttactcccattgagttgaatatgaacttgatagacgaagtggagaattctttcagttttgtgaaaagtttaattatgaaattgttttagacagtaaatgacacattcccatttcttgtcagtgaatatttattgaaatctagcccttcttgccttgcctttctggttgatctctttagctgtcaagctcgctggtcatctttcccttgctgggccttacatgtcatgttttcttgagttgtgaagaataaccatttgttagctaaagacctttctctgatctaaagcaactgatacttgaaagagtaaataaacggaacctgatccctactttatattgccaggtacaaaatacatttgtggctattctatcatattatttttgtaggtctctgaattaaagagagcaaagcttctttctactcaagacttgcaaacacttggttttgacaatcaaattatctcgttcttaagtttatgaatcgttgtcttctgctgcagagagaattggatttttagttcgaaagatgagtgcacatcgggaagatgtgttttagggggaagcaatatgtattttgcattatctgtacgatgtgagaaactgtaaattgataatacaatatgttagtaaatgaaatggcaatgagtagcaagcaatgggctggagagaactccaggttgggggtagaaaatgattattataggcatcctaggcatagtggctgaactttctgttttctccttctttgggaaatgggtttaatattttaggttcatctgcaggcctgggctacatttaagagtacagtatcctggcacgcacttgaaccatgctgagaggctgacagccaaaatgagctggaccttgttctcactttgttatttgattgcaggcgatgaggggaaatgatagcattctagttcttctttttgaaaaactatgcattacatttcagaatgtttcactgcccaatagtgcatagttttcaagtgtagttcctctcttaccacacagctaagtaatcctggaagccaaataaatggactgtatttatttcaaattcagttcttaaaagatgtctcagctgggcgcggtaactcctgcctgtaatcccagcactttgggaggccaaggcaggcagatcacctgaggtcaggagtttgagaccagcctggccaacatggtgaaaccccgtctctactaaaaatacataaattagctgggtgtggtggtatgtgcctgtagtcccagctacttgagaggctgaggcaggagaattgcttgaacccaggaggtagaggttgcagtgagctgaggtcgcaccactgcactctagcctgggcaacagtgagactccgtctcaaaaaaaaaaaaaaagagttatctctaattgttactgtctttatgttgagtatgttagggttcactaatttatggtgtatatctggatttttttcccacctggttagtggaataaaataggaagttgaataacatggcatttattatgatagtaaccaacagggcaactggagttagcatacttgtagcttttgtaaattactcaattgtcactcaataacaggacagttatttacttgattgtgattggccgaggaataataatggctccatttcagcagataaatagtgaggatttgaatctttagtaaaattaatgacagctggaggaattcccagctgcacatgtaactagaagtgcttaactacccaattaatcatgaatggatggattcagtgaaacacaaaattcaatctgcttttgcagcggtggttttgaaaaattggaggcaagcgtttttttctctattgaacgcaactctgagtgtctaggaaaatgccatacattttttaggatgaatgcaaagaaatatgagtcccatccttctttttttgcccttcttccctcccttctttcctatacatacttattatacacctactatatgccaagcccacaatggggacacaaagatgaaaaagatacactacctgcccttgaggagttattgtcagaaaggtaaaatagccacacgtacagttgtaacacaacggatggatgaaatggagtttgccagatgggcaaggagaaaaggggctttttaaataagagtcagtctcctgtgcaagagcagggagctttcagagtatgtacctaccttatacaacaagtattttacctgggtgcctactatgtgccacacagtgtggatgagatatgtttggaaaagtgtgagaagcatgttattggccagagcatgtgggaggagaaagataaaagatgggcctggagattgacagggacaatttcaaatgtcactttaatagtgtcattcccggttttattcttcttttcaaagtaaatgaattttttttttaagacaatctctctctgctgctcaggctggagtgctgtggcgcagtcttggctcactgcagcctccacctcttgggttcaagtgattctcctgctttagcctcctgtgtagctgggattacaggcgtgcaccaccacatccggctaattttttttttggatttttagtagagatgcggttttgctgtgttggccaagctggtctggaactccagccctccagttatccacccgcctcagccccccaaagtgctgggattacaggtgtgagccaccatgcccggcctcaaagtaaatgaatattttcttatttttgttctagcttaatgttgatgaaataaaaggtagtcagaacaaagattttgagtagatttagtattaatacatatttatacctaatcttagtaaatatacaaacataccaaatgagtcacaaactcagcattcaagagcagagctaggctgacacatagcacagtaaagtacttaatttcttatctggaaacttccaaattgctaggagaaattggcgagcaatccttcgagagagattgaaaacttcctgtctgaaaacagaaactattagcaattattttaacccgatagtagcaacccagggttcaaaagaattctgtatagacatctgtataatggaggaaattttcattcattgcacacaatagggtacaatttgatgaaaactaggtggattttttttttttaatttctatcctcaactcattccacaagtttttcaggcagcttagaagactatatgaagccacaaaaaagttagtaaccagcaaaatatcaagatcagagaaaatataaattaagacagaaaatcttataccaagaagaaagctagaactgagctctgatcttcctggtggctgatgtaaaaaccaaaatataattaatcataggctcctcattgttcatagagaatatgtcaagacagatatgatttaatttttattatccataatgaaaaattctaataatcgtgaagagccctttttcatttagttgtttaggtataagtagactcagccttccatgttttgaggaacattttcgctaggggactttgccagtgggttaataaagtgcttccagtgtctttcgtgtacaaggcattttgctatagagttctcatgcaggcattccatcaaaagatgggtgaagtctgagtgcactggctcattcctgtaatccccatactttgggatgctgaatggggaggatcacttgagtccaggagtttgagaccagcctcagccacatagggagaccctgtctctacaaaaaataataagttagtcatacatggtggcgtgcgcctgtgatcccagcttgaaaagtttaggtgagaggatcacttgagccagggaggtcaaagctgcaatgaactatgatcgtgccactgctctccagcctgggtgacagagcaagatcttgtcaaaaaaaaaaaaaaaaaaaaaaggtgatgttgtgttacccactagggagaacgttgccaacttcagctgcatctacttattctcacaaggactgtccttctttgacaataactcaaaaagacttatttttctggcagtttgttctgcaaggtgatagattccattgtattccaattttgtaatgaagtaatagaatttgcagtaaaaccaagttctctggaattctttggtaaaacaatgattgcttaaaatgggaaaggcttgtttttcaaattctcattctcaatataagcctcaacctctacccagggaggcattgtgcttgcccatcattgtcaatttttatgttctttggttataaataacttctggaacaagcaccagaccacatttcaatagcaattttcaaaacggaatgcacatttttaaaaactccttcgtgatcttttctagtaaggaggttttttttgtttgtttgttttgttttttttctaattgtaattttgtagtattgtagatggtattgtattgtcttggacctgcatagctaaaattggtgaagaacctttccacaaaatattaaggttactaatgatttcctggacttttcagtaaataactcaatatatttaaaaacctccccacctctactacattttatttttcagctctgatattagtttctccttgtctcagctgaacatcagaagatagacaaactgctgatggtttgttgataaatttaacacggttaccaaaaaaatcatgaaaaggccaggcacggtggctcatacctgtaattctaacactgcaaggctgaggtgggtggatcgcttgagctcaggagttcaggaccagcctgggcaacatggcaaaaccctgtctctacaaaaattagccaggtgtggtggcacacacctgtagttccatctacttgggaggctgaagtgagaggattgcttgagcccaggaggtcaaggctgcaatgagtggtgattgcaccactgcatttcagcctagacgacagaatgagaccgtatctcaaaaaaaaaaaaaaaaaaagaaagaaagaaaagaaaagaaaatcatgaaaaataccaaagtcttcaagttgaaaatggttaaattaaaagatgttttttcccctttagtcaatgtctaatgctgtgcttagtgtctgttaagcagtaggtaaattgtgtatatcccctatatcctgttgatcatttttagacctttttggaataggtttctggtttacttcttgctctcttttcccactgttactatcctatcagtctcccagtcagtctctctgactgcagtttttcacactttcaggcagatcttcccagtgcatccttttcgatctgaaactctcattcacttactttagtgcagcatcagccatctactcacaaccatatggctgcaaacacttcctcccggctttcctgatttgctgtgatctgcatttattctactctacaattttatttccagctactcctcaacatgaacctctgaacttctcattccccgactcataaggcaaggcaccactttcatgcctttgttcatgctgcccccaccttttcttgaaatgccttcgcaacgttttctctgcccccagcagatcatgatgatgcttatggcacagttccagcgctgacttctccatgcacctttcttggcctcatcacctcagactgacctctgcctttttgcaactccaaagtcagtaaccttcgtttctttttttaaatgacatagttcagcactgaactgccttgtttcatgaacacagatcttatttctccaacttgtttgaaagctctttaaaggcaagaagcatgccttttacttctttagcatccactgcaactcctacccccatactgactacagagttgtccaaattcatcactctacaaacattgcctttattttcctgccctttagctttgctgtctgccattcctgataattctgcttaagcctccctcaccttctccctgaggttttctgttcccccaaaacagaattaatctgtcctcttctagtcactgattggatttgtatttttgttatggtacttttatggtactttttgtactctccttcataatgtggttatttacatagctgtcagccctattaggttataagcccttattaggcaaggaccgtgtcttatttatctttttgcctgccattgtactaaggtacaggcctcatacatactaatttttcaacaagcatttgtcaatttgaattgcatattagatagtagacaatcagacatgacctagtgttgttagggcaccgagtatggttggtatatggaagtccacttacccgccctgtcctcttggggtacctagtacctagcgacagttcacctggttcacatacgaccacctgaaggggttctttcatttagaacttaataaagacaataaaatgctcggtaaaaatgactaaagctatactgtgaagttaaaactaaacaattaagcatagtttctctactatgtgtacagaaagctgcaaagattctgcaagaatgttgagtaccaacttgtagtcccttgtctttgggagttggtagcatatttgccctggggaagttatataagggaagtatctctgaggcccctttattccagggaccttccttctgcagtactggatagttcacagatccagtactgttttatttctcaggccactctgctggaatgtttcttcctcatctaagaccatttattcaagagcagagagttcttggtctttgtgtctgcattttcccctaaactctctgttaaagtactgagtgtgaatttcttgaactcgtctctcttgttcccactagccagtgcataggtgcatgcaacaccagctagaagaagggcctcctctctcctccagttcaacctgctgaatgctacctgtcatcctcaggactgtcctcttctgcactgtgggtctctctgatctttgctgtgcagcactgaaggagtttgatcaatattggtgggagaagaagagctttcaggatgattctgggaggaaaaaattttcccactgaatggacatcctgcctgcctcttgtattttgctctgaaccctttacctctgtcctcaggcccttgccttcatctggacttggatttcactctatgcccatcatcacacccagccatagacagtataggtctatgttactcaaacatttgttaatttatttcaaatccagccatttggataatatatgcatatggtttgtgaatttatctataatgatgcagcatgagaatgataacaaaagacctatttttaataaatttgtcttagctttaaaataggaattattccttttaaggcatgcatctcatagaaaagcaaagataatgagaaaatagaatttttaaaaaatagctaagtaaaaggaatagctgccttattttcctcgttgaaacaacaaaagggcatcctttggccagagagctcatattcagcttttgggagggaatagagtgttttgtctctgaggggtgacttttcacacctgtttaggattctaaaagtttgtggtgggttggctcgttttgttgagagtgccggccttgaattttggtatgtgggtcagctagcagaggttgcgacagtgctctgtgatgggtgaccgtccctagccctggccgtcttgaagtgggtactgggtcataaagaggaggggcaacccacagccatcccagctgatgcgagttcagagccacgcagcccagaggagacagcaggtcaggagtgtcagcctcatatgcaaaggacagcagtcttattcatgctgctgtctgaccaagaaaaccagaactgactgtcttcttgttattcccaaacaaggtgatgcctctgagtaaacacacttcttgcaggcagaagaaatatggaggaatacaaccaacatgattcctatatttcatttcagccaatacctttagttgtcccaaagttcttactagagcatttaattcctactcacttgaattaattaagttttatatttctatccctttttgaagagagggattacaacagcaaattggcctcacccaaaaaacaaagggccaggacaattccatatactgaagtgttctcattaacctgcattgtgtgattccttggctgagtgcttgcacattctgagtgcataatcttcatggcagctccatgagttaggttattatactcactttcagaaaggaaactgagcccagaaagaataagtattgtgcttgaaagcaaatgtctagtaaggagcagctctagaattccagcccaggtagtcaagcttcatggcaccactcaaaactgcttattgtacgccagctctcgtatgagtaaccacctcctctccttatattccctaatgaagaatcaaggtaatgatcagaataaattaacttatagcttctctgtcagacttatttaaatcaaggtttcatctagttacttttttttctatttgtttggtccaaaaaagtttccaacaaattgatgagcagacgtggcttctctctttgaccgccttggatctattgatgagctaattcactggaggaagggaagagaaaatccaaggtttggtagtcactgctttagtaatagttgattgtatgtgttttgatgtcaattcaaatgaccgattccatcaccaagcacttgaagacctaattcctggcactaggctgacatctttaacaacagacctcagaggaatcttagagatcatccaagagatgttcttgcttgaaatgcaagtctcagcttcgccagtggatcatggcccagtgactttgagcatgtggcctgacttctctcataggacctcgaaagagctttggagagaaatcaagataatgtgctggagagaacctagcattctcagtaatttttagttcaatctaaatgcagagacagaaagagagattctttttttaatgtcttcaacctcagtgatctgctcatccaacagtgcctaccaacacttctgctgggcatgattattagttaattagcaagggctttagagccagtccaaccagggttcaccacactttaccagctgcatgaccttgggcatcttatttagtgtctctaagccttgtttacttcagtgtggataatgaaatctatctcttaagtttttattgtgactaaattagataacatcagtaaagtgctgttttattccaatcaaaaccctatttcctagttccaaaggttaaactaaaaataaccttttcctctgccataatgacctctaacacacagaacacagaattagcagataggaatcaaaaaagcaagccttgctgtcatctcctgccctgtgaactgattggagaggaagggcactaccccaggaaagagtatgggcctgtaccactccaaactccaaatggggttgttccatgctgatgggaggggtgggtatcgtgtggttaccatcaaggccacaaaagtcaaacgaggaaagcagtgctgtaaggagtagcacaacctagggtgcatgtcttgtgacaataagcttcttctgtggaggaagctaggggtaggcatagctcttacctagagccctgggtgtttgctggtgaggcagcatgtgcacaaggggcccaccataccttcagagacttccaaccattcgtcatcttctaattcaaaaacagcatttgtacctgaagttaaattactgcacaaggcgatatcacctagaaggcctacaggcttcacaaatttaggagactggtgatcaaagagaaaaactcatactaatatagtctctgttggggcccctgggcctctcacaggaaatattctttttgaaagaacacagttggctgggcgtggtgtctcacccctgaaatcccagcattttgggaggccaaggcaggcgaatcacctgaggtcaggagttcagagcagccccggccaacatggtgaaaccccgtctctacaaaaaatacaaaaaattagctggatatcatggcatgcacctataattccaactactggggaggctgatgcaggagaattgcttgaacccaggaggcagaggagcatgtgagctgagattgccccatttgcgctccagcctggatgacaagagcgaaactccatctaaaaaaaaaaaaaaaagtacacaattaataaaagtacttaacactaatcatgggacatagtaagtgctcaataaataatagtggttattattggttttgatagtgattattaatatttaatgtcacctatcaaatcattattttagggttaatgcaggtaatcttaagctgtataactctgtaaaaatatgcatatttttatatatttatgtacaaatatatataggtatatagagatttataatgtttttgtttttaaaaattccgaaggtaaaaattcaagctgtatggtagggtttaaagtgaacttaaatctgtttccttcctctagtatatttaggtatattgatgcataatagattctcagtaaatttaacacaatttcaaataacatactagattattgtacaatgcgatcttctgacttaatgatttcacattttattagttggaggtctgtgccatgctcctgggctcaagaaattctcttgtcttagactccagagtagcagagactataggcatgtgccatggtgcctggctacatgctcttctatttcacaaatgaggcatgctttttaaaaacatgtcttccgtggataacatgtatctgttttttataccaataccatgctgttttaggtactgtagctttgtagtatattttaaggtcaggttttgtgatgcctccagctttgttcgttttgctcaggatttgtgtgtgtgtgtgtgtgtgtgtgtgtgtgtgtgtgtgtgtgtgtgtgtggggctatttgagttctggttccatatgaattttagattttttttctatttctttgaagaatgttattggtattttgacagggattacagtgaatctggagattgctttgggtaatatggtcattttaatgatattaattcttctgatccatgaacgtgggatgtctttccatttgtgttttcttctatttctttcatcagtgttttgtagtttttgttgtaaaggtctttcacctccttgattaaaagtattcatagatattttattattattattatcttgtaactattataaatgggattgctttcttgattcctttttcagcgagtctattattggtgtatagaaacactactgattttgtatgtttattttgtatcctgcaacattactgaatttgtttatcagttctaagagttttttggtggcgtctttaggtttctatatatttaagatcatgtcgtctgtaaagagggacagtttgactttctgatttccatctggatgccttttatttctttctcttgcttgatggctctggctaaatctttcagtatatgttgaataacagtagcaaaagtgggcatctttgttccagttcttagaggattcagtatgatgttagctgtgggtttgtcatacatgggctttattacattgatatatgttccttttatccctaatttgttgagagtttctatcatgaagggtgttgaattttgtcaaatgagtcttctgcatctgttgaaatgatcatatggcttttgtctttcagtctgttgatgcaatgtgtcatgtttattgactggcatatgttgaatcatccttgcatccctgggataaatcccacttgataaatcccacgtgatatttgatatgttggattccatttgctagtattttgttgagatttttaaattatttttatcttttttagagacagagttttgatctgttgcccaagctggagtgcagtggcatgatcatagctcactacagccttgaactcctaagctgaggtaattctcctgcctcagcctccctaagtgctgggattacaggcatgtgccaccactcttagccttgttgaggatttttgtgtcttattcatcagtgatattggcattggcctgtagttttctttttttgctttgtccttatttctatttttactcctttctcatattaatgagtgaagagataggttgttcatctttttcttattaacttattagagttctttggatatgaaggatattaaacccaagtcacttatgtgacaatgttttctttttgtcattttcattttgactgattattgtatttttttcccagacaaatgtttaagatttttatgtagtcagatttatcaatcttttcttttcatggcttctgaactttttggcatgctattttaaaactttagcatagtttctgttagtggtagtagaggtgtgtttatatacatatatatcttttaaaatatatgtgtgttatatatataatattgcctttaaatctcttcatctataatttatttttatataagctataagactgagtgcgatggctcatgcctgtaatctcggcactttgggaggctgaggtggatagattgcttgagttcaggagttcgagatcagtctgatcatcatggcaaaaccccatctttatgaaaaatataaaaattagctttgcatgatggcacatgcctacagtcccagctattaaggaggctgaggcacgagaattgcttgagcctgggaggcagatgttgcagtgagccaagatcgtacctctgcactccagcctgggcaacagaacaagcctctgtctcaaaaaaaaagatataaaatagggatctatttttttttccagttggctagctcagtttcccaacactattaactggataatcattcttttcccattgatttgcagtgtttcctatatcatgcattaatctcccatacagagctcagtttgtggtctccttgtaatttcattgatctgcgccagtaccaaacatgtttaacttttgtagttttatatattttcatatctattaaaaaggctaattctcttttattcttcctttaacatttttttctaaacagtttctggattttaattttttcagtcaacttgcgtagcattctgtcaagttaaaattgattttattcttcactggtctttcctacataatttccagcaacccctggaggcaggaagagtgtacaccctttgggtgaagtctgggcagtattggggtctccatttaaggttctcttcttccccctgaagccatctcattgattctttcattcagcaaatagttttgagctcctatgaagctttgtgctaggaactctgaggaccacaaaactggtaagacatgactcctgcctgaaatgaagtgtagatgctttactgtggtttccattgtgtcttcagccacctctgggggatctccttctgtttttgatggcatacctggattcagttagccatgcatacacattcccttaatgagaaactttagccagttttttaaaaaaatcattccaaagagttatttaaagatattttttcatcacacagttcctgggactacagaaatgacatgggcgaggctcaagtccttttccctactttcttcctgtcttctaaaccaagctatattattcttttttatgtgacagaaggaagtcttttctttttttttttttaagacacaagtgattgcctgaagctacttttaggggaaacatatatcctgttgtcgtatctctctctcaagaatctgactctcaagaaaacagaccacaatgtaaaagtagtgttgggtgtgctgctttgtaaaccactctgggggccatgtgagaagaaagcgtctctcagtcaatcacttttccagaaaagtcacagaagtccgtgttttcaggcaatgatcagcgcctcatcagtatgcagcactgcttctaccagcagcatattcaggattttctgaacaaatactgtgatttccttttaacgtctctgctgaaactagattagtgcagcttgagcagccaccctggaatgaagaccttgtgccgggtctaatgctgccaagtgcaactgccgggatcagccagcgggagccaccctgtcacacacctgtcatgtaggttgatcagaagctctcatgaagttttgactaggcagggtgggtttctagatcagctgctcagtgtcccatgttgttattctgtgacctgtatatagtaaagcttggttgctggaggccaccttctcccagtaggtgatcactttcgctttcccagaaggaaagtgagctccacaatctcactgtccctactgttacaataaagttcttgttggatgcaaaaatgatcatgggtgttttcaacttctgttactccttagtctcacagaaggtttttgatttattgctaattgtgcttattgatatagcacttcttacatacatgtaaaatattatgtgctgattatcacagcagtttttgcccaaaagcatccatatcaagtaatctttgttttttgttctttcccaatgtatatgttgaaccacgtgaaattacaattgcaatgtttgcaatttcatgattcaacctaacaaaaggaatctaccctcttgctaccatcattaccactggtttaacttgcaaatctgcttgtagctcacatctcagtttctcctttctcagaagtggctaaatggccatggctggtacagatttcctttccatctctatctgggcctttttgtcacctctctccttgtacttgtggggtcaattaaaattcttctgctgttatctccattcatgggtctcctcagactagcaattaaaagaaacctgtctgaaatcagggcaattatagcaaaaactagccagcacaacaggaagggtgagattggccaacttttataaattaatattacttcctgttaaatcaattatgtaaaatagttgtaatagaacccattaatttgtattccatttatgagattattcaaagcctgtgctttagtttgaactatactgtatatttatatatagttataatttaattacaagaaataatctgtaaataagtggtgtgaacataatcggaggcattatcattttagagaaaaagaaaactctcagtgctaccttagaatcacctaccaagaactaaaatgctgaagaaaaattttgtggttagagcagaaactcaaagaaattcacaaaccaaaaccttggtagcctacagataccatgtgaatgcagaaatagtgaacatgtcttttgaaaagcagtctgccattcacttcccatgatctcagactggcattttaaaaaatacgtctatcattgtaaattagtgagattctggtatttgattaatattaacaaaatactgaggaatgttattttgttttactgaaggcagctaaaatgtttgatgttttaatgtaagtttttgcaccagattttataggggaaattttaaaaaatgaatctaccacacccttgctccccatgtagtgacctatgagggtgtgtggaatggtgtgtgaggatgttcttgttgcctgtctgagcctcagatgcctcatccgtacagggtggataatcataacttacttcttagggttgatgtgataataatatctataagttagtaagggatgagcaaacattcattctcttccgcttccctttaacagccttttatgaacatgctcctttgctacccttgacgactctttgaaacctaaaaaggagctttagtcagattaacagctggggctgaattttaggtcttccatccaataagagtgagctgctgtgattgtaagcagaacttgtcttattttttcagccaacatttttgaaaacctatttgtgagaatccatgcaagataccttagagaaaagttatctcggcgatataatttcaagagttcctcactccaccaacgtgctgggaatgtatacttatcaagcgctctggattaaggcattgaagactgtaattaaaaaaagaacaaaacaaaacaaaaaaactcatgagggtgaggttgctaacaattagcgtcacaccaagtaaacacagcaaccttggtcaagtaaccacccgagaagaacttaaaatcatggaacaaagaagagagagattctgatgggagtgactgtgtctttctttgaacaaactcgaggtcctgccatgccaggcactgtagggcctatgtacttggagacgcagcctggaccctgctaggctaggtgccctagcaaagagttctgggcatgtttgataaagggggtgaaggaaaaggaagcacatttgcaagaaagggaggggccagcctgtcaagataaagatagcctaatgacaaccttgtgagtgagttatattcactcatctacccggggaaatctgggaaagtcaccaagaatgggctgtgttccttctgcaatgtggaaaaatgcattgtcaagtcattacaaacaacagagaaaaatgggcacaaacccactgggagtgatatatttctctgaatattccatgatcgcttagtccacttaatgcaactttttttttttttttttttttgagacagagtctcactctgttgcccaggctggagtgcagtggcacaatctcggctcactgcaacctccttctcctgggttcaaacaattctcctgtctcagcttcccaagtagctgagattacaggcatctgccaccacacctggctaatttttgtatttttgtagagacggtttcaccacattggccaggctggtcttgaactcctgacctcaggtgatccgtctgcctcggcctcccaaaatgctgggattacaggcatgagccaccacacctggccaaatgcaactcttaaaatgccaaatttacaccaagattagcgttcgtttatctaatccagaagggaaactgacattttgaatgtctactaccgcacagcccaatatggtagccactagctacaggtagaatttaaatttaaaataattaaaagacagtaacactttaaaattctaaaaattaaattaaaaattcagcatagtagtctctctagtcacatttcaagtgctcaataaccacatgtggcttgtggctgccatattagacagtgtccatgtccatcattacagtaaaagttccattggacagcgctggtttagtagtatcagcattactcttgtacactatgttgtacatgtgttatcttattgattcccaaatctatcccaaagaaggacttcattctcattttgcagatgaggcaagaatccccagaaaaataagcagttctctttcatgtagtggccactccagtatctgactgatgctcagcgttctgtgaatggacagctaagctaggttgtgagagactgggattgttggactaggaagcccagcacttccaacagtggaaagattctgttccagtatgatcacattttattttatttatttatttttttgagacagggtcttgttctgtgtttcaggcagagtgctgtggcatcatcatggctcactggagcctccacctcccgggctcaagcaatcctcccacctcagcctcccaagtagtggggctataagtacacactatcatgcctaatttttttttaaaatttattttttgtagatatggggccttactatgtgacctaggctggtctcaaactcctgggctcaagcaattctcctgcctcagcctcccaaagtgctgggatttcaggcatgagctaccatgcccagcctggttgcattttaaaatcaaacctttgtagacccttgcttctccttgctgtaattttacgatttgcctaaatactaaaattacttatacagtgagaaagtctatttcagttttaaaaggacaaggtaagtaagtagatgcctagtcccgagctgggaatggagaatggctgcaaataggcacaaggtttcttttgaggtattggaaatgttctattagattgtggtataaattatgttctgtaaatttattaaaaatcactgaattgtcacttaaaatgtgtgaattttacatatgtaagttatacctcaataaagccatttttttaaaaaaagaacaatatataaatcctaaaactctagggcagccaaaaatttaatgtgaaaaagctgccaaacctttaattagtgggtcaaagtttaattgctggtattttccgaatttcccccatgatgttgaaaaagaaatgatgtttcatctggagccaagcaccaggaaactctacaaggtatacattattatctacattttctaacggaggaaattaggatgcagaaggttaaataacttgcttaagattcacagccaactagaactggtgacagtgtcaaacctaatactgtctggatccaacagccatggctgctgtcctgttgatattatgcaccctctctgtgtgaatgagaagaagcccttacattgtttcacttgagatcaccttccttctctcagaagacagcagctagctgattttccagtgttactatctgcattttgcattttgtacttgagaagattccctaaagggaaaagagtctagaccaaaatacctttctttttttttttttgagacagggtctggctctgtcacccaggctggagtgctgtgctgtgaccttggcttactgcaatatgactttatcactacatggtatgacttgcagaggtgtctgcataagagcttttgagggactagtccctgtcatgtttcttacacgtgggttaacagctcagttttagatcatttgataaattgggtagctcgctcctacctgttttatgaatagaatgctagaaaattataagctcatggggcttccatcaggtcttttcagctttggccaggcctagtaacctttacgtcttcagttatgttctcttagcatctaacattctttccttcttgccatctctctctctttttgatcattaactatttagccagatatctgggtgacgcctctccaacctgtcctgctcttactaagccttgcatggccacttgcccttcctggatacttccagtggccaggcccagggagtttccttctggcctctctagctcacttgctcttccctctgtgcctttgtaaataacacagatcctttcctttatcttttccttcctttttttctgggatatgttcaactagttgaaacaaaataaaccaaaccaaaccaaaaataaataaaaacaagaaaccaagccagtaccaagccagcagagcatgtctatgggccacatgtgggctcttgaatgttggacttctgctttttcatatacaaagcaatgtagatgacattaaaaaaacaacaacaaagtaaatgttgtaatgatataaactaattatgaaaatgggtatcacagtgctttatttttccctctaccaatatccttagaaacagggagtaaacaggaacttctgcttctacatatttggccatagtagagtttattagatttgagattcttacagtgtcattcacatttcaacataaagttcatttgtaggagtccctgagtcacttcttgtgtactcagagataattgaatcccaggatttgaaaagttgttaaggtactttcaggaaatcagctgtcttctagtggcagtagtggagtgtgtattcagctgcttgactcactacctcagcaggcagcttgctttttttgtgaactgtaggcactaaccatccccaggacatgttttcaaaaccaggcaagtgccttcttcctgacttacgtaccacagtctcacttgggttcctgatgtcttcacagcagccagttcagctcccttagaatggtccatcacacatcccatttccagcaaagcattgcctaggactaactccaaactgtttttgtagatattttagaaacactgggtcaggcacagcggttcacacctgtaatcccagcactttgggaggccgaggcaggaagatcacctgagcctaggagtttgagaccagcctgggcaacatgacaaggccctctctctacaaaaaaaagaaaaaatgaataaaaattgaaacattgtgtttttttttctcttactctggattttatgcagctatacctaaactcagacaaaagatgtattctgagagaactctgctttaaaggacttcaagatagctctctttttaggcaatgaatacgtctatgaaagtcaccctgcacttactcgttttgtaggtccaaagtttttccctagtagatttgcacagaagaatttgattataattcagttaacaaatacatttcctctataaagggcactttcagaagcactatataaagttcatggatttggacacattgcggttatcaggtttatagtacatcttctatgcagtaaatacagtaagaaaaatggctacatttcaagatgggttattgtgcatatataatcattgagaaattaatgctttttgtttttatcaatgtgaaaatgtcagcactaggaaatgaggatgaaaagttgatttattgtgtgcctattatgtgccaggtcctggagtagatattttaatgtcacatgcagctcagtgtgggatgtgaatctgctggctctaaggctgaactacctgagtttgagtctcagccttcccactgctgcaaggattcagtgagataaagtgtccaaaacatctagcccatgctggtgtgatagcaagaactcagtaaatattactgctcattatatcttgttccatttaatcctgtgaagtaggcactgtccctctttaatagacaagaagactgtctcagagtggtccagtgacttctataaagttttctgcagtatgttgcagaggcaaaatttagaaccaggacttgactgggcactctgataaaaccgctaaccaggagttcttgttctaggctgccaggaaaatctatgctacccttgctagaatgatggcctctactgagagacaaagttgcccttaaaggcaacaaattcacaagtcaacatttctacatgtagaaaaactttcaaaggaccagattcagcagtcaactatttcttaaagctttttccccccctcagtggacagcagattctcagctatatggataggtctatgtttttcaaaacctgtgcatgatttatgaaacataatcaaatacaccagtcctcccaatacctctgctgtgtaaatgttaccatctatgcaaatatcaacttttaatgccagcttaaggaaactgtaaggatgatgttcctgtagcagccataagacaaacctccagggttttttgcggttggggaggcaaggaaggggttgactttttaacttcgccacatcagtcagactggatttcagaacttttttttttttttttttttttttgagacggagtctcgctctgtcgcccaggctggagtgcagtggtgcaatctcagctcactgcaagctccgcctccggggttcacgccattctcctgcctcagcctcctgagtagctggggactacaggcgcccgccaccacgcctggctaatttttttttttttttttgtatttttagtagagacgggatttcaccatgttagccaggctggtgtcgaactcctgacctcgtgatcctcccacctcggcctcccaaagtgctgagattacaggcgtgagccactgcgcctggccttttttaatttttttatttttattttattttattttttttttgagatggagtcttgctgtgtcatccaggctggagtgcaatggtgccatctcggctcactgcaacctctgcctcccgggttcaaacgattctcctgcctcagcctcccgagtagctgggattacaggcgccccccaccatgcccggctaatttttgtatttttagtagagatggggtttcaccatgtcggccaggctggtctcaaactcctgacctggtgatccacccaccttggcctcccaaagtgctgggattacaggcgtgagccaccgtgcccagccttcagtgctgtttaaatagctcttctagtgtgggcttcaactgagaacatccctgttttcatcctcaaggttgtttttctgctcagtgttcttgttgaccacgtctgggctgctgcaggacaatgattgaagttttagtagtgaaagagttcaatagtgttgacattgaaactggaaaatcattttactaatgtaagatgatgctttactatattgaaatcttagacaaatagatgacccatagcccaaatacaggtaggatttatcttttgtaataagctgagtctctttttcctttagatgtatatgcaaaagagaagatggatgaaaactaacgtttcacaagtgatatgggcttaatatagcacaaaacaagaagaattggtgctgagtatcacataattttcattgcagtttacttcctagcacttaatctagtcaaaatatttttcttcacaacattgctactttccgaataactcagatgcttaactatattctgccatctaaatttatatctgcaataaggcatggagtgtgtgcatcaaattttaggcaaatgaaaaagaactcgccccaggatactgttatggatgtgacaatttaagaagctacacatcatctgaaactattctattttctttgccagggttcagcggattcctacacaagcaggccgtctgactccgatgtctctttggaagaggaccgggaagcaattcgacaggagagagaacagcaagcagctatccagcttgagagagcaaaggtgagtctctttccttctctttggctcaaaagtgggtcgttgctcagtggctaccagctgctcttcccttacctcacatttctggaataatcattttgtgattattctaacaaggctccagattgggaagctctctgatcctttcacctctaagtgaggttagtaacatctccaaagaggcatttcctcagaaccttcacctttttgtatttggtttggtggtgaattattggtcgtcttccaacttagcaatatcaagcctcccatgcccagtgttggcagacagccccccaggcaccagctggccctgcctattcctggcccctcctcatccattacttcagcctttattacaggccacacgtgtgctgttgttctgtggatcgccctgtttgtttctctactcttctctctcgctttcagtatcccacctcaagttcagtgtgaagttcaggactttgaacaactctgagaagtgcagcaaagacaagcaataaaggccattgccaaaatagaccttcagatattccacaagaagaggcctccatagaaatcgctgcatccacaggaagcagcaaggagccaactgcatggttgaaagttagaaccagaagagtcactagggatctcccatttccatgtgcttccaactttgttttgtttgtttgtttgctttttgattttttgaagcacgaccctttttgtccaatgaaattttatgcacaatagcaaaatacaagacaaggtcatggccggcctgtcctctttgccctacgtgacagactcctaaggtatattggttcagtcttctgatttttagaagaagaaaaaacagaagcccaaataaagtgaattccttcccttttctatttttattgtaaaatatttagaggtgagaggctgtgcatggtggctcacatctgtaattccagctacttgggaagctaaggtaggaggatcacctaggcccaggaaataaaggctgcagtgaactgagatcacaccagtgcactccagcctgggcaacagagcaaaaccctaccaaaaaaaaaaaaaaaaaaaaaaaaaagaggggccggtgcagtggcttacgcctgtaatcccagcactttgggaggccgaggcgggcagatcatgaggtcaggagttagagaccagcctggccaacatggtgaaaccccacctctactaaatatacaaaaaatagctgggcgtggtggtgtgcacctgtaatcccagctactcgggaggcagaggcaagagaatcacttgaacccaggaggcagaggttgcagtcagccgagatcacaccattgcattccagcctgggcaacagggtgagactccgtctcaaaaaaaaaaaaaaaaaaagatgggaggagaatgatgcagtcaaattaggtgtcttcatttgcctcaacacctatgatgtctgtactctgttggtggaaggggcttttcttgcagtacatgtgaagggacatcagtgaggtttcagccttaactgctgttccccagtcagattcccagcacaaatacataagctggtaacaaagcagctcagaatatcaggaatcttgtgtctcactgtggctaatttttgttacgaaattttctttcagaatctgttttgtgaccagtgtggtcacccgaatttgggtggcagcaccgtttgcttaggctggtggtttacgtgtccccacagtgctgtgccagcctgagagcactttgctgagaggcatttgtgtaaaaagagtttcaaaaccagcttcgttagctagagagaaggtgatctgtgaagagccctgcccatcagctttgacgctgactaacccttcttttccccggcaggaccagatattctgttgtatagaatcccacacgttttcagatctggactatttaaaaaatactattttatcctcttcccacctttttttttttctttttaaaaagaccttgcacacatttcctgtattccaagttaagaagctattggttatcatttaaaataaacacagattttaagattagagaagagactgtcctcccctgcctttgtctatccctcttaatactttagagcacattttaaaatttggaatattggaaagtattgcaggaaaggaaaaatggttgggctgataggaccaatcattttcagagtcatctctgcaggtttcttgatattgcttgagaatgtaaaactcatttgagatccctctttggaaagttatttctcactacctggtactatcagagtttcaatatgaaaaatgctcctctctcctcccttcctcattccttattccatggttctgtccctagtccaaacctgtagcatttgccgtgaagacaaatgtgagctactgcggcgccctggacgaggatgtgcctgttccaagcacagctatctcctttgatgctaaagactttctacatattaaagaggtaaatgtagaacatactgcatcccttcacctgccaaaaagctgaagccaggaatcagctctgagccaaactagccagagaggagacccaaggagctgccagtgcagtacatgatttaatttgctgagcctcccaaatctagtcattctcattaagattgagaagtctgagatcattgcttgcattatcacacactgacaacattaaatcacagtcaaccttaaaattatagcatagatttctgacagacctctatggtcctctgggcacctttaaatccccttctgtgactgcagagccataaatatatggatccaactttggaaaatgtaagtttggtgtcatggcacctacccagaagggactgtttacaggggatgttgtaattatagacatgtagactatagtgctgtgcaccttgaccatggaaccaacactagagtgtataatcattcaaagaaagatttacagctaagaaaagggcagagggctctgggaaacagaaaggcaaaagggtaaagtgtttgagtagccaagaagggtgggatccaagacccctagtggagggacagacctttgatagaaagaagaatgctaattcattgtgacatgcagggaaaagatgagtgcaggcacagacacttcagggccttgggaataggaaactgaggacccatcaacttcaaccatggcctctactttcttgatggtatatgaggtgaggatgtctacatttgtctagaagacaagaactcttgacctgaaacatgtgccctggcatctgaatggttaagttgattatgtctcaccatttccatcaaaaatgcccaagccatattcattagttgctaatacccactgtgtccaaggagaagcaccacttgaaaaggtaagagatgttcttacatgtgacatgcacactcactcacaccaacattccaaccttgtatttgattgctttcctgcattgtatcaaggtctcaatttgtcctggctgctgtttgagctatgtgcttgttgatcagtgattttctcttcagtctggcagtttgatgtgacattgagctggtaatcttatgtggaccagagcctcttgttttcatgtcttgaaattatcagataagaaaacatctttgatatagaaagtgctaatcattttagggaaatccaaatagagaagggttggaacaacaccgaggtgacctctgtagagagctggcacaagttcccagaacatcaacacaaatgaatacatttctataatcaagttatagccttccctctcatccatcacttagaaggccatctattatgcaccatgttaagtagtttctcaataataaaaaaaaaaaagcttaaatgcagagaaaagctacaactatgcttgtcacataagccaaatgatgatcaaattaagctcttgattttacatagtgactttctccctagtaactcaaaaaattcattcctcctgagtcagattctcactgtgctttcgctgtttcctagaactaagttaaaacattttgggaagttgaattaaccatttcagcaagccctttaaagtcatttgggtgccatttaacaaatgagtgttccagtgggctatgccacttcatttcaggaagtaacttaagccctaggaaactatgactcatggtctgttttgtcctcaacacagtaaaatttaaattccagacctatgcacccaagattctaaaagggtccctttgccctttgttaattccaaaataaacagacctattattttaggcctgttatactaaaagacaggaaagtggggaaaaacaactaagacctagattgttcaaggttttatatcaggtcaattcacatttttttcttttcttttcttttttatttttttggagacaggttctcgctctgttttccaggctggagtgcagtgatgcaatcacagctcactgctgtcttgaactcctgggctcaagtgatcctcccacctcagcctcagcctcccaagtagctaggactacaggtgcactactacacccagctaattgtgtagtctagtatagtgcactacactagctaattgtgtagtacactaggtaattagtagtacactactatactagctaattgtgtagtacactacactaattgtatagctagctaatggtgtagtacactacactagctaattgtgtagtacactaggactacaggtgcactactatacccagctaactgtgtgtgtgtgtgtgtgtgtgtgtgtgtgtgtgtgtgtgtgtagacagggtcttgctatgttaccctggctgatttcaaactcctggcctcaactgatcctcttacctcagactccaaaagtgctgggattacaggaatgtgccaccatggccagccctcaatttacatttatttcaatgcaatctcatactttatgccactcatatagtatgcatggagaagctgtgtgcataacaaaggccaaattcttaccagaacatatttctcatgagtgtgaagctgttactcagaataatttaaagtttacccagaacttcatggtgtgattattcaatgaaaccttccattcctccttcataatgtatcagaatcatatatatatatatacacacacagacatatatataaatttcgcttttctatgagctcagcaaaatatactacatatcattgttacattttgaaaaaagtatatgtttataaatatatatattttgggtcaaaataggagagaattatcttgcccaacactgataaaaacagtaaaggaagtttttagaatcatctccagagagtttaaacaatagagctggtatctattttgtagaagtgacctagctgaaacctttccttgaggcagggagcttgaactaaattgctttctgctgtataattcagcaaatgtataattagaaatgcaattttgccaatccaccaaataagcccacattgacagactctcaccccacactggttgaagccttctcatagacttgagtttgcttgtcatggaacttaacttaaatggaaattctggagttcctcttgggcttcagagcgtttggaagttatttgcaaaatttcacatacaaatatataatacgctcagactttgtaagtgtaggcatctttttcttcaagtagtaagatggaccttaatttgcaaatctatatttgaaagatcatgactcttccccagtgagattagaccacagatagtatcgtggaatttttaactgaaagcttttgacaaattatggactattaaatgtatttcatctcagacatatctgtcttgccttccagagttccagttacattggtgcatatttatccttataaaatatgttctttaagaattggttagagcttcttgacaaagaccaaaagaatccaaaggttaggaccagacattagtccagggattcacaaactatagcccacaggtccagtctgacccactctcttttttgtaaagaaaagttttattgaaacacagccatgctcacttgttgatgtttgtctgtggctgctttcacacaaggacagcagattcaactaattgtaacagagaccacgtggtctgcaaagcctgaaatatttactacttggacctttacagaaaaagtttgcagaaccctgctttagtctatgcatctacctcagatatatatatatatagtatgtatatatagatatatatgtatatatagatatctatgtgtatatatagatatctatgtgtatatatagctatctatgtgtatatatagatctatatatgcacacatacatatacaatatactttatattaatatatagtataggtatatatacacatatatacatacacaatatagtttatataaatatagtatatatagatatatacatatatacatatacaatatagtttatataaaatgtatagtataatatagtatagatatatagatatatacacatatacaatatagtttatataaaatgtatagtataatatagtttatataaaatatagtatatagtatagtatataaaatatagtatacacacatatacatataaaatatagtttatataaaatatagtctatagtatagtatataaaatatagtatacacacatatacatataaaatatagtttatataaaatatagcatatcatatcatataaatagcattttattcttcttgtcccctaagattaataaacaacgtgaagataagtgaattactattgatagcaattttatttctgaattccagaaatataacaatgattggtggataggaaggctggtgaaagagggctgtgaaattggcttcattccaagtccactcagattggagaacatacggatccagcaagaacaaaaaagaggacgttttcacggagggtacgttcccatcttttctatgcacttttttttggtcagaaaattgggtgatattttcaagggtgtatactttcaaagtagaagatacttttctgtgtgcaaagtgtttctgaaactgacacagaagagtttcagatagttctctatcctctgtgcatgctgaagcctaacaccactggagaccatatgaattccatggcagagactgttttctgtggcctcagcaagccctccttggaacccaagctttcctctaggagagtcacttcgggcattctttctccacacagtgagtgggagctgacctgaaccagcagtatggctcctcttggttcgcttacagagactctcccttaagtgggcacaaaatgtgatggtatcgcccctactgggaagtgaggagcccctctgcccggccagccaccccgtccgggagggaggtgggggagtcagccccccgcccggccagccgccccgtccgggaggtgaggggtgcctctgcccggccgcccctactgggaagtgaggagcccctctgcccggccagccaccccgtccgggagggagatggggggggtcagccccccgccaggcgagacgccccgtccgggagggaggtggggggtcagccccctgcccggccagccgccccgtccgggaggtgaggggcgcctctgcccggccgcccctactgggaagtgaggagcccctctgcccggccagccgccccgtccgggagggaggtgggggggtcagcccccccacccggccagccgccccgtccgggagggaggtggaggggtcagccccctgcctggcgagccgccccgtccgggaggtgaggggcgcctctgcccggccgcccctactgggaagtgaggagcccctctgcccggccaccaccccgtctgggaggtgtacccaacagctcattgagaatgggccatgatgacgatggcggttttgtggaatagaaaagggggaaaggtggggaaaagattgagaaatcggatggttgctgtgtctgtgtagaaagaagtagacatgggagacttttcattttgttctgtactaagaaaaattcgtctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacacacactctgcctaggaaaaccagagacctttgttcacttgtttatctgctgaccttccctccactattgtcctgtgaccctgccaaatccccctctgcgagaaacacccaagaatgatcaataaaaaaaaaaaatgtgatggtatgtgcaggtcccggcactgatagtaccttctccaccccaggctttttgtggcatctcttgtctcctggtatttgggtgaagacagcttcaggtgaatcaacctctagtgagctactgaagtaggcatgtagatctcagagtgcaggtatttaaaggtcccaggaacacaagcacagcttgacagaagagaaaccaaatcatcctgagtctgcatgtattgtgtcgcagcctgcactgaagcattgatttgatatgttacacttttttgaaagttctaaaatagaagcagctctttctcttgaccctcaacctctgttttctgttgaatgcttttctatttcaaaaaactcctgtgttctttaggcgcctacctttgtcataataagaaccgcaccaactgtaataggagatcacaaaagtatagttaccccacttttaattaccaatcttttttagcatataacttgccaatactattattaatattaatccctcttgtcccttgtattagtctgttctcatacttcttctttttttttttttttcttagagtctcgctctgtcgcccaggctggagtgcagtggtgcaattttggctcactgcaacctctgcctcctaggttcaagcgattctcctgactcaacctcctgagtagctggggttacaggcacgcaccatcgtgcctggctaatttttgtatttttggtagaggtggggtttcatcatattggtcaggctggtctcgaactcttgacctcgtgatttgcccgcctcggactcccaaagtgttgggattacaggtgtgagccactgtgcccggcctgttctcacacttctataaaattggagaacttatgaggaaaagagctttaattgtcatggttctgtagactgtaaaggaagcatggcagcatctgcttctggggaggtctcagggagattttactggtagcagaaggccaagcgggagcaggtgtcttacatgcctggagcaggaggaagagacggggaggtgccacacacttttaaacaatcagatctcactataactcactcattgtcacaggaacagcacaaggagatggtgccaaaccattcatgagggactgcccccgtggtccagtcacctctcaccagtccccacctccatcactggggattacatctcaacatgagatttgcgggggacacagatccaaaccatattatccctttttttctaaaattttgtcttccatgcccctttttagacacatggggagcatgtgttcctgtcttggggtctttgcatttgctgttttttcttactggaacctttttcttcacacttacacccggccactccatctgctttatatctttgttaggtatcaccctttcagtgacccctttcctgccaattgtatttaaaattgtacccactccccttccctgtacttcccatcccttccctgacttagttttctctgttgcacttattactctcagaaatattatatatttacctatctatcttgtttggtataagctgagcatccataatctgaaaagctgaaatccagaatgttccaaaatttgaaactttttgaggactgacatgatgctcaaaggagatgctcattagagcattttcgatttcagacatttggattagggatgttcaactaagtatatagtgcaaatttccgaaatctgaaaacagtggaaatccaaaacatttctgctcccaagcattttggataagggatattcaacctgtactgatatgtcctactagtatatgactcaataagggaaaggattttgtctccccaatgccgctgtcttatttctactttccaaaacagggatgtacaatccatatttgttgaataaaataactgaattattatcattttcaaagttttattgttattattatttcttaattgttacagtcatgggccatataacttttttgtcaaagacaaaaagtaggaaggtggcagctcccgatggcatttgtgggcttcagggaagcttccagagcacacctgaggagaccagagttgaggatcttctatttaaataaataatatttttcgtgaccaattccctacgatcagttcttaattctgatgcccacataatcatcttgtaagaagaaatggtttctccaggtctaactgcttgttttgagctgtgtttgacatctgactggcacattggtgcctggtgttaggttaacaagcagttcataagaccattcccgtcagtgatggttttgtctgatttccgcactgagtaactagaagagatgcttttgcagagtattccaggtctcggctagttctccacattctcttagaaatgaggtcaaagaaaacatttggatagattcttgaagttctttatagcagaatttggtgtgttttgaattatttaataggatgagggccaaagaaagctttgtactctcaagttctattttcaaagaatctggggagtgagtctttagttccttttctatatcctaggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggtgagaaatatagatgtttttgtatttttattttcctttaaccaaacttgtgtgataaattgaattgtagatctatgtttccagagatttcagaagttctctagttaaaagttaactcagtattcttgggaagaatataataaaagaactctgaaaatatgaagtataacattgagtccccagtgaagaaaggaccatgagaagaaaaataagccatttgttttatttaaatgtatatatctttattttctcagttattaataatttcataccaaaatgttttttatgaaaaaatattaattaaaatatataatatttctcatgagtatagtggcttgctggtcaaactaggcagtatttgggaattgtgtatgtgtgtgtgtgtgtgtgtgtgtgtgtgtcatatgaaagcataaatgtcaagtactgaatttcctcaaaagaagagagtgagaattattttaatcataagcctcccaaagtgatcattttgtagggaatagtacttatttggatatttattatagttgtgggttgtttttattagaaatgtccttgttattttattgatctttttttaatgtattttactatgatccatcaacaatatggctcaggcattagccattaaataattttatcatttaagttttgtgaaaaattctaaagaaagtttctctgttttgcagagaaatggtaaaaagcctgtattgactcaattctaaatattaagctctttcacagtgctgaatgcagtccatgtaaaaataaccacatgaaaaaacctgagatttatcagaaatgtaggaaatttaaatggggtgcatcaaaaagtatgggcaaatgcatccaatttattactgtaggattgaagaaaaacatcacattctttatttttgaaggcagtaattaagccattcactttctctttgctaaattatgagaatccactaaatgcacaaaataattttaaaatgtaaaaaaacttcagatagattttaataaattggtatattaagaataaaaacaagcatggtattgctttaaatataaattgtatgcatttgttaaaataaaagctttctggataattgggtaaaatattcattagtttctggaacaatatagaaagttagtaaacagattttagtttaagaaataagaatgcttctaggtacattagtatataggtcaggctgccttaataaatagaccccaaaatgtgtagtgattcaaacacaatggaagcttattattgctcacttaacagtctgaagcaggtgttccttggctgggagggaggatagagttgggggaggggagaattgggcagaaagtttgttccctctgtcatttggggcccttagcccaggtacgatgtctctagtcagcttgcccggcctggaggtagcgcaactgacatttcactggttagaacttggttatgtggtcatacttaattgcagcggaggcactcttgcagtccaggaggaagaggagatagaatttgttgaatcaataatagccttcgtcacattcatctactggacaaaggcttaataagaaagatgtatttgttccatttcactctctttaaaaaagaaataggcagataatgaagtagcttcaaagaaaataagttaaaagccctgaatcctagagcattggagttggaaggatacataaaatgtcttttagactcatcatttctccaataaccacaatcagatagacaacctgcttctgtttgaaacttttggttattgggattacactttctaaaaaagcattgcaaaaaaatagctgaactctgactttgtaacttaatagggctggtcttggtcttgctgtctgatgctctggccttaaccctaaccctcatgcaggtccctgtggattgaaggcagccagcatgccttggtcgcacgtgcatagttccttcagatatgtatggagtcacatggtttcaacctgtggagctgttacctaaggcagttctgagcagtgccgaatccactggccccataacagccctatctgaacaaatcccatcccataagacagtgttagattattttggtctataacatacttatacgcaacagtgctgttaaaggtttgccctcaagaatgaagaatctgatgttcttcctcaatcctgaggcccagaaaaagggaatttatttaattgtaacagcagagatttgtctcgaatcaagtagaattgtcgcatccattactgtacacatactactgaagttggttttaatagaaattgaatgcaaatttcaatctcaagtattcatggggtctgatgacatggcagagggtctggaggaagagcccagcagtagcaaaagtaatagctgaagagagagacttagccctggagaaatctgatatatttctccagcaggagaaagataggtagatattaaaggggtgaggggtgagagaatggacttgatttcaaatattaagaggccaggcagcagaatgaacaataaggagttccttggttgagtgtatgtggagactttgataagaaagaaattcgctggtagcgtcacactgactctgacatgtcttcttcgtggggaatatcgttaggttttgagctataacatcatgctgcattatgttttaccaattgatacaaggagagaaaaaaacaaatagtctttaattgaaaccagccaagagaacaatgacaaggaaggctttagcacagtgacacggcataaacaatatgttctaatggaaacctactctgtgtttcatgggctatgaatgcagtacgttagacaaaataggagaaagtcctattatttttcagaaagtacaaagaagggatctgttggctacgaggctttcttctttaatctgcttttcagatcttagtagaaaataattcaacaaattggatgaaagtccaacagtttgactattgcagaatcataaacttgggatttttttgataccttagaaattatttgagtcagtttagagctacttattatacaattttattgctgtagctgctattgtggggcctaactgtaatacatgtaagaaaaacagaatactaggctgggcgcagtggctcatgcctataatcccagcactttgggaggcccaggtgggcagatcacctgaggtcgggagttcgagaccagcctgaccaacatggagaaacctcatctctaataaaaatacaaaattagccaggcgtggtggcgcgtgcctgtaattccagccactcgggaggctgaggcaggaaaatcacttgaacctgggaggcagaggttgcggtgagccaagatcatgccattgcactccagcctgggcaataggagcaaaactctgtctcaataaaaaaaaaaaaaaagaaagaaagaaagaaagaaaaagaaaaacacaatactaaacagttcctgagcgccctctgtatttttgaatatctacatgaagcaatgattcctgtgctgacgacgacacagtggatacacaatgggcatggagcttctctcttcatttcacaccacaaatattaattggggattacccatttggatgaggtttgttcagctggctgaatctaccattcacaggctgaacagccagcagtcaaaccagttgcagtttgttgacctatgccaatcatttcaaatcccccaaaaagttgttactttaggcttttgacaactggatcagatcaactctgtgacatttattggacaatttgtaactgataatgatcatggccaaaaatcttagatgaacatcgtgtaacctacacagataggatctcaagctaaaggatgcttttagcctaagaacacataaagggaaaaaaagggcttgagaaagaatttgaaagaaaagaagctaaacatacaacttagggagactcaaagcgatagtatttattaataaaaagaaatgggaacaattggtgctgtcacaaggcaaccaagccatataagaatgaagataatttctaattgcagtcaacaaatggaaaaagaacagcagcaacttccgtttcgtaatcaatttcattctcctatgcattcttcctactgttttctattcaaatgcagactcataaacagccactcaaacaccagtaataattaattgaacacttgagtgtcaaacttgaatatttaaattagtaggttttgagtacagtgtatctgacctgattctctcacccacatttcacggactctgggaatgagaggggtcatggtagactgcccacttttgagagtaggacataaggaaactatctccttcgagtctttaaatctccaataattgtttgccttgtgtacattatatatgtgtttattaacagaggacactatgaataattatttaagaatgcgcttttatatataaccttatttgctcttaatggcaaccccatgagatagttatggcaaagctactattgccattttattgattaggatactgaggtcaaaagatggaatgactcatgcaactaccaagacaaagatccaggaagatactcgggtctcctgtgcctttccattctcctgaaagtgcactgttgcattcttcggaacactcttccctactaataccagaagttttcaaaaattattatactgtctgggctgcatattggatgtagcaaggatagaatatagacagatcttacagctgttacgttaccagcgtggaaatacaaattattttttgatgaatctgtcataactgaaagtaatatctttccacagaaaatcacagaaaactaatacaactcacgatggattgcagcagttaggatgaattctaaagtggaaataagcaacaattggggttcagatttactatatttagggaatgatgtttgctagttttcaggaacattcgctgctacatccagtctgctggggaactaaactcctattagtcttttacctactggccagcaagtcacagaaagttttccaagggaactttttagagatgtataccaaacaaggtacatgggaatgctgaaactagggggactagctgagactagggggtctcagcatagcaagaaaagaagtagaaaggataccactttaagttaaaaaaagtatataagctagatagtattcagttgtgaatgtgattgcttttctggagagccttttataaaaaagaattttgggtttggtgtctggttttgataataataagcatctatgcacagaaaagggaaactcctattttgtcttactgaaggttttctagggctgtgcatgtcttcttctgagctctgttttatgcatgtgtatttttattaatcaataacttgtattagcaaactaacttgtattagcaaataaaatgagaaaacgtgccctttattgtctgcatctttccctgtattggaacacatgaaaaggtttttttctgaattttttcaaactttggtcgtgtttgaaaatagctttgtaaaagtacttttataactcagaaaaaaaaagtgtgaatctgatgataatcccttcagatttgaagaaccaagagtctcttgtttgtatagaactagaaaattttattttcactaaaggagactggaattcaactttctgggttgttgggccctccaaacatcattagtccaaaaatcactggtctagaaagttgaattctgtccctaaacccaccgacttgtctctcgtcatatatttggattgctctgaaacatgcctgtatgtttctatccagcagctccattcttaaataaaccagaaacccaaaaacacaaaaataaacacacatcgctgagcatggtggctcacacctgtaatcccagtgctttggaaggctgaggtgggtagatcacctgaggtcaggagtttgagaccagcctggccaatgtggtgaaacctcatctgtagtaaaaatacaaaaattagccatgtgtggtggcacatgcttgcaatcccagctacttgggaggctgaggtgggaggatcgcttgaaactgggaggtggaggttgcagtgagttaagattgcaccactgcactccagcctgggtgacagagcgagactccgactcaaaaaaattaaattaaaaaaaaaaaaccacacaaaccctattctggagaggaaaggagctgcctatgagacttcatgcctgaaagctgcagtggccaactggagtaatagaaagtcaggtgtgggtttactctacctcaacttgatttaaattctcactatctcagagcaaggcgaagacttgactgtgcatccatgcttgaccacttgactcatagcttgagattcgggcttgtagaacactgaactgtaagagaatggtggagtcaggtgacttggcactggcccgatacccaggggctagtttagacctgagctgtaactaaccatgtgcagctttctgtgtgtgtctcagtttccctcttggtaagatgaaaaagttgttacaccagtgttttccagtgtcttttagcagttgaacagctttttatagtgaaatcatatataaagccccaatgcagaaaacagaaatgcagacatgtttacctggcactgaggatagtgaagctggagcccactgaacctccctttagtcctcagaacagtccctgaggtgtatctgcaaaaactcttggtttctgcgggagacaattttgaagatgcatcaaataatgaaaagggtctaacagttctaaaattttaagaattgaaaacttcctgacaacccacagcatataaacataatgacacaggcaagcagtgctttgcttaaaatggcaccagaacttttgcacagactgttgttttaaagaatgatttccaaccatctgaggaaaggactattttaaattctctccaaggctttaggtcactgaaatcaggtacagtctcctgacatagctggcagtgttgtccccagacaggtatgaaatgacatatgtttcagtaattgataattctaccctccttcctgcttcaatccccaaagagtttgaaaacagaagagaatgggtgtactaactgagtataaaaggggaggggtgctactttccttgtctcctttctgggaaccatgctgtgaagatgagaatggagaaaggcccatggtgacagtaactggcctaaagaggcaagctttgaattctactggtagataattggaagttgagcaatctcagtttaaaatagtctttaaattctaagttgcagatattctcatttgataaatcatatgcaaatagatgcccctctgcatttatttgcaatgtctttgctttattcttcagttttttttttttttttttgagacagggtctcaccctgtctcccaggctggagtgcagtggcgtgatctcggctcactgcggcctctgccccctgggctcagatgacctcccccacctcagcctcccaagtagctggaactacaggcatgtgccactgtgcctggctagtttttgtattttagtagagacggaggttcaccttgttggccaggctggtcttgaactcctgacctcaaatgatccacccatgtcggcctcccaaagtgctgggattacaggcatgagccaccatgccaggccctgctttattcttctcttgcatgaccgaaggatactttctaacgtagaaaatcctggcacaatactcacattactttcaactagagtgccttatgactgcccaccgtatgcattcaaagtcttatgcaaatatgctgaagaatcttatgcatgcagaaaaaataaaaccattttttcacattcttataaatgaagtatccctttgggcctgtggagaatcacgtgtgtatcacaaaagaatgcagcttagccacagactggtagattgtctttgataatcaaaatgaagagggtttcccagctttgactggcatcattaaatgccagagcaaagcatttgtagttcctgaaggtcttgttcaagagcaaatcaactatgaattgtggcaaattgtattgctacttcctagaaagagcatggtttatttatatgtcttgattccttcctggtgtggtgtatattataaagggaattcagcaaggcaggccataatggaggaagaacatttttactggagtaggtttttttgtgtgtgaaacagtttaaaccttcctccattctgctctgcttgcattctgatactagccagagcctgtttaaaatacttgtggccaatgtttgttatactgtggttcccctgtagcatgtaaattggttattaagtactgtggttataaatcacttggagagccccataacatttttactggcttgttctgttctgtgttcctattcataggatttcaataacgagagtgacagctgacatttctcttgctaagaggtctgtcctaaataatcccagcaagagagcaataattgaacgttcgaacacccggtccagcttaggtaagatgttcaaatgtggtacttcttcaagctgtgcttacagaccgggctgacacatggtgcatttgtgaatgtctttttcaatttgttccccattctgaacgggggagcactgagtacctaaaaagaatgctagctatggacaagaaggcaacagagtcttgcagtagcgagagcttgctgtctctcagctttagtcaattagctaattagtagtctggtggaaagaatcctcaatgggctctcctagtcttttcctgcctaactacatgaaaccagtcatctccactttgctcagcttctcaacaaggctaatgatatctgtcatacctgagtcacagctgacataaaaggaaacgaggtgttcagccttctgagatctttagaagaaaagctagataacggtgttcttggtgttgtgaatggcaatgaccattagtaacatgcagggactttaaacatgtctttcctggggtaccagttggaaagcatcctaaaattccccatgatggagaagaataaaggctgtaagtgagtagctccgtcaagccataggtgagcagggctgtggaggatggatcataacccacagaagcgagtccatagtgctggtgaattacatcgttcatctggaaagcctgttcatggtctccacgattgccaagggtggtgtagtccactcatgacttcctaggattctctttacattcatattctgagggcaacttgttttaactaggaaggataaatagggctcttccatgccttacattttttaaactgttgaaattagctctatagataatagaaaaataaaattaagatttccaagacagagtgcatgccctaacatcacattaagaacccattgaccttgagccaaagatcgtgcaatttgtaaagaaggtacaaaatattatctgtgtgttcctgacatgggattggcatgtgataattgctaataaatgtgggatggttgctttgtgaaggattactaaacataccaaatagagtagtggtcagtgcttgtgaggggaagatcccagcgattagtggtcccttcttttgtcttgtatttagagccttccacatgcagagggaaacatgctcaaaggcacagtattttgaccttgaagaggtacaatggcagtgttgatggtgaatcctattaggtaatgactaaagttaaatatcatgggtgacagggacattaagttaggttgaagtttctcaaacaaacatcaattctctgctctcctgttttctacccattttgtaactccttatagtgtctttggcttttaagtactccttctaatgtatggtgagaggctaaaagataattaaaagcttaagccaggttgtctgactcctttaaccattgacacctgccaagggcttcatgtgtattcactgaagtcattccttacaatccattcacctgctgtcagagtcagtggggtggatggggggcatgttagtgtaaacaagaagaaacaaagtatatctcacctcatggtttttacctttactctgtaaagtcataaacccacaaccattggaattaatttcatggcaatctattaattttataataaccacaatgtgatccatttgtgtgcttgttaatgcacatttgtagattccttcatcaaatgtttattgaacacttgttatgtgccatgcattgtgctagacttaggaaataaagacataacccacacacagtatcttacccatgggcaaagagacagaagagacagatggttagaatacctgtgacagtggaattatgaacaaggaactaggggtataaagaagagtaggggttaagagatgtgtgagaagacttctcagaagttatatttgagctggttcttcaaggcaggcaggaatgtacaaagacattgacatgtaaacaaaaatatgttgttgagaaacaagtagatttgtgtatagcatgcttagaacagggaagttggtggtgtgatttgagaggaacagaagagattgaaaaagattgaggccaatgtgttggggttctaatgcaccttgctaaagagaactccaaaatagatcccatgcaatgttaattttacaacatagtaacagttgttacattcagaatgttttccattgtcaaataaatttggaaatgatgaattaaactgacaggtttcttctctgcaagacttagagccttgaagatatgaaggataattcatgtttgaaattctaaagagaagctattatagtattcaatataacccttacacaaaacccccttcttcccataggatatcttatgagattattgttccagagtactcactttgggaaatgttgctttggaccctggggagccattgaagtgttttaagcatgggagaaatatgaacaggtttgagtataagggatataatttgtgacagggatcctggagagaggtgggcccaaatcatcatggtcagtttatagaagtgttcatcgaggtcctccagcatcatagtccatgactccccagggctccatttgactggaataggattatgaggaaaacttatttggaacccctctgagaatcagtccaggtagccaagattttttgatttggttgagatctttttctttaaaaaacaaaaaaagagctatatagataaatatgcctcacagataaaatatatttattacattctgtatacatattatccaaacattgggctcaccccagtatttaatgtggccttctccagcatccctgctggcttgttctgcccaagcacctctcttcctctgcccaagtgcctgttgcctaagagttttgtgttggttaagcagtaggtatggctgcccttgctcctggcagaaaccacacttaacctcattgctggtgcagagtaaataaggcccaggtatttctgagtcatttacacagaaactcagagtgccttgagggttatttgtaccagggcagtccagttcacatcaatgtctttctgctgcttctgaaaatattgtattcatatttgaagcttaagaaaacataggcttgctcacatgtagtcctggccaggagctcccataagccagtgacagtttaatgaaaacagcaaatgggaaacataccctgacatcctgaggctgaaatttactacagtaaaaattgactttattttccaaacttccttctgaagaaaatttattttaaaactgtttctgccatgtgagagaaaaggggacaaatatgctacattactaacaaatgtagaatatgatttcagaagaatttgacaaataagcccacttgttttcattaatattctgaaagctagtcacctttccaagcaatgtgaagtctttcaggccattggtattggataacatgaaaagtgatatgttgactcttcaaattaatcctttttaatacagatcatgccttaaacttcagtgattctatgggaaataagaattttatgcaatcatgcaaaacataagaaaatagattttcatgatagtcttgagtattcatgaccctgcacaccttgtcaatccttttggttaaggaagggagaatttttttggtgggctatgtgaacttgaatttatactaaataagcaaagcaaatcacaaacacttttcaatgaggatatttagagcaacattacctttttccctaggccatctttagggtcgtttaaggccgggtacaatggctcacacctgtgatgccaacacttcaggaggccaaggcaggagtattgcttggactttggagttcaagaccaacctgggaaacttagtgagacccagtctctacaaaaaataaaaaatttagccaggcacagtgatgtgcacctgtagtcccagctactcggcaagctgaggtgggaggatcacttgagcccagaaggttgaggctgcagtgagctgtgattgtaccactgcactccagcatgggacacagagtgagaccctgtctctaaaaattaataataataatttaagttagatagttttgtgtactgtatgtactttggaccagattacagcattgtttggtcacacctatagccaaaaaataaaaataaaaaacaaaatcagctgggcacagtggctcatgcctgtagtcccaccactttgggagaccaaggtgggtgcatcacttgaggtcaagagttcaagagttcaagaccagcctggccaacatggctaaatctcgcttctactaataatacaaaagttagccaggcatggtggcgtgtgcctataatcccatttatgtgggaggctgaggtacaagaatcacttgaacccgggaggtagaggttacagtgagccaagatcatgccactgcactccagcctaggcaacagagtgaaactgtgtctcaaaaacgaaaacaaatcaatttctctgaaaatcaaatagtataattcagactttgggcatgatccaataagtcaggtaatttataaaatatatatatatatataaaacttttttatatttcagaaagccatgtcctatgttgattatctgttttccttaaaaaaaaaaaaaactggattgcttcagacatttgaaaagagtagatttttcatttgactagactcatgcacagatttgggtcacttggctattacagccagccagatagatttgcatctagatgcattgcagcgttttaatataattggccttacttttttttttttaatactgaagctaattatgccttagaacaagtacattggctttcgtacttaaatctaactagacttagtaatatgattagttttaagggtagactcagaacaattaaccagtggtacaaaaatatgcatatcagtcaaaacagatgagttgtggggtttttttaaaagaagcatgtccacaaagtattagtttatacttcgttgatagaaatatttcagtgtaatttgctttccatgtgatgttgctttgcacatatatttcagttgttttctaaatgtgcttttagcttctatggctaacattaaagttctttagaacaaaacaacaatcaaaaacaacataaaataatcatcgtagttatataaacagctaaatattatattgactagaagaagcaaattaagagagccatctcagacgtttctaccaactggttgtatgcaaaactcaacccatctctgtctatatttagaaaatgtcttaaattagacaggactatgaaaatttaaaatgttttattttgtaatgtagaccaacatatctgaaaatatactatatctttctaatgtaagaactaattcataacaataaccgggatctatttattatttttcctttaagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggtaattagctcctttctgccttaaggtttagaagtgcatcttttaaaaatgtgttttgctctgtggttttttgttagtggacaaaggagaacgtcttgctgattattaataagcacatttaaaatctttccacagtgtacagattctatgaattttcagatagtgaagaatataatagttcatttcttctaaaagctactattgtagatcccaaacaagacagttatgcaagtgtataatagaaacaaaacattaagacagatgtggaaaagtagactctggcttatcatagactatgaattctatattggtaaatttcttggatcctgttgattcctgtgtcatccatactctgtacctagttgagagagtacatctatattgatcaaaaaaggcatctatgttgatcatatataaaatagaatatcactgtttaaacatctcctatggaagcattatagaccctgacatttgtgcttaggttgagttcttgaaagaatgtggttattccacgataagcacaatgggaaatttgctttgtatctttatgccattgtgggaggtaaaaataaaagtgaaatagccccaaattggtttcttttgatttgggtgttctttcatttttaaaaaaggatgttgttcttaaaaagttaacgtgaaatggttacccttgggaagtactatcttaataatcagtttcttctctgtgcctcctagtgtattttggtgcctaaatacaaattcaactgccaaccagcatggcagtcttctctcatgggtggagaatgtctaaagaagctgtactctcctccagatgttctgagatcctagccttccatctatctctgcagacactgctttggtgcagtggacttgggaatcctgaacaaactagggccttttgagaatcagtagaatggattgaaagagctgctgggggttcaagcacttcactgcagtgcaggagagttcagcccttcccactgcccatgacactgtggtgtccttaagtgcaagaacaggagttcccagacacctatgtcctggggtattatagagctcatagattagcattgtttgcaggggaagggccacgggacatggcagtatatgaccaaatgcagttacagcagtggccaaaagacatagatatatcactggtttacatgtagcaatatactaatacaaatgttttgcctgggtctccaatcacagaatagtctgattaatttaaaattaaactgaaatgtcccattaataatcggtgacaaaaataaccagaaaatgactctgacatttatctgacatggagatagtgagctaaaacattattcaggtgaataatattaaagtattacttaacataaatgacctggtacagtccactccctccatttttacaggtctctctttgaaatctctgggaaaaatctaggatgggaactcaggctcctcctgagacttcacacagagttagaataggatgaacatatcaaatccatggaactgagagccaatgtaagcagatgacatcattacaggtttaaatatatgatttctcacactgcatttcctctctgataatactcagggccaagcagaccattaaaaagatcctggcttatttgattttctttcaactcatctacaatacctcaggttcatgtcttcttctatcaggttttacagcggttgattaaatctagaggaaagtcacaaagtaaacacttgaatgttcaactggtggcagctgataaacttgcacaatgccccccagtaagtatgatcattttttgtcttcatcattcttgactagttagaagagggtgggtttttttttcttcatattgttgttttcattctaaaatgatggtgatgatggtatgttgtcatctaaaagatttcttggaacaaactgctgctgttatgttgcttgtattcaggcatccagatgtggatggtgtttgccttgtaataagaaatgaacttagtgtccggggtctgttcttctcactgctaccttgtttgctttgcaaacatgcagcaaaccacttagcattcagcctccagtcacatggatacgcttaagaaaagaacaaaagaaaacataccaatttgatcttcctttaactcttctgcaagaaaattccagcaggcataaaagattatgacactgaaggtcaagaattgattggaactagagaggccctgtggttatagtagatgaaagagtcagggctgagtcagatgaaaaacgaaattatagcaactcttcttctagtgccattgccagaaaacagctgctgggttagaaggtgagcaatggtgggatggggtgggagatggaactgctatcacatggcactgggtccccagtggccagtctctccacttttcccactgacttactatttctgtgcctatgtttctgtaaaggaaataactgtccttcttactcaatggattcactagattgttttatacacttgtgtaggattgtttaagctctatggaagcatgaaatctgattcaaatgtttagagagggcaacacagcataacctgtaaaagcacagactctggagccagatatttgggttttgaatccacactgactagttatgtaatcttgggcaagtacctatctcatgggattggtgtaaggattgagtgagtgaatatgtggtaaagctgttagaacagcgccaggaacataagaagcaccgtctaagttttcttattataattactggatacactttgtgtgacgtcatgtctggtccagtagactctgtaagaacccgtgcccctctggctcactgttgtatgtcagttccctatcatagtagacccataatatatatttgtggaatgagtgaataaatgaaaggatgttcagacgataagagtaataatgcatcctttcattagatgcttacagttggccacacagtgtgctagatgctttacatagattatctctaatcttcacagttacctggtgagataggccatattatctccattttatagtttaggcaactgaaaacagagacattaaacgatttccctaaggtgacatagcaaattaggattcaatctattctagatctatctggctccaaagacaatttcctaccccctaacccatccacccatacacacatgtacctggttacctaccctgaagataatttgatagcttggagcatggcgtgctctgttaagtttcacttcacgctgcctgttagtgaagcccaattacacagtggaatgtatgattaaggcactgaacagacagaggaatgtattgcccagccctgaccttctaatgtttcacagttgaaggaagataatctttgttgtctagctatcaaaagccgggaactatgttattatttccaatttttggaacaatcttataaggatagttatatcagtttggtcttctgggaagcagacacctaaatggaattacaaatgcaagagatttattggagaaattttatctttatgaaaataagtttattaacatttattctaataattactagagaaaattcttgtgtcctattaaatttgagggattttagctgctgagagggttgatcattgagtagttgtacatataatatggtttgttacatctgaaatagctggaatcaagaaaagatatttgcatctgtaaaagcaactaatatactgagctaccttaggacttgtacccaggtcagagatttcaaacagctccatgactggaaagacagccttgccttaccattatctcagtaggataaacactttatctttttatataattggtaagataacctggaattttaaacaggcagtctggatggataaggttaccttgtacttagcattttctaaacactgtttactttattaaacatgttcaattgatactgcacagatgtagtaatgctgaggaggaatagtatcctctattttggcatgtgtgaagaaatctttggattataaaaaccagtagtaaccttaaaatgtgtctgcatttgcccctgctttacttcaagaccataattataattgtcatccaaagattggtgatcactgtgtcattttaattcctttaggagaatttgcgacttacttaattggccaccatatctccagtatgaaaagtcagcaaattacattggcagagtatcacattgctaagaaatgaaaggcaacagtttttggaaagggaagcctataggagctctgaaaaaagttaacgctgtagccagaattaatcctagatccagggactgttgaagcaaaaggggaccttaaagagcacccaatatagtatttcctagactatattatttataatatgggtcctatgtgatatcagtaagtgttatgggaaaataatcctgataccaaaaatgtttgagaaaacacttaggtgaacaaaggtagtctggtttctttactacagaaccctgaatatgccaatgtgtattttatatctccaataggacaaatagtgtgcacagcttcccctaaaattgtgactgcagatctgcttttccattgagcatcctatgggtccagtggaacatgtctagggaaagacttagtccaatctcctcattttacaaatgatggaactgagaccaagagaactggcttttcaaaggttgtatgcctgggccaaagtcagcttaagatctctttctcctagtctagcaagactagatgatgaatggcaacaggtcagttatatattctcctggaaagaaaagtatgggttttggccaggtgcagtggctcatgcctgtaatcctagcactttgggaggccaaggcgggtggatcatgaggtcaggagtttgagaccagcctgaccaacatggtgaatccccgtctctactaaaaatacaaaaattagccaggtgtggtggtgcgcacctgtaatcccagctactcaggaggttgaggcagaattgcttgaacctgggaggtggaggttgcagtgagctgagaccatgccactgcactccagcctgggtgacagagcaagactctgtctcaaaaaaaaaaaaaaaaaaaaagaaagaaagaaagaaagaaaagaaaaagaaaagataagtatgtatttcatgggtaaggatttttctaggagagagatcggtgaactttttaagtaaagggccagatagtaatatcttaggctttgtgggctatatagactcctttgcaaaactactcatctctgctctcgagcaggaaagcaaacatagacagtgtgtaaacaaatgggtgtagctgtgttccaatcaaacttcgtagaggcatgagacaggcctgatttagctggcaaactgaacttgcccccttgttctgggaccaagctatggttatctattactctgcaataaaataatccccaaaactcagtcacttcaaacaatggccacttgtagtattcagctggcggctgacctggtaccttagcagaaatggctgaaggctgggctcagccagctctttttgaatacaggctcttacgtggcagctcccaggctccatgagcaaagattccaatcttttacagcctgggcatagataccagaccacatcatttccacagcattctgtttatcaaaatactcacaaagagctgggtgcatggtgagtgcctgtagtcccagctactcaggaggttgaaacaggaaggtggcttgagcctaggagttcaaggctgcactgagctgtgattgtgccactgccctttaacctgggagacatactgagaccttgtctctaaaaggaaatttttaaaaattagctgggcatagtcctagctccttggtaggctgaggtgagagaattgcttgaacccaggagtttggagctgcagtgagccaggattatgccactgcactctacccgacagagtgagacattgtctcttaaaagaaaaaaaaatcacagaggctgcctaaattcaaggagaggggatataactcttcatctccatgagggaatgtcaaggaatttgtgaccatttaaaatctgtcatagacagtaagatgagtggggaaaatgggctactggatagttctactttggaagaggaaggactttcctctcgttgcccattcggaattcacagaagaaaagatgggatgcagacaaaaggggacctaggggaacaggacctgcaaacccatctcattttttttttaatatgaccagcctgattttgtattgccattatacatctatacactacatttttttatttctttttgcttctaccaagtattgatattctttttctcttcagataagttgaaaatagtatgttttttaagaaggccaagtgtaaacttccccagtactatggtaataagaagaaaagctgagagacagacaattgaacatataaatgaaatgtaatcctttaatcctacttagttacaatctggcttgtgttacccaaagctgaccctgtggctgtttgagctgtgtaatgtttttttgtgtgtaaaatgacattgatcactccttctgggagaggggaactcatctcctcagtagagtcttgcaaacctctaatgttacagtaaccatggtcactctgttctgtcgccctttattttccactgctgaatggactcagatttatcctatgaaacacaagaattctggagcgaatgatagtgcccagttatccttgatcatattgctctcacagtagtaattttccactgccctcttccagtcattttatttgaattatttagaatcgtgtggatttacctgtctatttgaagtgctctcctcattggtgcattcattattcacagcccctggatgtccacagtttaattcctaacattgcttttgaaaaggggggtaatcaatttcagatgtttgcttcatgaaataagaccacatgggatccaatttctctcagcccaaaggggactacaccttttccagggatttcagccactggacttgggtatatcgagttaggggtagttcattcccaccaatgctatgatctagcacatccaattaatctgactttaacagaagcatgggataccttttctgtaggcactaatgttggtagatggtattatctttgaagaatacgaatggacagatggaggggcgtggggaggaaaacatgtttgggttcacatcaagtgtcacaaattatcaagagagaggaagtcaaaagaatcaaagttatatattttttgccctcattttaacctcaccaattactggcaagaattatgattatctttcctgtttagctcattaaagtggaaactacctggaactaactgctagagcccagtaatattgtcaccccggttggagtgcagtggcgcgatcggagctcactgcagcctctgccttctgggttcaagcgattctcctgcctcagcctcccaagtagctgggactacaggcatgtgccaccacacccagctaatttttgtattttttaaaagagatttttgtattttttaaaagagatggtctcaaactcctgacctcaggtgacctgcacaccttgttctcccaaagtgctgggattacaggtgtgagccaccgcacccatcatagatcttttaaaagcccttcaacttagagtctaatttcccatcattagttgaccagtgagttaaatactcagaatctcaaaagctttaataatgtaaagaatggagttttgatatgaaagaaccattgggttgattatttttataattagcattacatgttgtaccattcagccgtttgattttactgaacagtacttgccagtctttttttgtgcatggtttgttttgttttgttttgttgagacagggtcttgctctgttgttcaggctggagtgcagtggtgcaatcatgacctccccagctcaagcaatccttctacctcagcctccccagtagctgggtccataggaatatgccactaagcccagctcattttttgattttttgtagagacagggttttgccatgttgcctaggctggtcttgaacctctgggctcaactaatcctcctgccttggcctcccaaagtgctgccccaatctttttttttttttttttttttggtgtcagtttcagggtctctatattttacaatagcaaggaaataaaagtgtgctcacccatattatttctttttaccacttagaaataagaaaaatgcccaacatgcagttttatctatgtacaacaaataaatgtaaagcaatgcgtatcattataattattattatatgcatgggagagttttgttacatttaatcccctgtctagctaatattcagtaatgagccaactttaaaaagtgaagttcaggcacagtggctcatgcctgtaatcccagcactttgggaggctgaggcaggtggatcacttgagcccatgagttcaatatgagcctgggcaacatggggaaaacccatccctaccaaaaactacaaaaaattagctggatgtggtggtgcatatctgtagtcccagttactcaggaggctgaggtgggacaatcacccgagccccagagattaaggcttcagtgatcggagattacgccactgcactccagcctgggcgttggagtgagaccctatctccaaaaaacaaaacaaaacaaaacaaaaaacaaacaaacaaaagttaaaattaaactgcaaaattagtttctacagtttataaactttttattaaaaatattcaatagcttcctagatttaaaaaaacagacaatatgcattagttttaatgagattctcccctccatgctagaaaatatgtattttatagtcattaaggaagacttacccagtgtctttatatatcttccctccaaaaagaattgaaaagaaataaatggaatatgcttcatttcctccaggtaggacccggagagcactgtatcttctgtaaaaagtagggtgacccaccatttgctcagaattttcaaggtttagcagtgatagtctcatgtctcctgaaacactgagatccccagcaaccacaatcattggtcaccttaattcaggtggcttccctagtaaagagcattacttcttactctgtaaatggagtaccaaacagatggttaaatacttttttttaaagaccttgcaagtattcatttccattttattcagtttcagtctttcttcccctttctttcttctctgccattttagctttcatacccactaaatgagctagaggcatgtttttcactcttcgttatttacaatgcttttctttttaattttcttgaaggagcttatccagaaagggggcctaatgtgcctgatttttttgatggtttgttttgattcccctattcactacttatttactttggcagccacaccattctgtctacctcagctgaagagaatatcccatcatacaagggcaaaggtgttccctgtggccatgctttgaaaacagctcagcgttgcccttctcttgggctgcaccaagggcatggtatcaccgagtgggtaactgttcgctgcccgggacttctgctgattaggagctctctgcatccatagcccatgctgcaggccacatattgcatagtaaggagctgactacacttgaacctttaaatttatgaaaaattggcatagctggtttgcataattcattgggttgcttctttttgcatttcttgtatgatttttaaaaattgttttcccctgatactgagtttctatcactctgatctactcagctgtgttatttcctaaacagctaaagagaaaaattgtcacagatatacaggctgtgaaattcttcctagatgaaaataagccacatatgtcagtattcattcagaagcagaaatttgcttttctctgtgttttttgaaagcctaaaagcagtttcaagtcatcttccaacctgtatctgtcttttagcagtgcaaaagcagtttcctagaaatgactgaggcttataccatgtgctgatatatacaaattctatccattcattggcaaagagaagtgctttattaaacttatggcaattaaatgtgccactaattatgtctacaaccgtgacaatgtaacaagtagaacggccaagtagatataaacctcattcaaataacattctgccataggtgctgcttaccctccttgggctttgcaatcctggctgtgaatgtcaggacccatccggcctaggtatccttggaaggtttttcagtttggcactttaagaaacagcaagaaaatgatttgttgagactaatcaaacccatattatagaatgagacccatgtaatcaaattttatggttcacataaataaaatgatataaacaaccaactccaagtcacataaaatgtagaacttgcagcacactttagcctggaatggcggaaagactggtcctttgttctggtgctgcctcgtttcctctttcttcctcctgtgccatctgagtctgtggatgtcctttggggtgtagctgtccttgtctcactcaagtcagcacctcgatgcctctatttatgtcaaagcatcatggacagttctgagattctatatttgtaactgttgaacttttacatgagttggggaggggcttttgattgcaagagacaaggaattcccttgggttactttagtggaaaaggggatttattgtaagcatatatgttgacagaaactctaggcagtagctgctttccttggcactcatggccatatgatctctttcttccattgtgcctctgcttctctttttttttgttttattttcgtccctctacagataacattctttggcttactcgtaacttccccttccttgtaagttcagttttcacacatctctccaagcctccttccaaatccagaactttatgctgcagcttcaaacgttaactggctcagtctctttatttttctgaattaaagtcccagtgtgacatagattattatggattttaatacttatctctcccaccacactttatgcttcttgagcataagatgtctgttttccttgccactgtatacccacagtgcctagaagaaaatagggactgagtattttatgaatgaataaaatatgcaaaataatctgaaatctactaataactgttcttggttggggggaattttctacatgagttgaactggctaagtcttctcaaacatgagtccatttggactgaagtcatcttattcttttcctagtcttgttccaagaaccccaaatggctttccaatttaaggccaaaattttccataaaaattgatgtgatgaaacatttaaatagtaaatgttgggagagagattgtttccatggtgacttctgcttcaggagtccttgttctaagcacagaagagaatgactgaactgagacaccactaacttcacatcatccagttgccattaacctaatttcagccagctttatcagtgccgatggcagtgaccctgtctttgattcattcctgggaggttcttattttggtaaaatgagttcataaaagcagatgaaggtggtgggaaaggtcaatcctactattgaaagttgagatgtgagccgggtgtggtgactcacgtctgtaatcccagcactttgggaggccgaggcaggaggatcgctggagcccaggagtttgagaccagcctgggcaacatggtgagatctcatctctacaaaaagttaaaaaagttagccaggcacagtggtgcatgcctgtggtcccagctactcaggaagccgaggtgggaggatcgctagagcccaggtgttccaggctgcagtgagttgtgtttgctccagtgcaccctggcctgggccacagagcaacactgtctcaaagaaaaagaaagaaagaaagaaagttgagatgtgctaacacttacctgtggaatgacttttctctttgtgtggtgccaaagttttctggtttccctctgaagagtatatgtctggggtatatcctgtctgtgttcccagccacactgcaatgacaggggggccaccctgctcctctggaacagaacaacttcctgagtacagaccagatgttgaacaatggccttactgtccgaaacgtggacagcagatacttcttttgtgaccccctgctttccctaactaaacaccccttgttcttttttaaccatttcacaaaatgatcttgtggtagcagaaaccactgccatgtggttttctgttattaatcctaaactttctttccttattgttttatcataaaacagataatgttattttcacaagcattctgaaaattacctaagtaaatgttattcccttcaacatagttaccttaggagaaaaaatgtttattccattgatgtggtcattgcccaaaacatgtctagaactcccttctcagtgccacaaacttgcttctctcatattccaaagtgtgtagagtgcagctctataggaatacatggctaaagatgtgaatacacgtgggtttttgtcatattttacctgtaacacatttacacttacttcatctttttctttctaaataatgaaaaatccggctgggcgctgtggctcatgcctgtaatcccagcactttgggagccaaggcaggtggatcactaggtcaagagttcaagaccagcctggccaagatggtgaaaccccatctcttctaaaaaaaatacaaaaaaattagctggacgcagtggcaggcgcctgtaatcccagctacttgggaggctgaggcaggagaattgcttgaactcagtggacagaggttgcattgagccgagatcgtgccattgcatttcagcctgggcaacagaatgagactccgtcttaaaaaaaaaaaaaaaaaaaaaaaaaaaagatccaaatattgaatgaacactttcatttttatattaatgtctacattcgttcatggataactgtgtaactcttcacttgaccctaactttagaaactgcccatatagcacctcaaatttgattttagctaatagctattaaaaatgctattatctgtgttaagtggaattttaggtttcattgcctaaaacctaaaatggaagtaaagtggattttcttgtcatctacaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacaggtattgtcactttttcactcatgctttttacaaccttacatgtaaaattctatgggaacttgattaggatggagactggagtcatccttaatctgaagagggaacactatgtgcacattatatttaaaaatcttaaatattatctaattatgatctatcctagagaaaactacccagagactgacaatttcctgagaattatgctgtctgtgaatttacagtggattttacttaggtaaattaactcctcctatgtctaaactctgctggcaaacgtaatgcctactcaatgcacctgcccattacttttttttagagacatagtctcactctgttgttcaggctggaatgcagtgatatgatcatagctcactacagcctcaaattcctggactcatgggcttatgcagtcctgctgcctcagcctcccaaatagctgggactacaggcacataccacacacatggataattaaaaaaaaaaaattgtagagacagtgtcagtgtctcactttgttgcccaggatgatctcaaactcctggcttcaagcaatcttcctgccttggcctcccaaaatgttgaaattaccatcatgagccaccactcctggcccctccattacttcttaatgccacttcttaaggattacacaatagctaagtaagatatataggtgcagataggcctttcagctgcccttaattaatcctgccgcacccaggttgctaggcctgctctctaccttgcacaagacaatgtggatataagtagagctgctctgttcagaaacagtaactgatccctgagttttcttggggctgtgcaggtgcccacctttgtaagtggctgtggcacgtgtcctttagggaagctggtgacgaacacaggatcaagaggttctcccttctgctgttctggtattgcactcagaggtagagatagggaaccagagaccttatggtacaaaatgagcctgcctttctacatcaattattatttaccattcatcaagtagctgctggaatgtggccaaacccgcagcaaactgaggaacatgtagtcaattgagccctcttgtatcatgatgagttttgttttaatggattataatgatagtcttaattgtcgatcatacagagttaactctgagataaatggcactctctgaaatgctattatagctgtattactctgttacaaaattgcatctttgtaagcagaaaaactgtcatgcaaatgaatagcttttgaaactagaaatgaacatgaaaaatgtactgtggtaatgtacagcacatacgcatgcattaggactatttcatgccttgtttcacttcccatgggctgatctgagtgtacattactattgactagtgtggattggctctgaattgtacattacagaatgagaaatagatgcatgaagcaatacacttctgtaatgtacgtagaaatgcaatgttgcacttttatattgaatacaacaatcttgactcatcactgctaagacatccacctagagtggttctccctgtttcactaatgagttaatgtgttgccctttattctgtggcctatttcttctcccagtaacaattgacacttcattgtgaggcacctgaggttaaaggcacagtctgtgacctgtcaaatgaatttccttctgcctgaatctgagtgtactttagatgagatgtgtctgggcccatggtttcagcaggatcctgtgccttaactgatgtgacctacctaaaccagtagacacaagtagataaatgttttctcatagtggagaaaaatgttgaataacattttctgagccttcaaataagtatcttaagatgctaatttcaattaatggtattagaggaatttcgtttatattggaagattattttgcaggacattttagttgaggaagcaagatttataaatgtatcaattagctggcttcataattattgtatacacccttggaaagattattacatttatgtaggatgcagaaacactttattttatgaacagcacaaataataattttattaaaatgtttttaaaaggtataaggaatattcagttagatcaaggtgaggtgtgttactttagaaggagaaagattatatcaattcaagagagaaataataaatgctattctgaactttatttcccaatagtaaaataattttcatttttgcaatagaaatggaattattagaacttcctaaatatattaagttccatttaacagttagctttcaattctacatttgtaataggaagcatagtcattcagcactgtggaattaaactcataaactatcaacactctggcatcttttcatgttgtgtcccaaataaataagaccagatattctaagcagatcattggtgcatcaggatgccttattaagtcagatatttagcatcttattgtacagatcctatgattttacatacatttacatgtttagatgaatgaagctgacattatttaatcaatgaactatctgatatttttagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaa

SEQ ID NO: 15726 - DNA, 37622 bp, Human; identical to SEQ ID NO: 12294
  misc_feature (1)...(37622): n = A,T,C or G

SEQ ID NO: 15727 - DNA, 5796 bp, Human
  misc_feature (1)...(5796): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccggcggggatgctgtgacggcggacgctctggaaaaggggctgggggtggggctctgcgagctccgggcggaccccggccttggattccggggagaaggttgcatcctgaggctgggaaaggagagggtctttggggtctcctgaccgatgcttctcccctccaggcttgcgccccagaggacccgcgccccaagcccccgcgccgcccccaggcccacccggagcatgctgcctgcagccatgaagggcctcggcctggcgctgctggccgtcctgctgtgctcggcgcccggtgagtagggggcccgcgggctgggtcaggtgcctgggagagcccgaggcgccgcgggagagccgggtgtggggctgccaccctctgacggttcccaccgcacttcgcatagagcccacgccccctccgggacccctgcgaccccagcccggccctcggcccctctgccccggcactgggctctctccagcgctcttcctccagggcctggaactggtgggcggctggccccgcacggaagcccttggtcatccgtcacctctgagagcctcccgggcctcctttcaaatccagtttggtccttcacagcttggaacccacggacctctgggggggatatgtgaggcggggcgggagtgtgaggggggcactgtcggtgtggggtctgtatagcccgtgtgtgtgtttgtgtgtgtgtgtgcacgcacgtgcatgggggccagggaggggccataggggctcccctcaaactgccaggatggggcacagttgtcccagggcctctgctccccctccaggggtcatgggggcctgctccctcccgtggggtcgggctctcccaggagtgcctgcagcagggggatgggtggggggcgcagggggctgccttggtttggaccccagtgcctctggtcaccctcctccccatgccctgcccagctcatggcctgtggtgccaggactgcaccctgaccaccaactccagccattgcaccccaaagcagtgccagccgtccgacaccgtgtgtgccagtgtccgaatcaccgatcccagcagcagtaagttgggacttagggtggtggggaatgtgctaaaagccaggctcttgagagaggtcagaggtgtcctcggagcccctctggcctgggacgagagtgagagcgtggggcggcaggcaggatactgtcctgctgtccccccctggctccttggtggcccttttcatctagttgaggccagcgtgggagggtggagggactcggccctgcctactggggccccgagctgacccggaggggcctgggctgggtcctcgggatgaggcagagagggcccaggaggagcccccgtcccaggccacgctttctcttcccaggcaggaaggatcactcggtgaacaagatgtgtgcctcctcctgcgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcttccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtgggggggggacccccaggtcccggaggggaagtgaagcaacagcccagctggaagggcgtcttctgcggagaaataaagtcacttttgagtcctgagacccgggtctgagcctgggtgtcgggggcgggaaagggttcctggcagagagctgggaatgaggtgctgagggagcggaggggctgggggcagggcgggcgctcagccaggatcttgggctcttgggctcagggcactggggtgctgggtggttgtgctggggctgcttggtcctggtgaggtttaggagcacttggggtgatggggtgagagctgagatgagcaagatcacggggtgggcttggggggaggtaccggaatcctgtgagcacaccacagacaccagacacgcccacaaacagtggtgcccacgcagccagcatgtgcacacacactcatgcccagacaagcatacaaacggtgcccacgcagccagcatgtgcacacacacccgtgcccgccctgctcactccttcacacacacacaccccaggtgccccgcgcacacgtgctggggcatgcacataactggcacaaactggcgtgtcccagtgcacgtgcccacacccacacgtgcatgcccatgtctgtgcacacccacccttgtacactcagcgtgcagtgcacacggtgccctcacagactcacagatgagaccacgcgtgctggcctcctctcgcccccaccccagctgtctctgcccctgggggctgcttcaggccgagtggagtcctcctgttccctcaccctgcctcttcactggacatccactccggccactcctggccctgagttgggctcctgaggccactccctgtggccaggggttgaggaagcccacacctctctgtgggctggcccggagggactgggtgccgtggggtgagggggcagggaagacttggcctggggaatgttggagtgatgtcttgatccttcctgctccagtttcagccctgcacccccgcatccagcccagcctcccacacccaccggccaccacgctagatgctccaccagcggctcgtctcacggcccaggctcaccacaccgcttggcaggcaccccagggtttctccgaggcctggtctctggccactgctgcatcatgccacctgtggctgacccaatctcatggccactgctgggtcctgggctccttagggaaagcagtggttcctgtaaaggctggccttgcatgagggatggcgaggaattgggtccagggctggtgagccaggaagagagaggaggcctgcggtcctgggcattggtgcccattccctgctggacacagccaaggggcttttccattgaaggccacctgctctgtgatgcagcccccgcccccaccccacccttcagtaaagtgtgctgctcttgcttgtgcctcctgttttgggggctggggtactgcagagaagctgagaattcccaggaggcaggaagccctggagcgatggaacccccgagggaagccttggccagctagggaggccgtggacaggccatcccaccggggtgaggcttgagccaattgtcatataaatctttgtatgctgaatttattatctgaaagaggtatttaaagacacaaaaaggagtgaaattctcccaccttcttgaaaaatcatatacaatcagaagggcacgccctcacctctccatcacctcccaccctgaggggctgccagggccagacaggcaggaagccggccagctcccaagctgccgctggcactggctgagtgggtttccccatctctgaaggagtttaagtgtggtccccacctgacaggttgtctttgaagggctgaacttcaccgtccgcgtgaagcccttggtccagcggggcacatggacggtgctgagaaattgatctgctatgcaaccctttctactgagcagttcaccggtgatgtcatcccagggccccgtgtccaggtggaccggctttaacgtctgcttagggttcccctggatgagggagccgtgcatttgtaactgtcccttatcagtgggtgtagggtttgttctcaaatgtctattgtcagcaaca

SEQ ID NO: 15728 - DNA, 41755 bp, Human
  misc_feature (1)...(41755): n = A,T,C or G
gtgaccctggagctgtgtggctaaggtgctgcggggtcactggagaaaggtcaagggactgtggcccagttggcccggaggtggttcaggtctcccagattccagggcggcattatgagccacgtgacagacctcccctgactggctgacagtgaagcataattgagaagatggcggaccagcaaggacctcatcagaataggtctgtacacagagcggcatagagagtgcaggagggtagtagaccgggcgcggaggctcaagcctgtaatacaagcactttggaaggccgaggcgggtggatcatgaggtcaggagatggagactatcctgcccaacacggtgaaaccccgtctctactaaaaatacaaaaaaaaattagccgggcgttgtggcgggcgccagtagtcccagttactcgggaggctcaggcaggagaatggcgtgaacccgggaggcggaggttgcggtgagccgagatcgcgccactgcactccagcctgggcaacagagcaagaatctgtctcaaaaaaaaaaaaaaaaaaaaaaaaaaaaaaaaaaaaaaaagtgcaggaaggtagtgaacagaacagcaaggggaatgccgaccctttctcctgttggggccaagacagaggcgatgtgggcaggggagaggccggggaatgcgcagaagccgactccatctccgcattaatagtggactaggggcagggctggattttcggaggcagtgtgcagctcccaataactagttccatgggtcctctgtgagcctagtttcctggtgggtaccgaggggagggcgtcggaaccgtacgctcctttgagtgaggggaatccgggaggatccaaggcaggggaaacagggccgagcgggaaaggccttgaatggggggcgagacccagccaggcccgctggacgcgtagcacgtctccttggtgacgggacgcgtggcccggaagtgggcggcccttctggcggggcggggcatctctgtgacgctaggggctgggcctcgatggcgaaacccaagcggctcccgggggggtttgaactggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtgagaggccgccggcaggcgggatccagcgccctccggggcaccgcgggcgagaccgtcgccttcgcacccccggcgcggtcgaccccgcggggccgtcgggtcctgggttccccgccgcgttgcgctcgtccccctcctgtcagaacctgggcccccgccccgcccaccggcgcggggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggtgggtggccgtcccttctctccgccgacagaggctctccctcgctctgctgcccgtcggcggcatcgccccgaccgcctcgtcctctcctcgggcctccacatggcagtcacttgtacgccctccgtaggcagcgctgtcccccgggcaccgtctccggcttgccagggccctcgcccggcgggggggggtcccgcccgccccctcccagcccggcgtctatcctgctcagaactctgttcggttttccctcgcggcggggcgcccggggcccgtgcaacctccgcgcctccctcctttaaacactattggtcctctcgggcatctgttcttccgtaacgccccttctcctaggagacagttgtccggccccgccccagcatccccgcggctccctgcgcggttctggccctctggggcccacttggggccgagcggttctcacccgccctctccgcacgtccgccggcgcctcaggtttcccccggtagccaccggcagtcctccgcgtgggacccgggcgcggtggtcctttccctcgcggttctgccccgtcccctccccttcctcccctctgcccccaggtcgctcagcctctactatttccccctactttggcaggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtattgccgatgtgggaggcgcctgcgccggagggcagggaaaggtggccaggggtccccagggcaggctcgcctgaggcttccagcttcctcattgtgtttgctgaaagtctggaccaaaacgtttaaaaatcgtttttaaagggaagggggaacgaaatgtatacacaatcctagctctacctccctcgctccttccctccccagatgtcacagcttcctggaagcaaacagggtcactcttgttgtctttatataatagagtactaggttcagagcctttttgaagggagtcgaggtgtaaataaataacacgtaggaggtggatgtggcagttagcaagataatggaatccaggtggtttgacaagaaacccactgagagatttcccaaagctattggctttacgtgaacaatgttctaaatgattagggaaaaaagcctgtcttctcagttttggtattccttggctaaaggatcagtagaggtctatatatatatatatatatttttttttttttcccctctttttaaaatcacgatgtaatacatatacagcaaaacgcataccaaagtgctcaagtatttttttccttgcattttgatgttgcattattttccccaagtgtttgtaaagagggcaagatgataattttggacctccctgtctctgccccaccctccctgccaccccctggtcgctcagcctctctgatctccccccactttggggggccaggtgcggtggctcatgcctgtgcaatcctagcactttgagaggccaaggtgggtggatcacctgaggtcaggagtttgagaccagcctgaccaacatggtgaaaccccgtctttactagaaacataaaaaattagctgggcatggtggcacacgcctgtaatcccagctactcaggagcctggggcaggagaattggagaattgcttgaagccaggaggcagaggttgcagtaagccaagattgggccactgcactccagcctgggcgacagagcgagactctatctcaaaaaaaaaaaaaaaaaaaaggccaggagatggatcagatggttattccaaggcccttcccatcctggactttttggatatactgctgaaagattttggagcaaatagacttttgctctctctcttttttttttttttatttggctgtctttgcagatctggtgatggagctgtacagtatatgtgtaagcaaggtgaattagacatggcattaaaaaaaaatcccctgctgcttgagagcttaaaggatagcaagtggaatattttgggaactagatacttttttattctcttaggggaatatttgagccttaatttgatgagtgtgcgtcacagtgacctctcgtgcctgagcctaatgctctttgaaaaaatttttttttcttttttgttgttgttttgaaacggggtctccctctgccacctaggctggagtgcagtggcgtggttacggctcactgcagcctccacctcccaggcttaattgattctcccacctcagcctcccgagtagctgggactacagacacacgccaccacgccaagctaatttttgtatgttttgtagagatggggtcttgccatgttgcccaggctggtctcaaactcctgggctcaagcaatctgcctgccttggcctccaaaagtgctgggattacaggcatgagacatggcttgtggccactaatgctctatttttgtcactcactcactgcatctttctccagggccgcctctgctccaggcactgtcctgggtgcttctacccttggccaaaccagcacattggcttctgttcatgtgctgcttgctttttgtcatctgacaggatgtcagctaggcttttcagcaagggtcataatacatgtgatgtgacgatatgttaaaagtccagcctgcaaatgcctgtcaccctatttccatcccactgctgggcacaccacgcacatctggtgctcatctcaggggagtcaaggaattccaggctggttttcctagccatgaacatgttagctaccgtagtcagtgtgtaatttcatgagatctgaaatataagattgccctagttttctgcttacaatctggttcttgtgcctgggtgcaggtttccatcgtgtgggaagaacggagtaacgagtctcacgcagaaaaaggtcttgagagcaccttgtggcgcacccagtgtaactgtgacggtaggtgatgcactcacgtagcagccctctttggtcaccttgctaaaaatgcttttgcacaccgtttctaggaggtgccttaccctgctgggcaccatcgccgcccagttgctctgctaggtgctgttatacatactctgctgatttttaattatgatcatcatttttgcctgtggtgaggctgccgggtgtgaggaaattgtcttagacttattcttccagccaaatcctaaaatcttgagatttttaaaataaaggaaaagaaaaagaagagaaaaaaaaagtttaaagaatgaggggaaggataagagctggtggtggttgaggggtttgtagctgtggttctgccttgctcatgttttctttagaatctagacagccttctcatccttaggatttccttcagctttctgttttcctgttctttgatctgcctgctctctgatttattctgcaccctgagcattttgtgtgtttcccacgccaatctgcatgcccagttgagatcactgtgtagaaggatccgcctgctttccgctgtgcttcactaaatccaaggaggagctgtgcattccagcaggtttagaggagatccagccctaaggaccctggggccggcgtctgggatctgttctggaacgggtgggtcttgcagaccctctcttgagtggaccagaatctcccttgtggtcttctgctgggatctctgcaggagcctgctgaatgatactcccgccttactccctgcctgcatgccagtagttggtagctgtcctgctcgcttggtggctaggctttttggtggcccccagaggctgtgagctctgtttttatgcccagtttactcatccacagatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccaggtaggagcatgccagtggggcgaggtagtagctgtggatctgggtgatcctgctaagcccagcctcctcgcactctgactccaaaggtttgggagacaaacacactctttcggaggccggtttcctggttagaaggtaggcaggcctgtcatccaggagcaacagcagtaacattagtcagaagaggcactctgctagtcggagagggatgtcactagcgtggcaccgtggccagctgggtgtggaagtgaccctgggtttgtccctttccacagaaatctcacaagcgaggaatgaaaggggacactgtgaatgtgcggcggagtgtccgggtgaaaaccaaggtaccttggatgccccctggaaaatcatctgcccggcctgtgggatgcaagtgggaggtaggctcacccttgcccaggcttttcttctcggactgctcagatcctagcaggcctcagcctcggtatgattcagggtcagctatagctactggaatgtcctaacagaccccatttactgagggccttgctaaaccctgaaactatgtgaatcttcttgagttcttatgatactgctgtgtgggaagtcctgctgtccaaaggcagagatgaggaaccagacctcagagagaagtgattttcccagagtcacagagaagttagcagagctggagttaagattcattctagaggcagtactcttagcctctctgctttgcttgtgaggagccacatcacatgtattttcttttcttttcttttctttttgagacagagccttgctctgtcgcccaggctggagtgcagtggcatgatcttggctcattgcaacctctgcctcccaggttcaagtgattctccagcctcagcctccctagtagctgggactacaggcgcccgccaccacttacgtctgattttttaatttttagtagagatggggtttcatcgtgttggccaggctggtctcgaactcctgacctcaggtgatccgcccgccttggcctcccaaggtgttgggattacaggcgtgagccaccgcagccagcctatttttcttatagtttattacattagaaatctttcataccagcagtgaaaagaaaaaaaaatagaaatgaaaaacaaaagtaactccttgaagtttatagtcatacctcataaaactatgtcaaaactgactccttgatttaccagacaaaggagactcctttcccttagagacaaagggagtatggggctttcttaggattaaatggaaactgctctgaccagtacaataaattaaaaggattgaaattagactgctgccttacattttttactacatatacttcactaataatcagtgaaatgtaaattaaaagccacagtatattttttttaaaacaaaaacaatgagcttttttcttgaatggaaaaagtttaaaaaatgacaactatctcctgccagcaagcatatgggatatcaatgaatcttttttttttttttccgaaatggagtttcgctcttgttgcccttgcccaggctggagtgcagtggcgcgatcttggctcaccacaacctccgcctcctgggtcaagcgattctcctgcctcagcctgctgagtagctaggattacaggcatgcaccaccatcccggctagttttgtatttttagtagagatagggtttgtccatgttggtcaggctggtctcgaactcccgacctcaggtgatcagcccacctcagcctcccaaagtgctgggattacaggtgtgagccaccacacccggcccgaatcttttaaaacgttttttataggactgtgaacctgattcagctgttctggagtcagtttggcaggacttgtctaaacattgattctgtaatttttcgtctaggaagttgtcctaaaaacatcatagaagagtacagggattttgtttttttgtttttttttttttgagacggagtctcgctctgtcacccaggctggagtgcagtggtgcaatctcggcccactgcaagctccgcctcccgggttcacaccattcttctgcctcagcctcccgagtagctgggactataagtgcccgccaccatgcccggctaattttttatggtagagacggggtttcaccgtgttagccaggatggtctcgatctcctgacctcatgatccgcctacctcagcctcccaaagtgctgggattacaagtacagggattttttgtagattttttgctgtagcattgtttgtaacagaaaaattggaagcaacctaaatgtccatcaggagagtgttggttaaattataatacatctggctgggcgtggtgggctcacacctgtaatcccaacacttttaggaggcccaggagggaggatcgcttgggcccaggagtttgagatcagcctgggcaacatagtgagatcctatctctacaaaaaatagaaaactagttgggtgtggtggcatgcgcttgtaattccagctactcagaaggctgaggtgggaggatcacttgagccagggaggttaaggctgcagtgagccatgatcatgccactgcatagcctgtgtgacacagtgagaccctgtctcaaacaaaacaaaacaaaagagaaatatgatacatccatacaatggaataccatgcagccttgcaaagactgaggtagaggctggttgccgtggcttatacctgtgatcccagcactttgggaggccaaagcaggaggatcacttgagcccaggagttcaagaccagcctgggcaacacgacgagaccctgcctctacaaaagataaaaaattagctgggtgcagtggtacgcacttgtagtcctacttacttggaggggaggttgagatttcagtaagctgtgattatgtcactgcactgcagcctggattacagaaaaggaccctgtctcaaaaacaaaaagattgagacagatatttatgcatgataatgaagcatggagatgcacaacatataacatttggccggccctatttgtgcagaaaatgggcgtctgtgtccatgtataaacgcatatgtttgtatgtgcagaacgttttctgggagaatatgtttatatctacagaacgttttctaggagaatatgcaagtagtggtaagcagtgattgcctctgaggtatggcaaggtttaatgctttatttttatttatttatttactttttgagaaagagtctcgttttgtcacccaggctggagtgcagtgacgcaatctcggctcactgcaacctccacctcctgggtacaagcgattctcctgcctcagcttcccgagtagctgggattacaggcacgcaccaccacacctggctaatttttgtatttttagtagagacggggttttgctatgttggccaggctggtctcgaactcctgacctcaagtaacccgcccacctcagcctcccaaagtgctgggataacaggtgtgagccaccaccacgcacagccaaaaatgcctttttttttttttttttgagacggagtctcgctctgtcatccagtctggagtgcaatggtgcaatctcggctcactacaacctccatttcccaggttcaagcaattcttctgcctcagcctcccgagtaactgggactacaggcgtgcaccaccacgcctggctaatttttgtatttttaatagagacggggtttcaccatattggccaggctggtctcgaactcttgacctcgtgatccgcccgccttggcctcccaaagtgctgggattacaggcgtgagccactgtgcccagcccaaaaatgccttttaaaaaaataaaaagccttggtagtttgggtttttttgtttttgtttttttgagacggagtcttgttctgttgcccaggctagagttcagtggcatgatctcggctcactgcaacctccacctcccaggttcaagtgattctcctgcctcagcctctgagttagctgggactcaggcatgcaccaccacacccagctagtttttgtattttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagccgggatggtcttgaactcctgacctcaagtgatctgctcgccttggcctcccaaagtgctggtattacaggcgtgagccactgtgcctggcctccttggtagttttcaaagtacacatcacagagatgctgctatgaaaaattttcctgttgacatgggttgctaggggtaataatcccctctgaaaagcataatgccacttccagccccattgccaaatcctagaggtggaaggtcccagagaggtggcctgcccaggttctctcagcacctgaaacagtagctgtcttttctgctttcattcttgtgtctgcccctttccacttgccagtggcttcctgtggccctgagaggccctaactcaaccctgtccttcatggacggaaggggaacagcccctggaggtggaagtttgaggaagatatggaaatgaagaccaaaagctgctgtatgcatgtggggttcttgtttgatatcttacaactcctggaatataagatcagctttgggagaaagaaggtctaggtttttttcttgcctctattactaaaagtgatcagccgggcgcggtggctcacgcctgtaatctcagcactttgggaggccaaggcaggcggatcatgaggtcaagagattgagaccatcctggccaacgtggtgaaaccccatctcaactaaaaatacaaaaattagctgggcatggtggcacgctcctgtaggcccagccatttgggaggctgaggcaggagaattgcttgaaccctggaggcggaggttgcagtgagctgagattgcaccactgcactccagcctggcgacagagcgagactccgtctcaaaaaaaaaaaaaaaagtgatctatttttatttagggaaatttgaaaatacagaaaaataatcagctactcaattctggctgctattaagtttcaaaatttcttgttgaaaagtacaggcccaggagcaatggctcactcctgtaatcccagcactttgggaggccgaggcaggcaaatcaactgagatcaggagtttgagaccagcctagccaacatggcgaaaccccgtctctactaaaaatacaaaaattaccctggcgtggtggtcgcgccaccaatatcagctacacagaaggctgaggcaagagaattgcttaagcccatgaggcggaggttgcagggagccaagatcgcgcccctgcactgcagcctgggcaacaaagcgagtctccatctcaaaaaaaaaacaaaaaaaacggaaaagaaaaacgaaaagaggactggccgggcctggtgtctcacgcctgtaatcccagcactttgggaggctaaggcaggcggttcacctgagctcaggagttggagaccagcttggacaatgtgacgaaaccgtatctctaccaaaaatacaaaaaattagcccagtgtggtggtgtgcacttgtggtcccagctacttgggaggctgaggtgtaaggatgggttgagcctgggaggcagaggttgcagtgaaccaaagttgtgctactgcactccaggctgcttgacagagtgagaccccatctcaaaaaaaaaaaaaatggaaaagtgcagggatgtacacccatcagaagtgtattgctccatgaattttcacaagctgaaggtacctgtgtaacgatcacccagcatcctagaagctgcccctggcttttgtctatgtcactccctccccatcacaaggagtaagtagtcacactttcccatatatatatatatatatatatttgtcattttaaaaaatatatagtcatgtggccgggcgtggtggctcacgcctgtaatcccaacactttgggaggccgaggcgggcggatcacaaggtcaggagatcgagaccatcctggctaacacagtgaaactccgtctctactaaaagtacaaaaaattagccgggcatggtggcgggcacctgtagtctcagctactcgggaggctgaggcaggagaatggcgtgaacctgggaggcggagcttgcagtgagccgagattgcaccactgcactccagcctgggtgacagagcgagactccatctcaattaaaaaaaaaaaaaaaaaaaaaaaaaaaaaaaaaaatatatatatatatatatatatatatatatatatatatatatagtcatatatcaattaacaatggggatatattctgagaaacatgttgttaggcactttcatcattgtgcaaacatcatggagtgtacttacacaaaccgagattggtaaagcctgctacacacctgggctgtatggtatagcctattgctcctaggctacagacctctacagcatgatgccgtacagaatactgtaggcaactaacacaatggtaagtatttgcatattgaaacatagtaaatatagaaaaggtacggtaaaaatacggtgttttgggaccactgtcatatatgcagtccattgctgactgaaatgttacgtggcacatgactgtttatacattttcctatttttgtcattttaagtattaaaagtaacttcttttcttctaaaagtaatatacatacctggatgtggtggctcatacctgaaatcccagcactttgggaggccaagacgggcttatcacctgaggtcaggagttcgagaccagcctggccaacatggtgaaaccccacctctactaaaaatacaaaaatcagctgggcatggtggtaggtgcctgttatcccagctagtcgggaggctgaggcaggagaattgcttgaacctgggaggcggaggttgcagtgagccgagatggcactactgcactccagcctaggcgatggagtgagaccctgtctcaaaaaaaaaaaaaaaaaaagcaaagtgtttacagctttgcataaagtttcctgaagcatatatgcattttaaaatatttaaaaaaatatttaaaaagctgagactacaggcacctgctaccacgcccggctaatttttttgtatttttagtagacacggggtttcagtgtctcgatctcctgacctcgtgatccgcccgccttggcctcccaaagtgctgggattacaggcatgagccaccgctcctggccctaaaatattttttatactgacgtatttaaaaagtattgtatttttttaatacaatactttccaggtattgtaccatgtgcatttataatatttttctacatcatcaaaataactgattactcctaagagcatttcttaatatcatagaatatctggtcctttttccaatttacccacttgtttctacaataccttttcagcagattcatctacctttgtaactaatccactatcagctattcatattcatttaaaagacttttgacatatttcatttctaccctaggtataaaaaaatgtactgccctaaacttttgccaactttgggtattattaatgtttttgctgatttgttatattatttctttatgagtattgttatttttagagacagggtttcgctctgtcacccaggctggcatgcagtggtgctatcatagctcactgcagccttgaactcctggactcaaggaatcccctgcctcagcctcctgattagttgagatcacaggcatgtgccactacacccacctgatttttttttttagaaggagtttcgttctgttgcccaggctggagtgcaatggcgcaatcttggctcactgcaacctctacctcccgggttcaagcgatcctccagccttagcctcctgaatagctgagattacaggcatgcaccaccatgtccagctaagtttgtgtttttagtagagacggggtttcaccgtgttggtcaggctggtctcaaactcctgacctctggtcatccacccgcctcagcctcccaaagcgctgggattgcagatgtgagccaccgtgcccagcgctagctaattcttttacttttatagagacaaggtctcgctatgttgctgaggctggttttggcttcccgcctcggcctcccaatatactggttttacagggtatccagcctatgttctttattttaaacttaacattgtagcccaagcttttaattttgatgttgggaattctccaaaaccatcatttaaacatggataggtaatgttccatcacaagggttcagagtatgttcttcctggggtccccgagttagctgttacagcttttcccgtctaatcagtaaataagcctccagtggtggaactcgtggtcaaggttctgccttctgagttcatgtgtttctccctcctctacatcagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtgagggaggtagggggctgggatagctactaccctgaggatgtgcaggagcacccaggtggatttcctgcctggtccctcagcctgcgtctgcaggccttcaggcctcctctgcagggttgccccgggcttcagttgcctgccccgggaggtagctggggcagcatgggatcccatcccaccaacaagggccctctctattgagcatgtagctgtcctggtgctccacatgggtggtccaatttgaatttttacaacagcatgtgaagccagtggtgttactgtcctcattacagagatgaaatacctaggaaactagggcctatgccttccgctttatataaggtttaacaaaaacaggccgggcatggtggctcacgcctgtaatcccagcactttgggaggcggatcccctgaggtcaggagttcgagaccagcctgaccaacacggtgaaaccctgtctctactaaaaaacaaaaattagccatgcgtggtggcgtgcacctgtagtctcagctgctcaggaggctgaggtggtagaattgcttgaacccaggagccagaggttgcagtgagctgagattgtgccattgcactgtagcctgggcgacagagagagtctctgtctcaaaaaaaaaaaaaaaaaaaaaaaaaaaaaaaaaaaatatatatatatatatatatatatatataaataaaaaaattaacaaaaacaaagccccaaagaggccaaggaagtttgtcctcagttgccgtgctctctcttggggtgggatgtgacaatggaattggaaatagaacctggaagtccaaggtccccaactaggaaattggcagagttgtcattaaaatccaggccttagacttggattgctatgtcagcctatgtcttcactgctaacacgacctgtgtctttaatcctccaccctgtactcgaggtccagggaacctcctggagaacctagggctggctgcctagaataggcccttcttggccaggcgtggtggctcatgcctataatcctagcactttgggagactgaggagggcagatcacttgaggtcaggagttcaagaccagcctggccaacatggtgaaaccccatctctactaaaaatacaaaaatttgccaggcacacgcctgtaatcccggctacttgggaggctgaggcagaagaatcacttgaacccaggaggcagaggttgcagtgagctgagatcgtaccgctgcactccagcctggatgacagagtgagaccctgtttcaaaagaaaaaaaaaaaaagcccttcttcccctataactcaaagtgcaagagcctttttgtgacatctctcctcctatggtgtgccagccaaaccacggtttgcaacctggcttcgttcccaacccacaagtcactggggctctctgtactgagtttcctcatctacaaaaagaaaatcagcatctcccaggagagtcagtcttcatggcagttaactgagattgcacccataaggccctggcatgcagcctgtgtagttctcaattggaaggctccttatttttttgtttttgttttttttttttgagatggagtctcactcttgtccgcccaggctggagtgcagtgggcacgatctcggctcactgcaacctctggctcctgggttcaggcgactctcttgcttcagcttccagagtagctgggatcacaggcatgtgccaccacatctggctaatttttgtattttcagtagagatggggtttcaccatgttggtcaggctggtctcgaactcctgaccaaaagtgacctacccaccttggcctcccaaagtgctgggattacaggcgtgagccaccacgcccggccggggccttattttggtccaaagcattgagcctagcaatgtggcatagaggaaggacctcccttcagtggcccctgcctgggtccccctgctcaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatgtaaggtggctcctgctctgtccccgctgatctattcctccctaccaggctgccttgagccctgggcaataatggaaagcaacgtaggaggtgggcacaggcactgtgcctgtgccctggagcctgttcaacagtcacacaattaattacagttaattacctggttgtgcttatgatttgtactatgagggaaagggaggaccccgtggattgtggtgtgggactgggtagcagggaactgtttctggaacaagtgatatttaaggggtgtcctgcaggatggttaagcattcggcaggtgggtgctagggaagaaagcacgctactcagtgggaacatcttatgcgaaggccccaaggtgggaaagtgtttgtagctgagaaatggaaggcaggccagagtgggtgggcagaggataagggggccacataggttggcagggggctggctctcagcagccactttgaggcatttgcattgagggcatttggaagccatggaaaggatttattttatttaattaatttatttggccgggcgtggtggctcacgcctgtaatcccagccctttgggagccaaggcgggcaaatcacaaggtcaggagttcgagaccagcctggccaacatggtgaaaccctgtctctactaaaaatacaaaaattaagccgggcgtcgcggcgggcgcctataatcctagctactctggaggctgaggcaggagaactgcttgatcctgggaggcatctcaaaatttttgagatggagtctcgctctgtcatccaggctggagtgcagtggcgtgatcctggctcactgcaatgtccgcctccttgactaaagtaatcctcctgcctcagcctcccaagtaactggaattacaggtgcccactaccatgcccggctaacttttgtatttttagtagagatggggttttagctgttggccaggctgctctcgataacacctgatctcaagtgatctgcccacctcggcttcccaaagtgctgggattacaggctttagccactgtatccagcctacagccatggaagttttaaaagcagggaggtggcctgactagccttggctgcagtgtagagaagaggtagaagggctcaaaatcgtatctgaagatggtgcgtaggagggcgtgacagtggaggggggcagtgcagagatgacaatggtggctgtttgagagaaacagggccacaggtagctaatgtctcctggtgtggaggccctggtctggtgcccaggcagatgtaacttctggccctggtcctttctgaaggccacccaggccagaagggctgtccctgccccctcccctacttttccctgaccagaggtgagccccctagggcattgtgaggcaagccttggatctctgggcatgcgggggcctgggagggctcacagagccgtctttctggccccagacttcagaagaaacacctacaacaggagaaggagtgcctcatgtccaagctggtggaggcggaaatggatggggctgcggctgccaagcaggtcatggccttgaaggataccatcgggaagctgaaaacggtaggtggcaggtggcaggaccccagccatggaactggcctcgggagggggcagctgcaggctgggcagggtctttacgcgtcatcaggcagactttatgacatcttcaggctgggggagagcacgcttaactaggcccccacccaccactctcacttcccaatccttgacccttgaagatgacctctggtcaccagggcctctgaggagacctcatcatgggtctcctgggatcacagtgagtcaaggcatgtggttgattcctgcaagtatcagccaccaggtcttgtcatcctcctttgcttcctccaggaagtctgccctgactgtgctcacccacactgagccttcccacccctttctccacctttgctcggagcagacttagctcctgcttgtccctttaggtccaccgcttccaggaaacctgcccttgatcaccttggcactgtacacagcctggttctccttgtctgggctttctggcaccagacctcttgagtgcccatggggcctgcttcttcccttctccccctgcatctgtaagactggctacttgtcttccaggagaaacaaatgacctgcacggacatcaacaccctgacaaggcagaaggaacttctcctgcagaagctgagcacatttgaggagaccaaccgcaccctccgagacctcctgagggaacagcactgcaaagaggtgagcttggggcctggctctttccctccagctctgcatgcccatcctctctgagcctttctccttgtctgtaaaaagaaaataagattggtgcccgacctgagaggtccttagagagatgtaatgaaattgttcacatgaagtgctcagcacccagtagacaagtaccatcttagatgccgttgaatccaagccaggcagcaccggaacaaccttgaaagtcaggagaggggcagtgggggagtcagggaggggttcagcccagggcatagaaaagagagttccagacctgagctttttgttcagtaagagaatgattaatggctggcagacacaaatcgtgtggtctcattttgttttcttaaaatatgttctctgagggtgggcatggtggatcacttgaggtcaggagttcgagaacagcctggccaacatagtgaaactccatctctactaaaaatacaaaaattaggctgagcgcggtggatcatgcctgtaatcccagcactttgggaggccgaggagggtggatcacgaggtcagaagttcaagaccagcctcgccaacagagtgaaactccatctactaaaaaaatacaaaaattagccaggtgtggtggcgtgcacctgtaatcccagctactctggaggttgaggcaggagaattgcttgaacctgggaggcggaggttgcggtgagctgagatcgcgtcactgcactccagcctgggcgacagagcgagattccatcttggggaaaaaaaaaaattagtcagccaggtgtggtggcaggcgccagtaatctcagctcctcaggaggctgaggcaggagaattgtttgaacccaggaggcagaggttgcagtgagctgagattgtgccactgcactccagcctcagcgacagagcgagactccatctaaaaaaaaaaaaacatgtctgggccaggtgcggtggctcatgcctgtaatcccagcctttgggaggccgaggcgggcggatcacctgaggtcaggagttcgagacctgcttggccaacgtggtgaaaccccatctctacttgaaaaatacaaaaatgagcctggcctggtggcaggtgcctgtaatcccagctactcaggaggctaaggtaggagaatcacttgaacctgggaggcggaggttgcagtgagccgagattgtgccattgcactccagcctggggaacaagagcaagactttgtctgaaaaaaaaaaaaagttgtctgaactttatatgttagcaaatatagtcgaccctctgtatctgtgggttctgcattcgtggattcagccaaccttggattgaagatatttggaaaaaattacatatttactgaacacctatagactttttcttgatattatcccctgaatcatataacaactatttacatagcatttaccttgtatgaggtattataaataatctagagatgatttaaagtatatgggaggaggtacacaagtatatacaaatactgtgccattttatatcagggacttgagcatctttggattttggtatccacagaatgtcctggaaccagtcctccatgaataccaagggatgactgtagttcttttcttattttgatagtcaaataaaaattaatgatgtacaacatgttttgacatacgtacacaatatagaatggctaagtcaagttaatcaacatatgcattgcctcacatactaagatatttgtggtgaaaacacttaaaattatctcttagcaattttcaagtatacacatcagtaactatagtcaccatgttgaacaatttctccttgtctaattgaaatcttatatccttgaccaatatttccccaatgccccccagttccatctctggcaaccagcattctgcttctgtgagttcgacttcttttttttttcttttttgagatggagtcttgctctgtcgcccaggttggagtacagtggcgcgatctctgttcactgcaacctccgcctcccggtttcaagtgattctcctgcctcagcctcctgagtagctgggactacaagcgtgcaccaccatgcccggctaatttttgtatttttagtagacacagggtttcaccatgttggccaggatggtctcgatctcttgaccttgtgatccgctcacctcagcctcccaaagtgctgggattacaggggtaagccaccgcgcccggccgagttcaacttctttaggttccacatataaatgaagtcatgtggtctttctgggcctagcttatttcactgagtataatatcctctagttttgtgcatgttgtgaaaggatttcctttttgaaggctcagtagtattccattgtgtatctctactgcgttttcttcattcatctgttgatggacacttaggttgattccgtatcttggctattgtgaatgatgatatattagcaaatattgcagaaaagactgacagtataaatggttgtctcctgcttggttctaagcaaagagatgacaatagtctcaaaatgccagtgctaatgaaatggtgacgttcttcttatttttgcttttttatttgagaccgagtttcactcttgcccaggctggagtgcaatggcacagtcttggctcactgtaacctccacctcctgggttcaagtgattttcctgtctcagcctccctagtagctgggattacaggtgcatgccaccacaccgggctactttttgtagttttagtagagacggggtttcatcatattggtcaggctggtctcgaactcctgacctcaggtgatccacctgcctcggcctcccaaagtgctgtaattacaggcgtgagccaccacaccaagccctgtttttttgtttgtttcgttttgttttaacattgtcaaccttgtttttatcttttttttttttcttgagacagagtcttgctctgtcgcccaggctagagtgcagtggcacgatatcggctcactgcaacttctggcctcccgagttcaagtgattctcctgcctcagcctcctgagtagctgggattacaggtgcgtgccaccatgcccagctaatttttgtatttttagtagagatgaggtttcactgtgttgctcaggctggtctcgaactcctaaactcaggcaatctgcccacctcagcctcccaaaatgctgggattacaggcatgagccaccgcgcccggccttatctttaaaaattaatatattggccgggtgcagtggctcatgcctgtaatcccagcactttgagaggccaaggcaggtggaacacttgaggtcaggagttcgagaccagcctggccaacatggtgacaccccacctctactgaaaatacaaaaatgtgatgggtacccgtaatatcaactactcgggaggctgaggcaggagaattgcttgaacccaggaggggggaagttgcagtgagcctagattgcaccactatactccagcctgggtgacagagcgagactctgtctcaaaaaaaaaaaaaacctgttaatatataaaataaggccaagtgtggtggctcacgcctgtaattcccacactctgggaggccgaggtgggagaattgcttgaggccaggagtttgagaccagccggggcaacacagtgagacttcatctgtacaaaacattttaaatttagccaggtgtggtggcacacacctatagtcctagctactcgggaggctgaggtgggaggattgcttgagccctggaggtcaaggctacagtgagctgagattgtgtcactcactcaggctgagtgacagagttagactgtccccccaaaaaattatatatatatataacaagtaatgtaaagtggtatcctcactgcccagcttttttttttctttttttttgagacggagtctcgctctgtcaccgaggctggagtgcagtggcgcaatctcagctcactgcaaccttcccctcacgggttcaagagattctcctgcctcagcctcccaagcagctgggattacaggtgccactcccggctaatttttgtatttttagttgagacggggtttcaccatgttgtccagcctggtctcaaactcctgacctcaggtaatccacccgcctcagcctcccaaagtgctgggattacaggggtgagccattgtgcccggccactcaccgcccagcttttaaaataagtgtctacatagttgattcccttttgtgtgtcattttgcaataaccttgtctccctcccctcagagggaagctttattaatttttttgtttgttttgatacagagtctcactctgtcacccaggctgaagtggcacaatctcagctcactgcagcctctacctcctgggttcaagcgattctcctgcctcaacttcctgagtagctgggattacaggtgtgcatcaccacacctggctaattttttgtatttttagtaaagatagggttttgctgtgttggccaggctggtcttgaacgcctgacctcaagtgatctgtctgcctcggcttctgaaattgttgcactccagcctggatgacagagccagacactatctcaaaaaggaaagaaagccaggcatggcggctcacgcctgtgatcctagcactttgggaggccgaggtgggcagattgcctgagctcaggaatttgagaccagcctgggcaacacggtgaaatcccatctctactaaaatacaaaaaaatgagctggcatggcggtacgctcctgtagtcccagttactcaggaggctgaggcaggagaatcgcttgaacccgggaggcagaggttacagtgagccaagatcatgccactgcactccagcctgggtgacagagtgagactccatctcaaaaaggaaaaaaaaaaaaagcctcttgctctagccagttttctccttttttggtttcttagcttctgtcatcctggagtcccatcttcaattggagatgaagggtcagctaatttgaattcccacccaaaagtggtgttttgtgctttgtccaggctcagctccttggtgcccatctgtgctcagggctccctcaccatctcggtgcttgctgggtagtgctcagtgtggtggggaactgctctggttctggagtccgagtcggctccagggcccagtactaccccttccagctgtgtggcctcacttgccttcacttctcccagccttagtctcctcctctgagatgggggtagtgatagtgcatggctcttagagtagggggctttggtgagttcatgcacataggatggcagaagagttggtcagtggtttcagtgccccaggggaggcctggagggcagtgagaacagcctcaggttctgcatccgtggccaagccttctgtcccaggttctttgcctcttgttgccagagaaaccataatactgtcttttatcagttcctaggtgcccaggaaactttgggaaccagagagcccttttctctgggcttatgaaggggatctgtgggtctgagagggaaagagggtgaacaagatgtccctccctcaagggatactttgttcaggtgccaaagaaaaatagggacagtcacaaagacatagcccagtgagaaaatgggccagggcaggagcaggaagttcaggcaagaggagacccaaatggctcatatgagaggatgctaatcctcactggtaattagagaagtgcaaatgaaaccagcaggagtgctgttggcagatgactggcaacagaggcagaggttggctgctgcctggtactggtgagtgcagggaagtgagtcctcccatgtcctgcttgtagcccagtgaattggtgcaggcattttgcagggcatttcagccacaaatctcagaccttccgacctggccattcctcttcttggtatcatccctagagaggcactttgtatatgcccagcaacgtctattgctgcagtgtttgtagttgcaaaacatgggaacagcctcattgtccagaggttgtggggagaggttaaaaatggcagtggcatattagagacacggagaggttccacatgccatggcatattagagacagaaagcagatcagtggttgctaggggcaggagtgggagggaatgggaatggctgcttaatggtacagggtttcttttttgggtgatgaaaatgttgtggagctagataatggtgatggttgtacagtattatgaatatactaaatgccactgaattttacgcttaaaaatggttagccaggtgtggtggcacacacctgtggtcccagctactgaggaggctgaggtgggaggatcacttgagtccaggatatcaaggttgcagtgagctatgatccatgattacaacatgcactccagcttgggtgacagagctagactgtgtctctaaaagaaataaaaaggttaaaatgacaagttttatgttacatatattttaccacaatttttaaaagttaataatggaatataccaaagccatttaattgtatactttattttttcttctagctttattgaggtatatttgacaaacagaagtagtatacattttaagatgttcatcgtgatgatttgatacccatatacattgtaaagtgaccacctcaatcaagctgattaacacatccatcacgtcacatggttacctttttgtgtgtgtgtggtgacaacacttaagatctcctagcagatttcaagtatataatacatcattaattatagtcaccatgctgtacactttaaatggtgttcaaatttatatctcaataaagctgtttttaaaaatcaagtaacagctgggcatggtggctcacgcctgtaatcccagcactttgggaggccaaggcgggcagatcacctgaggtcaggagtttgagaccagcctggctaacatggtgaaaccctgtctctgctaaaaatacaaaaattagccgggcgtggtggcagttatctgtaatcccagctactcgggaggctgaggcaggagaatcgcttgaacctgggaggcagaggttgcagtgagccgagatcgtgccatcgcactccagcctgggggacaagagcgagacttcctctctaaaaaataaaaaaaattaacacataaatacaatatgatattattttcctaaagttacacatgaatccctttccccttcccccagagacaaacagtatttctcttgatgcagcaaaatgctgtttcattacagagaaacagtatttcaatacagtattctgtacagtattttcaatacagagaaatacagtatttctctgtagatgtagagaaaaaggatgggaaggatactcctcaaactaatagcagtagggtagggtttggaggtgggtacaggaggaactgtagctttattagcattcactattttatagtgagaatatattcacattacttttcaaattagaactacagttttttgggccaggtgtggtggctcacacctgtaatcccagcacttggggaggccaaagcaggcagattgtttgaacccaggagttcaagaccagcctgggcaaacagggagaccctccaactctacaaataataataatgtttaaaaagttgggcatggtagtgcatgcttgttgttccagctactttggaggctgagatgggaggatggcttgagcccagaaggaccaggctgcagtgagccatgattgcaccactgcactccagcctgggcaacagagtaagactctaaaaaaaaaaaaaaatacaatttttggaaaaggtaaagaatcaataaaatgtagacatctgggtttattgcttaatgacttgactttttcctttgcctttctttgaaggattctgaaagactaatggagcaacaaggagcactgctgaaacggctggcggaggccgactcagagaaagcggtaactaaggctgcccttgtctactctagtgggtacaggtggcaagagcgtcgttccactacaaagtgtagaggtgcttggatcaaggcaggagggctggagcatttcgctaggtcttagtttcacgatctgtaaaatgggctgatgtcctcctgtcacgcttgttctgataggcttgtctagttagttacttgagaccttgagccacaaagctggacaccaacatagagagggtaatgatgatgttggatttgtaaatcatccgtgtctgttaaagctggatttccatcaaattagtattatggattcaaagccatcaaaaagtacacacctttggactcagtaatcctaattctaggaatctctcccaaagcagcatgttccaaagtctgttcatggaaccctaagttcctcaagatgttaatgagtgcaagaaaccgaaggggaggttccatagccagttaaatttgggaaaccataggctggcctgaacatgaagttcaacagcttctttcaagacttttttggagtgtctgctgtattaatgcttttgtaagtctccaagagaggggagggagacggaggcccagtttcccaaggtgtggtctgtggcctctgatgcttagttgaggaaggagtggagatgcagcaagctcggcgataatgcctaaatgtgcattcccagctcaagaacccttgttaagttatgatatacatcagtaacttgaaccgtcaagcagctctttcaaaagacacagaagatttaatcacattatggtaaacatgagcttttaggctatggaacgaagtaggcatatgactttttttttttaacggtgctgagcatatgagtttcaatgtgcattaactggttatctctgcatggggggttacggggtttctttggaggatttttttggtgtgttctcaatgttttctacagttaacattgctgttcttaaattgcaaaataaatacatgttcattgttttaaaaaaatgttttaatgcatatgttaggtgcttcctaccagaatctctgacatgggccaatgtatgtaggaccttgggccccagtggccaggtactcacaaatctctgtcctccctgggccgggcctctttgcccttcccaggggcacctgacagcctgtgttctctcccagcgcctgctgttactgctgcaagacaaggacaaggaggtggaagagctccttcaggaaatacaatgtgagaaggtagtgtgctttttttttttttttttttagacggagtctcgctctgtcgccaggctggagtgcaatggcgcgatctcagctcgctgcaacctctgcctcccggatttgagtgattctcctgcctcagcctcccgagtagctgggactacaggcgtgcgccaccacgcccagctaatttttgtatttttagtagagacggggtttcaccatgttggccaggatggtcttgatctcttgacctcgtgatctgcctgcctcggcctcccaaagtgctggattacaggcatgagccactgcgcccagccgcagttgtgcatttttatgagccagtagaatataatggatatgcagagagctgggttcaaatcctgtctttgggccgggtgcagtagctcatgtctggcactttttcgagaccagcctaggccactccctagcactttgggaggccaatgcaggaggactcattgaggccaggagtttgagactgtcctgggcaacacagggagaccccatctctacaaaattaaaattaaaattaaaaaatcagccaggtgtggtggcatgcacctgtagttccagctactctggatgctgagatgggaggatcacttgagcctgggagactgaggctgcaatgagtcatggtcacgccactgcactccagccttggcaacagtgataccctgtctcaaaaaaaaaaaaaaaaattattgaccatgcgcggtggctcacgcctgtaatcccagcactttgggaggccgaggcaggtggatcacttgaggtcaggagatcgagaccagtctggccaacatggtgaaaccctgtctctactaaaaatacaaaaaactagccggttttgatggcacgtgactgtaaccccagctactcaggaggctgaggcgggagaatcgctggagcccaagaggtggaggttgcagtgagctgagattgcgccactgcactccagcctgggaaacggagcaagactccgtatgaaaaaaacaaacaaaaaattgtgcctccatcactttttccgtctctccacaggctcaagcaaagacagcctctgagctttctaaatccatggagtccatgcgtgggcatttgcaggcacagcttcggtccaaagaggctgagaacagtcgcctgtgcatgcagattaaggtacctattggccccacaagtggggaaagaggaggcaagggcctgccaatttgatggtagcggcctggcccagatatcacactcaggaagtgtgcctccaaaggtttctgaggcagctgatgacaaaatactcaggcctcagagacattccaggacagtggcaagagcaatggacagagacccaggaggtgttgggcatccttcccaacagtgacggggttgcgtgccatgccccccaggcctatcacttaatcccctaggccctcagttctcctcattacccaagggaaagggatggtctctttgtagcccaggggtcctctgaggtcatactctgctgagtgaccaaggaactatctctgaccacaaggctgggagttcagggaaggattccagagcagttctgacctaatatcaagaccccatgggctgagagatccagggaggtgtcgtggggagctgggagggactgtgtctctggtccgagttaggggagcctctcacacagctaagcacttttttctgtcttcctcgtttcctctttgctcttgccttttcctccctttctccttcaccctctgctttgccttcccacaacctccttgtctctcttctccctctctttctcaccccttcccccttccagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggtcgcaggcccgcggtgcccagctcctcacctgccctgaggagggctgggtgatggcagaggggtggtcagccagatgggtagcggggaggggtgggtggatgagggatggtagtggtggaaaggatagatggctggggaggagggagagggagttaaggggatcaaatgggtaaaagctggagggatgggtggctggagatgattggaggctttgtaggagagttcagccacatcagctttgtgggtgagaataatggttaaggaaggatttacaaacaggatgcatttgattgctagaaatctgggagcactagctgggctcccactgttgcttccagcgccctctagaaaggtgaattccagaatgaggtttaggttaccagggtgagaaaccacctaggatgagcccgctcccagctcctggcagcctcaccactgacactaggctaacaggcccttttgtcccgtgttcccaggatctttatgtcgctgaagctttatccactctggaatcctggaggagccgctacaaccaagttgtaaaagaaaagggagaccttgagctggaaattattgtcctgaatgagtacgtcttagagtaggagagggaatgtggcgctgttgagggacttgggtgtgcaggtgggaggggcctagtggctcagggaaggccacgtggctgctgtttgtactctccgggttgggggctgcactgggctgtgatgtgggtagccctgagctgggctttctggttggagctggggtgcaagctctggccctagtcctggggtcctaccctactgtcaggcactggctaggggccgggtctttctggtcagaggtgtgggtctgacttcatcacctgggcctgatcctgtcctcagtctacacagcatttgaaatgggcaccgtggtgtcctcattcctattggggaatggggcagatggtgacccgagtgtcttctctctgttgtctgtccagggacagcagctgtttgccagtgcctgccagtcagtaggtcagtggtatggcatgggagtagggggcaaaagtggcctcaatttgcaagtgactgagctgacacctttcttgccactggcgaactgtgaatagtgaccattccatcattctccttttttccttcatttattggaaaaacatatattgagcatctaccatataccaagctgctgtgtgctggccaccagggttacagcagtaagaagacaaatgcattccctgccctctactctgtagaggagatagggctacaagaggcatggactccctggactaaggataggtcatgggggagctcatttaatctcccaggtcaggaaagtctcttactgtattcaactcaacttagcaaacatgttctgagaactcactatgtgccaggctctatgccagctgctgtccttagggagttctctgtctagtgggagaacatagatacctaagacagaagcatacatggtacaggggaggggtcagggacaagatgtcttgaagtctgaactgggtttttaagtgtgagtaggagtttgccaggtaaactggagttgccagcaaactgatatgtttgcttgggcctagtcagtgttcagtggtggactgtaattggtcaatactgagagcacatattgtgcaaagggtttttgatgggtctgtggtcaagatagaggagtaagcacctgtgagccccagggctcctcttgaggccacagtctctgctctttgactgatgatggccttgctgagtgactgaggcagcagcagggagcagaagggactgggggtggggcaggcagctggcttctaagttggcgtctttctatttgtgcctttttcccacaccacactcattgccgttcctgcctgtgttaggtgagtgttcatatgtgaatgagcaatcatggcaccagccccctgctgggggtacaaaagcccagggtgctcagggccctgctggagaggaatgcctgggtgataatccctgaccaccagcctgggagtccaagaagggattccagaagcgtctgtcctaacaccaagacctgataggcagagagattccaggaggtgtcatagggagttgggaagggatcatgtctctggtccttgccttcaaagggtatcttggccttatgagaggatcaagatgggtacacatccctctctctctctctctcttttttttcttaatggagacaaggtcttgctccttcacccaggctatagtgcagtggcaccagcatagctcactgcaaccttcaactgctgggctcaagcaatcctcccaccttggcctcccaaagcactgggattacaggtgtgagctgccacacccagcccacacttctcttaataagtcattgcttattgttgaattgtagatggtttcttggagggggaggtatgggagacacatcttaacggacgtcgttcagaggtgggacaggcatgggagtaccacagcagcaatgccaaggcagggcagcagagttgcttctcagtgtggagattggggagcaggcaggcagtatattgagtgatgagaacgctgggtcccacaccacacaaagacgtgggttctttagaacctgtgtaattggccgggtgcggtggctcacacctgtaatcccagcattttgggaggccgaggcgggcagatcacgaggtcaggagatcgagaccatcctggctaacacggtgaaaccccgtctctactaaaaatacaagaacttagccgggcgtggcggtgggcgcctgtagtcccagctactcgggaggctgaggcaggagaatggcatgaacacgggaggcggagcttgcagtgagccaagatcgcgccactgcactccagcctaggtgacagagcgagactccgtctaaaaaaacaaacaaacaaaaaacacacacacacacacacacacacacaaacaaacctgtgtaattgattctctctgtctgctttcactttgtgatcttccagccgggtaacagatcttgtaaaccaacaacaaaccctggaggagaagatgcgggaagaccgggatagcctggtggagagactacaccgtcagactgctgagtattccgcattcaagctggagaatgagaggctgaaggttcgcagtgagagctggggaccaggcagctggatggggcccagcgagctgatgaggggtcttgtcttacgtgggcctgggggcatcttgactaagagggagtcagaaaagcctggatttgaccaggcatggtggcttaggcctgtaatcccaacactttgggaggccaaggcaggtggatcacttgagcctagttcgagaccagcctgggcaacatggcaaaatcctgtgtctgcaaaacatacaaaaagtagccaggcatggaggcatgcgcctgtagtcccagctactcgggaggctgagttgggagaatcgcttgagcctgggaggttgaggctgtggtgagccgagatcgccccactgcactccagcctggaaaacagagagagactctgtgtcaaaaaagaaaagaaagcctggattcaagtccttactctgctgcttcctggctgtaggacctgagtgaaaaacattccatgcctcttccttaggtagaggaaatgaggtccttgtgagaatgtggtaacgcatgtgaaatgcttaacatggtgtactcagcctgcgcacatgagatagaactcatttgaggttaatgtgggctctcctgggggcctgctgggccccttcacaggcattaattctcacttaaactgtccaacctgccagtaacatgatgattatctccatttgaaatgagaataaggggccgggctcacgtctgtaatcccagcactttgggaggctgaggcaggcggatcacctgaggtcaggagttcaagaccagcctggccaacatagcgaaaccctgtctgtactaaaaatacaaaaaaaattatctgggcatggtggtgtgtgcctgtaatcccagctactcaggaggctgaggcaggagaattgcttgagcccaggaagtggaggttgcagtgagccgagattgcgccactgcactccagcctgggcaacagagcgaaactccgtctcaaaagaaaagaaaagaaatgagaataaggaaactgaggctgagagagaagtcaagtgtcttgccaagattttgccctaggaagtatcagagttgagatttgaacccgagtctgactcgagccctagctcttaaactcaccatacccacttccagcctgccaggagtgagaggcacctgagcagaggttgacatttcagagacaggttttatcttgctcttttgttgatctgggcaataacatctagctttattttttcactgattttgttttttcttgttaagattgattttaaggaagaataacatatggaaaagtacacagatcctagaattttcataaagtgaatatactttgtccatcactcactctgattgaaccttgcctgcaccctagtgacctttcttgttactaatacccctgtaaaggtaactgctagcccatctcctgtcaccacaaattagttgcctgcttttaactgtagagatttgaatagtttgaatatccctgggcctggcgtctactctgcaagtttgttgagtcagccccattgtttggaggagtttattcatcctcagcgctctagggtatgtcgttatatgaacacaccacagtatatttgtccattctactgtcagtggacatttgggtttccatagtgttgctgtgaacatctttgtatgtctttaggtgtacacatttggtgcgtctttattgtttatataccttgaagtagaattgccaggtcatcatggggtgtgcattaagtctatatttggtagatgtcactgaatagtaaagtgtgtcactgagtagtaaagtagttactggtagatgttactgaatagtaaagtagttgaacaaatctccacacctgtcagtggtgagtaaaaggataacagttgctccttgcctccttggcaacgcttggtagcttggtattgagtgtcttattttatgttagctactccggtgggagtgtagtagtatctcatttgtatagtgtaattgtcggataagttaaaaataacatgcacgtcttaacagttatttaggaggccagccatggtggctcacacctgtaatctcaatgtgagaggactgcttgaggccaggacttctagaccagcctgggcaaccccagcaagaccccatctctacaaaaaaattttaaaagccaacaactatttaggggattagttatagtatggtgcatctgtatagtgtattacagtgtggtcattcaaaatgatgtttgtagaagtatattttcctagtctaatttttttttttttgagacagagtcttgctctgttgcccaggctggagtgaagtggcatgatctcagctcactgcaacttccacctcccaggatcaagtgattctcctgcctcagcctcccaagtagctgggattacaggcatccaccaccatgccccgctaattttttgtatttttagtaagagacagggttttaccacgttggccaggctggtctcgaacttctgacctcaggtgatcaacctgccatggcttcccaaagtgttgggtttataggtgtgagccaccacgcctggcctttcctagtataattataaaagttaaatatgctcatagtaaaaattcaaaacattacagaaatgtgatgtagacatgaagatcttcgctagccatgaacatatatttttctagattatcccccagtactaacatatcaagcacacacacatccactcatccatccattattctgtcacttgcttttctgatttaactatatttacggacatctgttaaggttggttttttgagctttatctctcttttaagtgactactagttactttattcatttgatacaccatgatttatattgtcccatttaagatgaataattgggttataggaagacatttatttatttatttatttatttttaaaatttcccacctgcattataagttgagaggacattcattgacttgagagaagttcacaacataatttttttttttaaatatatttttggtagagatggcgttttaccatgttggccaggctgatctcaaactccagacctccaggctggagtgcagtggtgcaatctcagctcgctgcaacctccacctcccaggttcaagtgattcttctgcctcagcctcccaagtagctgggactacaggcacatgccagcacgtccggctgatttttgtatttttagtagagatgaggtttcaccatattggccaggctggtctcgaactcctgacctcgtggtctgcccaccttggcctcccaaagtgctgggattacaggtgtgagccaccacatccggcccacaacatattgttaattttaaaagtgtgttacagctagatgtggtggctcacannnnnnnnnnnnnnnnnnnnccaacatggtaaaaccccatctctaccaaaaatataaaaaattagccggagtgggggtggtggtgtgtccctgtaatcccagctactctggaggctgaggcaggagaatagcttgaacctgggaggtggaggttgcattgagccaaggttgtgcctttgcactccagcctgggtgacagagcgagactccatctcaaaaaaaaataaacaaataaaaagtatgttacatacaacctggcagatcccatggtggggaaaaactatgttacatagcagtaagtatagtatagtctcattctttttgacagaaacgaaaaagttatgcagctatagatatatagccatatccaagtcattaagcattaggattagtgtgtcttggttttatccccattttcttttttttttttttttttgagacggagtcttgctctgtcgcccaggctggagtgcaggggcacgatctcaccttactgcaagctccgctttcgggttcatgccatcctcctgcctcagcctcccgagtagctgggactacaggcgcccgccaccacgcccggctaattttttgtacctttagtagagacaggatttcactgtgttagccaggatggtcttgatctcctaaccttgtgatccgcccacctcggcctcccaaagtgctgggattataggcgtgagccaccgcgcccggcctggttttatccccattttctttaatgattatatattgcttttggattaagaaaaaacagaagtcatttatttgcatctctattcacttgaggtggtaacattaggagtcttacctgcttctcggtgcttctctcagggaaagtgctctgtgggttagagtagggggcctttccttttctggttctttggatagagttgagggtaggaggtccacctgaagcagaaccttcctgtgggttactcatgagccatcccttccaggccagctttgctccaatggaggacaaactcaaccaggcacacctcgaggtccagcagctgaaggcctcagtgaagaactatgaggggatgattgacaactataagagtcaggtaggcctcactggggccctggcccttctgagcagtgccctccctgcccccatcagactgggggctccctaccaggccactcccagggagggttgggtatggaagatggttttcatcaaaacgtggctctacctaagatgaaccacagtgttgttggtccctaggtgatgaagaccagattggaggctgatgaagtagctgcccagctagaacgctgtgacaaagagaacaagatccttaaagatgagatgaacaaagagattgaggcggtactgctttccttccttgttttcttctcctacccaattccatatctaactcaatgactgtgagtctgttccccttgtttgcctttgaccctacctgatttgggcaacaaaggtgagctcattttctcattggtgggctcatccactctaccctgtgcctctctctcctttgtctctttcttgtttcctctcttctctctctcatgctgctgctttgtcttttttttttttttctcttggttttcttctacctccttttcaattttcttaaaataacaacaacaaaaaaactctcctggctgggcacggtctctcacacctgtaatcccagcactttgggagactgaggcaggcaggtcaactgaggttgggagttcaagaccagcctgaccaacatggtgaaacccctgtctctactaaaaatacaaaattagccgggtctggtggcgcatgcctgtaatcccagctactcggaaggctgaggcaggagaatcgcttgaacccaggaggtggaggtagcagtgagccgtcattgtgccactacgctctagcctgggcaacaagagtaaatactctgtctcaaaacaaacaaacaaacaaacaaaaaacctcatgcttggagcatccaagtagacagaaatctacagttatgccaggtctttggcatgcctatttcattctatatggtgtccttattttgtaccagccagaaaatatgtctcccatcctcttcccaaagagccttattcttctacagatggtttggctgattagagcagcgggattatcttaatggttaccttggagatgggctgagtccaggctcagccactaatttgtttcataaccttgggcaagtcaagcccctctctggtcctcagtctccgtgttaagtacaaggatggacttagaccagatatttctccctttccctctgacctgtagcattgtgactgctttcctaggggctttagagttagacttttaaaatttattttattttttttgagacagagtcttgctgtgtcacccaggctggagtgcagtggtgtgatctcagctcactgcaacctccacctcccgggttcaagtgattctcctgcctcagcgtcccaagtagctgggactacaggcgtgtgccaccattcccagctaatttttgtatttttagtagagacagggtttcaccttgttggccagggtggtgtcgaactcctgacctcaaataatctgcgccccttggctttccagagtgctaagattacaggtgtgagccactgcacctggcttggagttagactagactttaatcctgtgtttaccagtttttagctgaatgaccttgggcaaatgacttagctctcttgatgcttactatacttgtatggggacagcatcacctattttacaggttgtctgaattaaatgagcaagtgtgcagagagcccctggtacaatgcctgggtcttggtgtttactgtgtggttgccattgttacgggataactaaatgaatggcaagccacctgctcaatggccagcggggagtgtaggccacacttctgctgtggattttgcaggatcctccactggggactgtgtcagccctgccctaactctaaaggactctgcctggctccactaggagccaggtctttcctaactgtgggtctttccttcctgtgggtctttccttcctgtttcaggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgccatgtgtttgcacaaagtgattgtagttataggagccgtcacttgcgtggagtcactgggccctcctgctgttgcccccacccaagactgctgcctctgcctgtgtgctccgcagctgtcctcagctccacacccacagctgggagatgccagcagacaccgagccgtagaatttctttttttctcttgctttagctgcttctcctgactctttaacagatgcactgcctgagattctgtcctgaaagaagcaagcatccctttctcccagaagcagtctgtctctgggttactggaaccatgcctacggcctgcagtgtccaagaaattatataccactcatttgcagcgtgaccttgggcaaggcccctttcccactcttgacgtgtgtacttgtgataattagaaaaggggctaccattttttgagcacctcttctgtgttcctgcattctctcatttaattccatcaggaactctgtgaggtgcatgtgttattttccccattttacagaaagcagcccaaggcatagagaggagaagtaattccctaccatcacagagctagtacctagtaagcagggattggaacccagccagctctgtctggttcccaagcccacattctcagtactgtaaccttacattgcctgccttctccgttgaacctgagcattctcagggactttgagccttgatagctgaggcttctgcataaaacagccctctgggtaaattctcaaacttgccaactcaaaaggattgacagatttcctgttgtcttgcctgcacttgtccccagttaagaggaggttgagatcaatagtaccagcaacataacaggtaaagctctgtggttggtttgtatgggccagttagccctgccagctgtttctgccttctcatgtctgtcctggatcctagctgggtctctctgagtggcctcccctgatcgagaaagcatctttgtcattctttagcatcaaacctggtttctcccagtgtggggagagccttttgtctttggagttgggcctaacctgtccctgctgtcctttctcctctaggttgtgcgttgagacttggacacctgctgagggcactgtgcccctttcctgggtgtggacaacaggtcatagggaaaggggagggctctagcgggaaattcctttgtaaaccagtctgtgttcctgtcattttagatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggtaagcattgtgggagagagcaagggggcctctcagcctggggagacactccatgacagcatgatcaggatctgcccacctgtaggcaccacctgtcccaaaaggcatgcctggtccaggcctgccaggagggcccagtttgaatggagcagccagtatactgtggtgggggcacttccccactcttttctgccctttcttgccagtcacccttcccaagacctttctgatctgaccgttctctgttatttacggattgttggaggcagtcagaggtgaagggtacggctttgggaatcagaagccctggccttggggcccagctctgccacttaccagcattgtgatcttgagcaaatcatttaattcctttgaagctcaatttcctccttttgaggaaagggtcaaggtagagtttatctatctatctatctatctatctatcatctatctatcatgtcactctgtcacccaggctggagtgcagtggtgcaatctcagctcactgcaacctcgacctcctgggctcaagcaattctcctgcc

SEQ ID NO: 15729 - DNA, 148783 bp, Human
  misc_feature (1)...(148783): n = A,T,C or G
gttggtctcgaactctggagctcaagtgatctgcccacctcagcctcccaaagtgctgggatttcaggtggagccaccatgcccagctgaggttctgcatttctatcaagcttgcaggtgatgcccatgctgccagccctttgagtaacaagggggctttattactgagcttggctgaacattggaatcatctgtggagctttaaaactactaatgctgggctctcaaccccagagattgcaatatcatcagtctagaatgcagtttgagtactaggattttaaaaagcttcataagtgattctattttgtagaaatattgagaactactagattggatgatattgaatccaattttaaaacaaggtgtagcaataaatgttcttcagcgctgtgttgctgactttttagaaagtcagttttgtagctctagaaagaatctggctgcatccatggatgacctccagatctctgcttagcatgactgggtaatttctccaatgtctccagcacatgctgtcacttaacagcagaaagagaattcctactttcaggagaaaagtcattcctgaagattacagttaaaatatgcccacagatgatgaggttgtactaaatcagtccccttgctctctgagcttgttctaagttacaggaagcagaagaagcagagaagcactccatttcttttttcttgtaatctctagcatgttcacatgcatagtttctgagtcagtagcaaactaagaacttcttgtgtgattcaagctaacccctcgattatcagaagcagatgtttcaaacgactgaagatcagtgaggcatatcctatttacaggttaataattgactactagatgcaggtgcaccaaatggtcttagagacattagataggagagacaatgtcagtgctccccctaccctgcctcccctaatctaaagcctactctgtttcttttatcaagtgattggctgtatgttaacagagcctggggcactttcctgttgaaatgcctttaatcccaagcaactggattgatttttttttttttttggatggtttagattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtatgtggttcagtatatgccttaataatcacgatttctttcctcttatattattatagtctcacagtgaccctttgatgatagacaagcaaggtgcagaggacctagctcagaaaaatttagtgaggtgcccaaagtgatccaacaaagaagtggcatgatgggctcatgaacccatttgggtggtctcttggtcccctgtactcttcagcataaactattgaatagttgatgcttatctgatatggaaggactctgaattttaacattaaaacataccctgaaggtcgttgtctaaatgacaatgaccctcattttacacatgaacaaatcaaaggcctgagaggctgagttactgctgaaggccacagggttgatcagggtcagattaatgatttttagcccaaatcctgggctctctttttcctacagtgttgactttctctcaaaatcatagaattgtttcactttttcttatattcacagcaatttatagtttgggggtccttagtggagggggtgggatatatgtatggagtaaatttcttttaaaaattgaacacacaaaaaaatagggagaataagaaatagataacatgtacccattatcttgtttttctattttgcttatcttttttttctgaagaattttaaagcaaattatagcacaagaacatttcacacccaaatatttttgtatgcatctcttaaaaagaaagacacattgctgcatgaccgtgctaacatacctaacaataataacattaattctccaatatcacctgaaaactaatctatagtcaaatttttcaataatccccaaaatattattatttatagctgttttattcaaatcaggatacatctaaggatgccatgcatttgcttggcaagtctcttaaatctcttttaatctagaacactgagtttgcatgaatgtgggtaggagccaaattttaaccagcaacagttaccattataaattattcctcatcccaggcaaagcagtgcattctgaagggaaaacttattatctatccctccttgtagacgttttacacgttatccaaacaagaaagtgtattcatgttgaatatttaaaaaacaatattgtaaccacaaagcagaaaactaaaccaccaaaccacaaaggtagacaacaatagaggaagaagagaacaaattatctacaaagtaaccagaaaacaattagcaaaatggcaggagtaagtcttttactatcaataataaccttgctggtacatgggttaaactgtccaatcaaaagatatagaatggctgagtggatcaacaacaagatccaactagatgctgcctacaagagacccatttttaaactttaagaataggcatatactgaaagtaaagggatagaaggagatattccatgaaaacagacagttaccaaaagagagcagggatgcctatacttatatcagataaaacagacttccagtaaaaagctgttccaagagacaaagaaggtcatgatttaatgataaagaggtcatcttatcaagaggacataacaattgtaaacatatatgcatccaaaattgaagcacttaaatatgtaaagcaaatattagtggacatgaaggaagaaatatacagcaatataacactaataggggacttcagtactccacttgcaacaatggagagatcaaccagacaaaaaattaacaagacaacactaaatttgaactatacttcagaccaaatggacctaccagacctacattcatccaacaacagcagaatatacattcttctctagcatacatagaacattctccaggatagaccatatgttaggccacaaaataaaccttaacaaattcaaaaagattgaaatcatgtctagtattgtttccaaccacaatggtgtgaagctaaaaatcaataacaggaggaatcttggaaaatttacaaatatgtggaaattaaagaacatgcttatgatgaactaatgggtcaaagaagaaatcaagagggaaattaaaaaatattttgagattaatgacaatggaaacacaatgtatcaaaacctacagtatgcagcaaagtcagttctaagagagaagtttatagcaataaatgcctagattaaaaaaggaaaaagatataaataagtagactaacattatgccccaaggagctaaagaaagaacaaactaaacccaaagtgagcaaaaggaaggaaataatgaagatcagaacagaagcaaataaaatgtagtatagaaaaactatagaaaatataaataaaatcaaaagttggttctttgaaaaaataaaatctacaaactcttagctagattcactaaaaaaagcagactcaaataaataaaatcagaaatgaaagtggagacattgcaatagatacctcagaaataaaaatggtcataagggattattatgaacaattttatgccaacaaattggaggacctagaagaaatggataaatttctagaaaaactaacccaacaagattgaattgggaagaaacaaaaagtttgaacactccaacaacaaataaagaaattgaagaagtgattaaaaactttccaaaatagaaaagcctaggaccaaacggcttcatggctgaattttatcaaacattcaaagaataattattaccaacacttcttagactcttccaaaaattagagctacagggaatacttccaaacacattttgttaggccagcatcaccttgatacctaaagccagacaaacatattgtaagaaaataaaaccacaggccaatatctctgataaatattgacgaaaaccaaattcaacaacacattaaagaaattatgaatcatggccaagtgggatttatccctgacatgcaagactggctaaacagaatgaaagataaaagccacatgatcatctcaattggtgcaggaaaggcattttacaaagttcagcattctttcttaacaaaaactcttaacactttaggtatagaaggaaagtttctcaacataataaaggtcgtttataagaaacccacagctaacatcataatccattggggacaactgaaaacttttccacaatttagtacatggcagggatgctcactcttgctatttctattcaacatagttttggaagtactagcaagagcaatcagacaagaaaaataaataaaagtcatccaaattggaaaggagaaagtaaaataatctctatttacagatgatatgatcctatatatagaaaattctaaagattctacacatgcacacacacacacacacacacacacacaaacacacacacaaatttttagaactaataaatgaattcaataagttgcaggatacaaaatcaacatacaaacatcagtagcatttctatacataaataatgacccagctgaaaataatcaagaaaacaatgccatttatgatagcatcaaaaaaatacttaggaataaatttaaccaaggggtgaaagtatactgaaaactataaaacattgattgaataagacacaaataaatagatatcctgtgctcactgatcatggatcaaaaacattaatattattaaaacattcatactaccaaaaacaatatacagatttaacacaacccctatcaaaatttcaataacattcttcatggaaatagaaaagcaatactaaaatttgtatggagccacaaaaaaccaaagcaatgttgaggggaaaaaagttggaggtaccacacttgctgatttaaaattatattacaaagctaaagtaaaaccaaaacagtatgatactggcataaaaacagaaacgtagaccaatggaacagaatagagagcccagaaataaatcaagacatatatagtcaactaattttggagcagggcaccaagaggacataatggagaaagaaaaaaacctcttcaataaatggtgcctgggaaaacaaaaatgtaaaagaatgaaattggacccttatcttacactatacacagaaataaactcaaaatgaataaaagaactaaacataagatctgaaaccataaaaatcctagaaaagaacatagggaaaaagttatttgacattggccttggcaatgatttcttggatatcacatcaaaagctcgggctacaaaagcaaaaacaaataaatgggactacctcaaattaaaaagctttttagcttttccatttttcatttatttattttatacactttaaaatctctgggtattcttttttagcatcttaaaatttatttttatatgagtgcctgtagatttgccgtatcctttaaaaaacaattattttaatatatattataattgtacatattttcggtgtgcatatggtgaaagtcattggagtggaagatagcaaggagcttggaaattgaaaaggaattcagaagttgttgatgaactctgaagttatcagcatggatggttgaatggcatcatagacaactatctagagagacagtacttgctttacttttggaaatcagtgtgctggcattaaaactcagggacttgaaaatgatggacacagccaaagaatatagtatggtgcctggggtgtagggagtggagggagatattcatgcattctataatctggcaagcataaaataatgcaaaaacgaaacaagactacctattctttaagttttgtgaagggtaaaaaatggtaaggagtgaagcaaagggctatttttatttctttgaggtcttcacttttcccacacaacaagaaaattgttggtaaaatcttctgggctgtcttctctcccacttactagaataggactattgctattcttttttatgagcatgtattggaatacagtgatggtgctacactctaaggcagcgttgtccaacagaaaaatattgtgagtcacatacatactttacatttttagtagccacattaaaaaagtgaaaagaaacaagtgaaattcacattgtgttttatttaaactactatatctaaaatattattataccatgtcatcaatataaaaattattaatgcaatcgattgcattttctactaactcttcaaaatttggtgtgcatttacaattgcagcacacctcaacttgactagccacattttaagtgctcaacagctaaatgtgactagtaacaattgtattggacaatgcagttctaaggattgagatattttaaaaatcaagaaacaatttttgttcagtagaaagttacagtatagttgacaagtaagattcatacagaaagctatctatacatctagcaatcatttatactttagatctttcaatctacttatttgtttctcaaccttgttgcaaaaaaaaaaaatctgaaatggcttgcattaagatatacaaggtaaaaaaaaaaaaaaaaaaagcaaaaccccaaaaggtgaacaagtattgatttcatgttcaatttatttaaagtctaatactacttgtcaatttggtcttccgaggaaatgcatcacatatttttagttgagcttcattttggaagtgactagagattgtgagttggggaaaataattaacttaccctgctaagctcacacatcaattaggtagcagagctgggaatagaaagcatagtttcctcttctagatgcactggggaagctgcatgtaaatctggaatccctcacttctgtcaaatgcatatcctgtttgtgtctcataacctgaataaagctgattacgtaaccaggtttccctggcaggtgtgaaactatttttaggaaagatgtgtcattgcttagaagtggattaaaacaaacaaacaaacatatgggttgttagtctacatagaacaggtgaggctgatcaaatttcccccatagtggatgagtacagtataagaaatatcaaggctaattgaactgtgaaccattgatcattgtttagagaacaaatgaatctttttctgcctggtggaggaggatggtaacatttcactgcttgaaactcacgagacttttaaaaacatgtatttttggtgttcaaattttaggtcctgcacccgatgttgtctcagacaaaatctaccaaatcagcaaaacgattgaggaatatgctatatgtcctgatctccaaatcgacctatctcgactaggaagacaagaatttgacctagagaacaaattcaaaccattcagaggtaacagagattttattttgaagaagtcagagtaactatgtggatggggctgactggtttctgtagggaagtaaactcatgaaaattattgcattgttaatctcaggggtgactcgataaatgtgtgtaaacttaatatggtgtagagagaagacatgagagcagccaagatattcagaactggaaactttcaaaaaccacttcccaaactcgatatcattttcaacataggaaaagttttatggttgacttcattatagcattccaaaaataggctgtgaattgccaaaacttgtctaagcaattaaggtgaagatgctggaatgccttagttaagaagaaacctaacaagtcaatgggttattaaatttctcatgaaaggtaggagtttcttttccaagccataaccaagcttggaataattacgcatcagcttattgaatgcataattattgatcacttgccctataccaagcaccgtgttaggagattttacaaaggaattcagtaactaccaaatatatttaggcaagtgattcaaaaattaaagaaccaaaatgagattgtcaaaaatattatcttatattgtaaagcaaatataacttctacagtattcagaagatagctttttgttttatagattaattttagaccatatgacaacaacattaataacatgtatgtatacaacattttccccctatattttatcatattgctttttcctagaaggcatagaatagcaatagatctaacatgttttacttttttagtgcttctataagcttgaatgcagtttgtgttaagatggtatcctcattttagaagtaatttaacttagcccaaaagaggaaatacctggtttgtgtccatgtgatattttagggatagagaaaagattaaaatggattgtgtggggggtcacagtatttgcccaatgttaccaaatctttcttgagaagttttgagtcagttgtttgcttaggtaatgagcagaaatttacagagagccatgatactcactggaagcaacagggcctgcttttgctaatctagctgggagaatgcataggcatatgtgtgcacacgcatgggatggctggacaattaaaggcaaggggtacattatattaagcaaaatgatttcaatacgctgattacatatggttggaaggactaggcttatttttggcatcttcacaatttttatagttgtccaagagacccgaatcttcgtgggctctcattcaggctcattgctgcagccacattgctagttgaatgagttttctaaaaatgttactgataccaggagataggtagagggattccctggcttccaagaatttggagataatcgtttgggataatttatgtgctgtattcttgctggttcaagtgttgagcaaagcttgagttaattaggaacaaataattcctttgcatttcactttaaagtgtcaagagcatgaactatatgatgtgaactttcaatttttactgacttcttgttccctcgtttttcacatttgtttggtactgtgtgttacctattgtaaataccaaatgtatttaggcaagtggttcaagaattgaagagccagaatgaaattgtcaaaaacattatcctataatgtagagtgagtaaaacttccaaagtactcagggcataaccttttgtcttacagattaatttttttatggcagtaaaatatacataacaaaatttaccattttaaccattgtcaggtgtacactttatacaggttaatttttaattacttcgtagattattatgctcctcatgtaaaaagataatttaaaagtatccatgttacaaatataattatatttgaatgaacacatagattacattgacttaagtgtaagaaaaaatatttttagatatgtatttgatcagatgaagggataatattatatggcatattaagatctcatccattaaatatcacacctggatttactaaaaattattgaaagtgggttggtaatatcttcagtgcaagtttaaaagtatttcagggtttcaaagtagtatgtatttgaaaaatctgaaaacaatatacataagtttcaaaatttagctaagaatttaaaaaagcagggctcctggacaaattttagcacctaaagaattgatttactacttcttggaaaagtactttctgagcattaattatacactgattgacaagtatgaaaaatgtattctgagctttttggtatgtcacataaatgaataaaactttttggattattggttactgggtggtgctagatactggaaagcatttgtgtttaatgagaacttctagatatttgccattcatttggaaattgggtgctagattgggcatgaatgagatttcacgcaaacccaggaatatattcatcaccaattctgcactcgaatctggtaggcacaatggcatttggaaaataggggtcactactgaggtcacttgctgatttgtttcataccagctgagtcagtctttggccagcccccacaagaaaggcaactggatatgccaaaatgcctctaaacattgagatgtgtgctgtgtgcatttttttgggaggggaagtgggagcaggagtaacagggcacatttttatcttaatttattcttgtggttgatattttccttgcaaagaagaatttataacttggtatcatttatacccattgagcacctgaaaagcttgtagtatcttgattgtgccctgatttgtgatttttgtcaacaaatgggcacttcgcttcccacatcatgtgcagggatatgatgggcttgtgaccagaatttcatgctgttaaggtagtgattctttttatgcttccaagtatctttcatgggtacagtcaatgacattttcctttgtttttctatctttagtggagatagtggacccagtggatatctatcttaacctccttcggaccatctttgactttcatgccatcaagagtttgctgactgggcccagccaactgaagattcgcgttgacgcaatgcacggaggtaagcttgtgattttctccaaatcagtgggcaggaaatattgagacctctacacctgttgggtttcagaggttaagaggaaagttggattcatagatattcacacaacatgtgtatgttcagatatttggaatgctctggaaaacttcaggacccttatttctgtctttggatgtaaatgaaaacaaaagttgaacaaatgagtttgaggctatgcatgttcaagtgtggagtatagtaaaactgttatttatttgatcatatgcatggcatagtttaaacagtcaaataaatagttcaagatttattgtgaaaaaaatctgtacccaactcctatcttcccccaatttgttaccttccagagttaaatttttcaattttttcagctgtttctttttgtatttatctccctatcattaaatattatgaatatacagacccttgttgatttttcagttttgagcattactgaattcatactacaggaactggagctgcagctctttttcaccctctccacccaccacccacctctccacccaccctttccacccaccagttagggaatcctagcatgcttccctaattatatcaccagtttggtaagatcattatctagtgtttacattaccacaacactgctgagccatgcaatatgctataattatatttcctttacagtacaactttttgatttccttggaaacagcaattatcttgttttctcattgcttgcttttaatcaagtatgtttaccactcttaatcctcaagctctccgctagtgtctaaatcttccttcacttcattttcctggagactttgatctgccccactctgccctggttgctctctgagcatgctgtcatcatgaaatctccctttatcaccatggtagtaattctttttacacatctcttatgttaaatgtcctgtcccctggtttctttgtctgacaccttgatttactggtacattttggaggaacacattctccaggaactcagtgagagaaagctcatggtaggtaaatattttgtgtattgtatatctgaaaaggccttttattctacacttgcccttgattaatatttgactgatatggaaatctatgttggatattatttttcttcagaagtttgagggcattgctctactgtgttatagctattatattaaacttgagaaatccagtgctattttgatttttaatccattgtctttcctttttcttctctggaagcttttaggacctttgacttatcttcagtgttcctctgttttacaataatggatcttagtgtgggactctatctttattatatcggacacctgatggaccctttcagtctgaacacttgtgtcctttaattctggaaaagtttttgaattactatttagtaaccattctggttatttttactactgaattgatcctttaattattctatttccccttctcctccccagtttttcatctctttattttgttctactttctgggaaatttccttgactttatcttccagtcctttagttctaccattatatttttaatttcccaaaacttttgtttgtattttccaaagattctctcttgtaaaaacgcatcctagttatgtttcatggataccatatctttttaaacttaggtttactgaggtataatttatacacagtaaaactcactcctggtaggtatacagtttgataagatttgaccaacatatacagtcatgtaaccactatcacaatcaagactgaatatttccatcaccccaaagagcttttggcagccctttgtagtcaaacctctccccttatccccagcccctggcaaccactcatctgctttctgcccccatagttttgcattttccagaaagttatgtaaatggaagcatacaatatgtcaccttttgcttcaagcttctttcactcagcataataatttcgatatacattcctggtgttgcatgtatcagtagttgttccttttactgctgagtacaattttattgtgttgtcgatataccacaatttgtttatccattaactggttaatgaaaattagatttctttttcttctagttgttggctattataaagaaagatactgtgaacattcgtgaacaagtctgtatgttttcatttgtcttgggtaaacagctaggaatgggattgctgagtcatatgatacgtgtatgtttacctttataagaaacggccaaatcattttccaaaatgcctgttccatttgcaccactggcaatgcatgagggctccagtttacctgtatcttcaccaatacttggtactgtcagtcttttccattttagccattctactctatcttgttaatctctattaggatattactgatatattttaaaaagttttcttttccctgtataatttttgtttcctccaggtttctctttactttttgtttattttcacctcatctcaaatacattcctcaaaattttggtgatccttggctttctggcatatttaagaatgaggcactaaaaatctgctgggagctctgagcctgctatgggtcttctccatgggccttactctaagggcttctggctaggctgttctgttctttcttgttgggctgatcatattcctcaggaaaagaactttcaggttcttgccttagcattatctggcctacagggaagacagctttgctttttttccaaatagtatgagcaatgtttctgggtttcagcctcattgcctggtttatattgtatgtccatctttgaatcaattgctctggctagaagatggaggacgctgattgcgcagacataggtcacctccttagccttggggaggtgggatttagccatacccagaccccatgaactgagatggggaagagagtttttctccaaacaaatcccaaatgctgtatccagaggaagaggaaatgtgtgctgggcaggcacaatcaagagatgttcactattggaggattgtgtgttgtattggtggaaaataagtggaaagcaatatctttcagatatttcagctaggaggattacatgctgttccacagatgtgccttatgttctacctcaggctctgttcccttgctcataatgttccttcgatttagatgggcttcccactctaaacccaaacacttgccaactttatattattccgtcaagttccaccagaaatgctgcttcttccttgaagccttatgtgtggttattgcttctctgaagccattggatataattatttcatcaatgtgcattgtttagtcttaccactgcagtcattcatttgcagctttgactcatcccactactagattacaagcccaggaatgtagaaactatgtgctttgcatcccttcaatatgatcccttcatttcctagcagagcagctccatattgcatactccataatgttcattgaactggaaaatactattccttggcatgtattttggtaaaatgtgcttgtttttatatgcttcagtggtttatagtgtttaattatatacttggcagagtccaaatgattgcagagacaaagaacattgctagagccctttaatgcttttgcatatattcagctaaagcttttaatacatgaaaagcaacaggcaatgaatcattattatgtagctgatttctttctggcaaacttttagaaaaatttcaggtgaaaaaatgtatgtaactagatgactgaatacatcttctgtattcctaccacagtaactggcacatagtagatgctcaataaatagtagttcaagcaaatattgttctatattgtatctttaaaacgattgtaaatttatatttttcttctgggttattaaatggtgtttcctgtactattcagaacaaaatactctggggagaaggttctgcaaatatttaatattgctgtgtatctatttttagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggtaagtaggaaagctgtctgtctgctgaccctttgatcatataatgagccatgcactggaaagcagagaattaatgaacacatctggagctaacatgtatggggcatgtgtgccctaactggctctgcatctgcccttctgtttaatgactaagtattgcaattaaatagcgattacttttcttagttccagatttacgttatggcatacaaaggttgtttatttaaaaatatatattattccataaacctttatttatggctggtgttgttgaaagcaccaagttaagaaatcagctatttctgcaagaaccagtgttctctattatgtttgggagaaagaaagagttaggtatttggggacttctaaagcttgagccacatttcaacaggtggaacatattcctggtgtgtcaagattctgggcccttggtactcagagatttcgaagaatgtttcccatgttctctttggcctcattcaagttgttagattgttaaatataagatggcagtaaagtggattgtgatgattatgggaatgggctgctagcagatgcttctgtccgatcatttttacgcattccttcctacaggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacaggtaagcaaggatgtcaccgtgaaaaactttatggtagacctttggcgtcgatgtctcctttgttggttgctggcgcttattctcccctgctccatttgggaatgcgttgaaagcatgggaacacggtatagtgtactgggtagaagctggagaatcaggtggcctgagcttaattcttggctctgccacttactagctgtgggaatttagatttatttagtctctgtgcctcagttttcttatctgtaaaatgtggataataatagtggtatctttatatggattgtcatgaagtacaaatgaggtgcttcatgtagaacatttaacatggtgcctggtacatagtaaatactacataaatgtttagcaacagaacttattaacctgaaagtatgtatgtataagtgagggaaaaaaagcatgggttttgaggtcagattatattatgttcaaatgctaacttatagccttattagcgctgtacaaatagaaaaatgatacttcataggtttattgtaagaatgaaacgagacagtgcatggaaaatacccaacaagagattcactcagtagggctctaactaaccctattaggtttcattcttcttgctctatccatccctcttgtctatcaccctatattataaaacattgaatttcagagtctgacattttcaaccagcacgtgttattatagaaacagtgtatgtgcctggtggaaagttagaaaacacaaataagagaatgtaaacatcatatcccctaccttgggttacctatgttaatagaaaaacttatattccttactgtatctctttctatacatatacgttatacacatataattaaaatacataatataatatacataatatatatacatatataatttatttgcctgtgataataccaaagacatcaaaaagtacattgcttgtaacctgctttttcttttccatcaacaattgccaactaccaattaataaattttggccgggcgtggcgactcacacctgtaatcctagagctttgagtggctgaggtgggaggatcacttgaggccaggaattcaagaccagcctggacaatagagcaaaaccctgtctctacaaaaaattttctttaatcaaccaggtgtagtggcatgttcctgtagtcccacaccaaatgttgattaggataggaagcaaccagaactttcatacattgcaaacaaaagtgtagaatggaagacagtttggcagtttcttgtaaaatggagcctacagctgaccaacattccattcctaaatatttacccaaaaataatggagatgtgtccacaaaagacctgtataataatatacatagttgcatgattcataatggctaataactggaaacaatacaaatgtccatcaacaggagattgcaaaaatagtgatatatttatatattcgtatactacacaataacaagaaggaatgaaatactgacacatgcagtgggtatggatgaataaaaaaatattaaatgataaaaagccagtaacaaacaaatacataatatataattccatttctgtgaagtttcagaacaggtaaacatatatgtggcaatagaaattattacaatgttactgtatgaggggtaggaagaaggcaccgggaaacattctgaggtgacgggaatgttctgtgtcttaatctgggtggtggttacatggatgtgcacacttttcaaaactcattgaattgtacccataaaatgcatttcactgtatataaattttaccttatgaatgaatcaacaccatgaaaaaatagccacaaaatccagaagatgagattctatgggacaaattagctaggtatgatgacgcatgcctgtaatcccagctacttgggaggctgaggcaggaaaatcgcttgaacccaggagacagaggttgcagtgagccgataccatgccattgcactccagcctgggcaacaagagaacaagagtgaaactctgtctcaacaacaacaacaaaaaaatactgaagggccataacacgtggttctaaatgagatactacattgggcaaaccattcaaaaaagacattctggagacactgagggaaaatttcagtatgatcttagtttcagatgacataaaaattatttatttgtttattttagagaaagggtctcactctgttgcccaggctggagtgcagtggtacgatcatagttcactgtaaccttcaactgctgggctcaagcaatcctcccaactcagcctcctgagtagctaggactacacatgcgccatcatacccagttaattttaaaaacattttttgtagaaatgagatcttgctatgttgcctaggctggtatcaaattcctggcctgaagtgatccccctgcttcagcctcccaaagtgctgggattatgggtatgagccactgaacctggctacttttaatcttattagtatcttttaatgggcagaagttttaaattttgatgaagtccagtttatttttcttataattaatggattatatgattattatatatgtctttgtcaactacaagaaatttttgcttcctccaaggtcagagagatattttctctatattttcttctagagtcattgcagtttcaacttttacatttatgtctagaatgattttgaattaatttttgagcacggtataaggtaggggtcgaggttcacttatttcccttatccagtttttccaatcccatttttaaaaaagaattttctttcccctgaatagccttggcaccattattaaaaatctgttggccatatatatgtagatctatttcaggattctctattctataccactgatccatttgttgattcgtatgtaaatattacactgaaattaggtgagcttcccaacatgtttttcttctttgtcaaattaaagggaaattatatattctaggtcctctgcattttatttcattttagaaccaacatctcaatttctaccaaagcctactgggattttgattgggattatgttgaatctatagagccatttggggagaatagtattttaataatcttgaatcttccaatccatgaatgtggtatatctctctatttaggttttctttaatttctcttacatgtatttcataatttttaatgtagagatcttatacaatttttgtcaaatttatttctgagtattttcttttttttgacgctattataaatgttttatgaatttaattttccaattatttgctgctggtgcttttttgtaaattgaccttgtattcttcactagaggggagaagaatcacctaccttttggatgcctcccactctacttgtctccctgaggtgatatggaccttaagtccacgatggtgacctaaactcagtttaaaattcttgcctagcagcaccaaagagtggtatgtgattccatgttttctcccatttacctttgcctacacccttcctttaaaaaaaaaaaagactccgtagaattgtagggaacaaagcaaaaatgggaccatttctagaaattgagaactcagagtcatataggatcctgagtgatatgtagggtatttaataatatgggagtatatttaacccttccacttatacagaatcttataatttagaaataatttgtaacatatcaactcacttgatctttgcaataattttatgaggtaattgaggtaggtattactctcctcatattaaagatgttgaaccaatgatcagagagcttaagtgacttgtacaaggtcacacagtgaattagaaattgactcaggatttgaaactaggtcttctgataatagggtactactgtatctgcccaataactataattggatcaaaagggtccctgataaaccagttgagaatattgtcccctgtgggctagcaaataactttccaaaccatggctaggggaggctggttttactctgacaacaaaaaccatttgtccttgtttcttgtggaaatttcccagcagttcttgatttcactttacccctccttctcaataaatctctgtttcagtcagaaaccagaggccttgcttagaaatttcacaaaggacctgttctgatatgtaagtgaccatttaaaaggattattcatgcttgctggttgggaatcagaattctgtggggctctgacgtggtgatttgttctgggtatttgatctgttgtgtaggtcccaggtggattctcatgatggacactttataagcttctttcttcctaggtaaaatcaatgcagcttcaaaattttgaccttgacagtggtttcccatatagcttattttttctttaattagtaaaattataggaatgtgcccataaatgccaggccctggaataataacaactgaggacacagttgagatccattaaatgacacacttgcctaaactcctgggattccagaataaggggaggcctgtacccttgaggctgatgaattattcagacaaactttcattgttcacagataattgtggctccccaagggaagattttcagtgtctttaatttctactcttacagtgtcactaaaacaaggattccatttagcccagaataatacagtttcagccttgaaaatggcattcttttggggctttgtcattctgaatgtgtctgatttgtggttgcagatgaatctgtgttgctgaaacattttggttcaaatgatttcagaagtaaaacacattgaaagtatgtttgtggcctgaggtccgtctccaccccatgtagaggtattaaataatcttttgtgtcatcatccttccataatatttatgaagcacccatctgtgcttggggctgtgccgaattctgtgcaaaacaaggcaaacacacacagcctgaagccctattcactagacatatttacagtctcaaacatggctagcatccttgaatacatcccaagaagccagatctaaaaagtatgttttgactatgaaaaaggccatccaagatccatcacccataaacagggtggtgaatggattagtgctcatctaccctctatttgctcttatgccacccctatggttcaccatttatccactcaagaaatatttattaaggacctcctatgtcctagacatggtccccgtggcagtgctttcagtctaatgcggaagacaaagaataacaagtaagggaaacatacagaaacacaaattgtaacacaggctagtggaaatgaacttggtgcagtactcattggtgggcatcgagcatcttgcttagataggagatccagggaaggactcttggaggagattaggcataggaccaaagatcagaaacaggtatctggacctgactgtgatgctgggattagaaatgacacccacacatgtgaaaacacttattcctcagaaggtagtctacagctatttgttgccaattcccaatctaaaatatgtactatagctttatcttgaacatactcagctgatcgttggaatccagacagtgttaatcctccaagtatgcaagtatctactgatctctggtgatctcgattcttaccacgtcctttagatctgtgctgtttcatctcccagatcagtcatgatggatgacagtggtggaagagatagtgatgtgagctcatatgtaattactcagtctcccatacattgcttctgctatagaatgatgggaattatttcgctttagcagataaatatgttcaaatgtaacctatattaacataaaagaaaaaaagaagaaagccctttatcctgtaagttattgccctgaaactctgtatagctgattcagttaggatcaaggcaggaaagagatggcaccctcaaaaaggtcttactaaagagaatttagtaattgtaacttaataacctggtctaaggaacggatgaggttaaggaaaccaaaaaacacaagaaggaatggggaggtaccttagcaacagcaatagcaggaagctgttaacacccctaggactaagaagggtccaggggagaggtcagggtgaccacagcctagtgagatctggagttgtgaaaagtgggcggtcagacaagagctgaacttggcaggggggagaaatgccccaacttgtctcttctcaccctccaacctcctgctggtgcctcctataaccaaaccgcactggaagccagagggcagcctatggagttctgcctcctggggaagagaacagggcatttgatgaagtggggattttggggtagaaggggacaaaaagccaccagcataaatggcacaatggcccatctttttgcttatttctacttgcttatctcctagtctcatcctcttccctcttttttggacttcaggcatagagagtcgacttaatcatactcatcattgaacaatcctttaataattggtctgattgaaggctcatttcttattactttaaaaatgataatgcatttcttttctctctgtttgactgccccaccatagacaaccacaaaaaatgtgtttattgggttttgtgtatatattttttgcatatatttttacttaatatgactagtactatataagagattgtatttgatttcttacctttttttccactaaagaccacactttaagatcctcttgatggctgtacatccatctagggtgttgcttcaaactgctgcttatttgtccatgagtgcatccatgatattttgcccttgattccctcagcaatgaacactcagactgcttctcacttcctatcacagtgaatactgctgcacaggcaccctgtggatatgtgtgagaatctcttcaacacgtgtattcagaagcagaattattgggccagagggggtgtctatacttaatttagtcaattttaaccaaatactgtcagattgcactccagaatgcccatctcttgcctgcttctccaaccggtctctaagttcctgcatcttcaaatccaggccaacacttcatgttgtctaactttctaatttttatccagtagactagatagagagtaacataccattgcaattttaatttttcatgtctcacattactaatgagcttaagcatctcttcatatgcttgagaaatttgggagtttccttttctattaattgcctattcctgtcctttgaccatttttttttttctatttagggttcttctttttagtctgatgaatttgcagaagttccttggatgatctagatactagacccgttgtcagttttaggcacttctaattttcatcttttatctttagacaaaattttactcctgatttcgatagccaaattgatatcagtagacagatctgttatagacaactcaaatttaacatgtataaatagcaacttttctaatttttcctgaaaattgtttttcctgtgtttagtctctgcatgagtcacctattatctaaataataaaccttggaataatccctcattccagatgtaccactaatcactgggttttgttagaaggatcccttaaatgtttttaaatcattatttcttctccattcctacttttcctttcctaatttacgttctcattatcttttgcttggactattgtaatagtcaataaactgttcccacttcctctagacttcctcttcttcatttcctcttctgtactgtcccaagggcagttgttctaaagcagaaagtcgtgcattttcttcccttgtttaaaatgggttggtgggctttgaatgcctgcaggagattccgtctcctgattatacaacatgcataatctcctgattatagaacatgcataatctcctgattatgaacacttcactcctgcagacattcttatcctacactctaaacatgtcatgctgcttacagttccccaaattcgatgccctcacatttctatgcctttgcatgcacttctgtccctgaaatgtattccctttgccccacctcattccactttgttcttctttatcttttatggcttgagtcaagcatccccttctcagtaagtcctttgataccatgttccctccaccccaacagatatttcaaaaagttaactactatgagctatcaacatgcttcttttgactttggtacagagagacatctggtgatactatctgttgattgcaaagaaaaatatacccgactaataagaagaaaatgaatggtgcataatgacccaatctcctttggatataataaaactatgcctgatttgtggttttcatttacatttaggtgagtttgtaatgagttggatttttagtaatgatatgtgggtactgacgctcttagcaaatacagcttaatcaatgtgagatgaaaggaagcaactgcattgtagttatttcctagtcgataatgaactccccacagcctgaacttaagcgcaaggttgtttattccttgccctggcaaattgaatgaggactggattcattaccaaggcatttacaagacgcataaggtggccttcctttatggtttgtgtgttgacctactggaaaggatgctgagactggttcaagtctgtaattgtgtgtttctaagagttggtgtctaatgggaaagtgatctcaggcctgtagttggtaaaaagcatttatgtattaactggctagagtgagaggaataaatttttaacacttaagactataaactgtaggagatttggagatagtggctaaatcctcttggaaatgctggatgcatcatcttttattcaatttttctgagccatcttgggtttctgctatctgagttagtcagaaaaacacttagatgaatgttaagtaacccaagtgctaaaatatatagtcgtcatcactctcccatgagaactgaaagacgaaccttttttggaagtcagctctcttttatctgctgtatttgtgaggactctttgatactcagattctgtctcgggaagggcattgtcattatttagggtgtccagcagcctattttcagccctcccaccgatgtggcccttcttggtctaaacaagtcactttgaccagtggtggatggatccaatactgaaagaagctccttagaatcgccctgtctgattagggattcaaggctactttaaactggggtttcaatgccatccagtctcagtgccacccagtctcgaacatgtggcgtgctgttgttctccaacgggaacattaacttcatggcctgcctttgtaatctcaattttggtcttccgaggctacatttggttaaataacctctctcttttattccttgtgacttaaaatatttattcaatttaaaaatcaatcccattgattactgcaaagaggcatgaggtatatattttgagctgataaaaatgttccatatcttgattacagtggtagttacacagctatatatatatgtgtgtgtgtgtgtgtgtgtatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatggatgaaattggaaatcatcattctcagtaaactatcacaagaacaaacaaccaaacatcgcatattctcactcataggtgggaattgaacaatgagatcacatggacacaggaaggggaatatcacactctggagactgttgtggggtggggggaggggggagggatagcattgggagatatacctaatgctagatgacgagttagtgggtgcagcgcaccagcatggcacatgtatacatatgtaactaacctgcacaatgtgcacatgtgccctaaaacttaaagtataataaaaaaaaaaagaacaaagcaaaaaaatgtgagtgtgtgactgaagtggtacatctgactttgccactgattctcatcacttctcagggcctcgctttccccatctagaagggctgggatagtggctgttctgcaaagagcccccaggggccacattgcgtctagctcatagctctgcctccctagtaggatgcagcccttgtcctcagggttccaggcagtgggagctccggccaccatgcccatatttaggcagcaactagagagaggatgaagaggaagggcaaaggactacactatcttttaaggagattcatggaagtggatagttgacacttttgcatatatcctataggccaggacttagtgatgtggccacacatagctccaagggaagttgagaaatggagtcttcattctgaatggccatgagcatagctaaaaatgaggggttgtcttattaagatagaaggggatgagagttatagagggacaactagctgtctgtactgtgggtttagatgatgtcctaaacattcagtgtagaatattgcagtcttcgaagatgtaaaatatctttaatatttgatcgttaatttttttctttagactaaataatttaggatgctgacataaactatgatgatgatatttttgatgatggtgatgaggatgatgatgatgaggaggaggaggaggaggagaggaggaatatctaccagagaaaatagtccagggtgttatatatgacaatttacaacccgatgagaaaagtatttttcccattttacaaataagtaaattgatgctcagagtgggcaaacctctgaggccaaaccaggtcttacgaatggagtcatgatatagccacaaagattgggaacaaggtttttgggaagcaatgtggctctctgttgcaagtaaaaaaactgaattccaaatgacataaacaacaaggaaaaagttacatctcgtattaaaatgtctagaaagggcagcagcagaggtgggtaattcattgcctcagcaatgtcttcaaggaaccaggttctatcattctcaggatgtggtctttgaccttgatgagatttcctcatggaaaggccccagcagtgcgagctattaccctcacatacgatgtggtcttatggcagaaaagagactgcctactgtttatgtgtctttttaaagtcggggaaacttttccagaagtcctcctgtgccatatttgtcctattttgtgtaaattcacctttgctgaggactaggtacctgaataaagtcatgattctcttaatatgaaaagcagtgggaatgattttgggtgggaaactgtcaacacctctaattcattcataggttatttgcccattagctgggtgtgcctgtagtcccaactaccccagaggctgaggctggaggattgcttgagcccaggagttcaagaccaccctgggcaacatagagacatacagcgaccctatctctttaaaaagtatatataaatatatatatacacacacatatatacacacatacatgtgtgtatatatatacacatatatgtagtgtgtgtattaaatatataatgtgtgtgtgtgtgtgtatatatatatatatatatgattttcccaatatttaaggacaatctagaattctagaattatggatatttccctgaaaatgtcattacttttggatgtcccttgcttattacaacttactcacttgcttatcaataaacatttattgaaaaccttctctgggtcagatagtgtacgaataatgaaattcatgcttactgtcaaaaagcattttatgatttagtgacagagtcagatatcctcagcaacatttacaaaacaatgcatggaatgccacaatagaggcaatgaggatgcttagaggaaaccacttatattggcctggggaatcggaacttgtggctgtaataaagctttcttctcttagattatgaatgttgctcatggggagcacttaaatgagctccctgagaacagggaccacaacttctttgtttttattttttagtctgagtgtagtgctttgactatagtagttgatcaatgtggtgagcagaaaaggtagcttccctacattacagctagtagtggtgtttgctggacttcagcaggtctttgtaaattcaaagcccaggctctctaacaccatacatagcactttgttactcacaatgaatggtttgctacagaatgctttctcttttctaatctgcttcttgtctgattgtcatgcaaacttgaatgggataataaatgtaaagtaattagcatagaagaagcactcagtgactattacctgctattattactttataatgtagtctgcattatttttcttcctttatttaaatcttcaactttgctgaattgcttattgaagaaaatgctgtctctaaacataacattactggcagctggaagtgaaacttacacattatgcttcatggtatctgagagtcatgaagtttacaaagacatttctggtcttattctgataaatatcacatgctagtatttcctacattcccatttactcagtgttccctacttcctaaaggagggaaaagcgccgtcgaacagttgtcaaattttcttcacaaacagcttggttttccttaatggatgaaatcacccttcgttgatggatccatttgcacaggaatttctagatcatctcagggctcacactctgggtcccacctcctgctctgctacaaacggttaggtatctttatgcatcagtatccagctggccatagcggccctgtgtcagaaattatatttcctctaattggctaaagggaccattttcttaatagtttctttcttttatagggccatgtgctatattccatttatatacacattctggaacacagtattccagagcatgttaattgttcagagataatggacctaacaaatagaatggtgcggttaaggagaaatccagttgcatggaggtccttggtcttttgtgtggcttgaagaggttgaggatgctgatgtgttctttgggaagagattcacagttgacaggaaacatctgctttaatttgctccaacatcaacaagatcgatgtggtaggaaacctgttgttactgtgtgagttccatttatcaaggcagggcttggcctgaaatcagggctatttggacaggtaccacaatgggtcaaaatatggacataacaaagcagcattacttgagagtatcgtgtggctgtttctctatttaaagggagtcatgttccttctatacctgtctggctatcttcatttctttctatgtctttctcgttatgtttttctttctcagcacatttccattcagggcctcaattacgagtgtaacagttctcaccctaaattctgcctccatatcctctctcctgggtaagaaaggctcccagtgatggcgactctcaatggagggggattctccccaagggtttcccaaatattttcagaaacagctatgcaaacacacagactcacacacgctagtactcaccaaaccttggagattatccactacccctaaggtatacctgcctcttctggctaaccttcagaatcgcttacctagaattaattaaagatgctcttactttcaggaaaactgccttggttttcattatttggaaaagtaaagtttgtatctgacgcttaaaatatgcctctggagaactcaaagaattcaaagcattcttatatcagtgcatctgtgatactaatcttttagaaaattattacactgctaataaaatgtgcagtgtggattcatgccactgagcttaggttattgcctccactatttttgaaatgctagtgcccatgatgtcctgatgcaggaactcatctcttaacaaaacaacacagccatatacagaaaaaataaggtcctttttcacccattctggtgtagggtagctcaatcaattaaaagaaattgcaaaggctatatgctatggtttgggtgtttgtcctctccaaacctcatgttgaaatatgattcccagtattgaaggtggggcctaatgggaggtgtttggatcatgaggacagatccctcttgaataaattaattctgtctcttggaggtgagttcttactcagttcccatgagagctggttgtcacaaagagctggtatctccccatcttcttgcttcctctctctccatgtgatctctgcacatgccagctctccttcaccttctaccatgagtggacacagcctgagggcctcaccagaagctgaatagatgctggcaccaggcttcccgtatagcccgcagaaccatgagctaaatagacctcttttcttaataaattacccagcctcaggtattcctttatagccacacaaaatggactaagacaccctatcactggagtccactcagactaccaggtgagataaatccaggagcttccaggttctttgttcttgattctggcaatgggtccaaataaaagacaatgaaaggatatgctattggctactttgtcatttcatcttcctgcttcctacctaatgacctgaatgcacatgtgctcccgctgtcagtctccccactgtgaacaactctcctttctctttacgaacctcctctgccctgggcaggctggtgaccacactgctctgggccagatactgtgcccagtacagagaggaggtgcacgaggaaatgataaggcacatctctgctttggagaatctcattgcccaagaagacatatagacaagtaaaccagttacagaaataatggttaaggtacactggtggtacgaagaagggacgaatcagttttgcctaagattggaggatgctgggcaaaaaaggcttcagagaagaggaggtatttggagagtgcattgaaggttgaatagaaggtttagagaatcagaatttgcctagtgtacagaaagaaaaattgaaaggcagtggacggccatcagtagaagggtgtgaggcacaagttattgaggtacatgaagagactgacagtcatgatcattatgaagcattagttgaagggtcacagaggtacgcataagtataccaatggtaatgctgctggaagagtagccaggggactggagaaaagaaggcaccatgttatgtgctgggacctcattcattcttcatgtcataaggagccaattcttctctggacttttccacattccatgcaaagtctgtctggcttcctgtccatttactttctggtcattcaaggcctaccactgtccggtgtccagttgctcctcacatgcagatggaaaacctgggccaggtcaaagtctgaagacctagagaactgggcagagctctgggcagtgtgggatctgcccacacctctcagagagaggaactgaggtgattgttctgagaggcagtgagcagggagaccccgaagccaaaggctggcaggatccagcagggcagaggccagcaggggaattcagggaagagcctcagggctgacaatggggacacctgactacagtcaaggggattcaaagcacagcctggaacctggaggaatcccctggaacatggacacagaaatgtggacagctgaagccatgaccttgaccacaggtagggagcttgcagttagggacaggagccaactttacttagacataactcaaattcatttcatttctgaaggaaatgaaatttccttcattttcacctggttggaatttattgctctctccttaatggtgcatagcaccttgtttatttatgctttgagtaattgtaatatgccttgttttatagtatttttatacatttctacttcaactcttgattataaatttgttaaggcagggaatatctatctatctatctatctatctatctatctatctatctatctatctatcttatctatctatcatctacacacactaatggtattttagctatagcatacataaatacataggtacattttgttgaattgaaattaagtgaattaatcccatcctctttcagaatagaaattatgttttctgggagctagaaactattgtgagagatgttagtattgttgaaatttaaaaggggctgtccagttcagttgtggcctggtgtgtactgaatgacatccaaattctaagtaagtggaattgctatcagatctgaaataaattagccatgctcgtgagaagatgtagagtgaggaattccttccacaaatgctctgcttatctgattattggttagccagtgatttcctgtcatccacaaaaaaagatgaaatagtaagagaaaagtaaatactaggtgaagtgctttgagccaaagggagtccatataagaagtgatggatggctctgttgggatcccggcagtagtgcatgatgatgttggtgtataaatacgtcagctcctttaacccttgggggaccctgaggcatgtgtttttcatgggcccctagcgtgctcatgcaggattaagtttcagttgcctactgtggtaattggcttgagaagcctatctttattaattttcttctcttccttgtcttatttctcttcttccctacctgtgttctcttcattcccttcctccctacaaaataaactatgtgagtttgaattcttctttcaggattcaagtttactcctggggaaccaaattaagactaaagaatatgtattctctttcttctcatttggcgttgagacattttaaagcctcaacaattttccctatataagcagttccaattatttgtgcctcacttataaaaagtaggtaatgagaaaattaaggcttgcagacaaatcttacacaattgcagcagaatatctcagaaatgtgctcaattctcgggctttctgtttggtctctttaagcaggcaacctcaaagaggtgtttctagcttttgtgattatgtgtgattttgttattttacagcctactgctgtggaactctattgagaaaagacactgataaagctaataaaatatacatctgctacaaagaaaattttatctcaaaaatgctatttcctcttcagctctgaatgttgacagattttttttcctaacggggttcagtaggttggctggaaagccaagatcaaataccaacgggaggtgtgaagactggccagcctatgttcaacgagttcaccatccagctgctaagttctccatgctgataagacaaacactctctgaatcggatacgggcctactggtatctttaggaccatctgcagcacagctaggtaaagtaggcacaatttttaagttaggttttgcagaaggtcccatgaaacagggtttccttgtcaaaatacagtgagacataataacagagccatgtttggaggtcccttcattgacaatgggttatgccttcagctttcaggctgatcctgctgagaagcatatgtgattagccccaagaagctctttactgccccctagatccctgtcaaatctaggagatcttgagctgtacttcccctgggcccgggggacgtgtgaaatgcttgtgttgtatcttcattagtggaaatttttgatcaattatcctggatgatccatgtcatggaacattgagctgcgtatcctttcatttccatcattcagggtgatattcaaaatataggataggcatttttaaccccaaagtatattgagaagtaaaattaatgttggagattagtacattacacacctcatcaagcaggaagagacaagaaagcatataaatgcgacacaattctggggcaactcctgtcttcaaaacttatttgcttcagctatagccgctgaggccttactccttttcctgcctgtcttgaaagattgttctatgcggccacccagatttcttgggatctgatgctagaccttggaggaagtcaggtaaagctttctagctctgcctcagttggaccatgtctctcccctgtctctggtttcttgggctactttgatttcactttctgtgttatggaaacctctggcagtaactgttccctgtgtgccttacacttcaattgagatgcacaattgccaaagctctctctgataccaccagggagcagcgaacttaattcttctgtctttgatctctctcttgttttgctgtttctcccctgacaagaggctgagctgctttgggggccaccaagggccattctctccactttgtccttcactatatcacatccccatatgtcttcctatagtcacctgctggcgtgattccattttgtttgttgaatttgactaaaggtgtcttgagcttaggagtcatatcagcctgcccacaaaagtgtcccatttcactgggcaaatcaactagaatgttgttgtatttactctgtggacttaggaagggatcctctgggaattagccccatggggtttctgtcacctcccattctactttggcttagacaaggtatctgagttcagaacctgactctgttcctgcgctcagctttacagacaagtggtattatttttagcctgcagaccttttagttaacaccctgctgcattgagggtgtgagagagaagtgctttggaaatcagactctgttactgatagcttgtcctaaactgaaaaggcgacaggagaaaggatgctttgtgttcaagcagaagaaatctccgatgctgcagttgctgctgcagccttcccctgtgtttctcaccttgccgcggcctgctgtttggcaggacgacttgactggctgcgctgtggtttctgcgcctgtgatggctccttctgaatgccctctgagccctgggggtcttatcagctggctgcggcgggggtgggagatgaacagctcccttgtcaagcccgctttctccttctcctgggaacccctgccgggtcaccagcctaaaccccctctagcaccccatggcctcttgcttggggtgtcagagtcagagagagtaaggaggtgttgggagatgaagttcagagggtaaaatgataccgcaggaggaaccaggcttatgcgagctttatagtcggctgaaaaagagaatgtggtaaagatcaggtggcccgtttcaaaatggctggaacttttacttaatactttacaaggtgcgcccctgccccaaagtataggtggaaataaacctctgctttaaaatctcaacagaaaaatcagatcaaagaaatctggtgaaatacctttgattaaatgtaacacacaattgatctcaattccatagctgattattaatttttaattaggagtaagatacaggcaccatgatgtgtagattttgttgtctaagaaagaagatgaatagaagataatatgttttaactttttttttccaccaagttttaaagttctaagactgctggcaattttcaatgaatatatggggtctccatcactggccattttatgggcaaaacagcaaaacacaaataggtttaatgctgagctcccagcccttatctttgcttctccccctccatttccaccagtcaggtgtctagaaaagaagggcatcccggttgggaggaattggttgtggggaggatttggccatgatcagagtaggtactgcttcagaccgagctggggcattttaaaactgaggcagaagaagccatactttaggggtccggggaaagaaagtaggactaggatggctccacaattcctctgctgatcctctcagagacttagctttgcttagaagcattccctggtaaccagcatctattgctgtctttacttagcatttaaatgcccccagtctggcaatgtcagttatctcagagccaagacagaataattttgtggtagaaatcaaagaattttcagtgtaacatctagggcaggatttgtgcctcttttgcagtggatggccttttcccctcttgacagaattctgttagagcctcacattgttgagatatccccctcatctccattctacagagtgttaatgctgctggaagactgtctgttaaaatcagattcccatcaggctttgaatgctccctaccaaatggcgtagctgcctttgatctgtagtctcacttaaggaagcttttcaagtgcatggaaaatgtcttgaccccagtgtttggacctgtcactgcttgcacaccaaatcaaggtatcatcaagctgaaaacgtacacctagaggaattcctgctatttaatgggctcagccattcctgctgtattgatggcagtctcagctcagctctccctctgggggctccgaagaccctagagttatgttcctcccagcagcaaacctctgaggcttggtgtggctcaaagacagagtcagagctgctttgtcatctgtgattctgtgggttggaggagtagtcagaagtaggtcacatctgaagaaaaattctctgcttgtgatcttgagtacaactgaaggaaactgacccctttgaattcatgaagtaggatgcaaggttcatattatctatgaggactgtaaaaatggctccactgaccttgagcttattcactcacaatgcatgccagttagatatgggtatttagcatgctgtattttaggaatattacatcaaatgtggaaatacggaggcacatggtaaactgtcacgtactatacaaatgatcattgtgatgacattttcttaaaatgggttatatgaagtataaagaattgagaggctgactattgccagcaattagtttagtatagccttgtttattaatctatggccagatgtggtaccttagagcctatagatcttactgtgcacacccatgaccttcagatgttcgtcgggagacacaacatagagcctggtcttggtgcttgaggaatctgggatgtcatacctgactctttgatgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaaggctgatgaaagctaggtcgacgaataatgtgtgatgagtatatgtgtgcatatgcacacgtggacatgcaggtgcacatgtccatgtcagggtacatagtgttacaaaggggagacgaggtgtgtactgatcattttcacatttgcactctgccccgttcactgatcttcccctaatcggccctgtatctccaggagttccactgcataggcctctgcctagggcctgcttcttctctcacccctggtggctggctgggtcctgttgggtggctccagcctcagaggctacagcagtttcctgatgttgtttatctatagatggtctctcttctgtttggtgtctgagctcttccatcttatgggcaacggattctccatattaaattccttctgtttgaaatacttagagctggccaggcatggtggctcacgctggtaatctcagcatttggggaggctgagggaggcagatcacctgaggtcaggagttcaagaccagcctggccaacatggagaaacctgtctttactaaaaatacaaaaattagtcaggcatggtggtgcgtgcctgtaatcccagctattcgggaggctgaggcaggagaatcacttgaacccgggaggcggaggttgcagtgagcggagatcataccactgtactccagcctgggtgacagagtgagactccgtctcaaaaacaaagcaaaacaaaacaaaacagaaatacttagagctgattctgctttcctgactggcccctgactgattccagatgcttactttgtagatggatactagattaagacatgcatagtacaatttgtagagaagaaagataatgtagaatctaactttatactgtttataagagatatgtctaaaaaatgtgattcaaaatggtttaaaattaaaaattaggcaaatatataaaaaatgaagagaaaaaagcaaaaatcaaggtaataaaatgttaaagcaatgaagatcacttttatttattttaaataactatcataaatatttatgtattgaatgacagcatcagaatatataaataaataatttttaaatgtaaaaaaaaaaatttagaagctatatattaagagaccttactgtaattttcctaacttttgatagaccaagtagccaagtaggaggaacaatctcaacaataaaataataatttattgacctgaaaaaacatttagtagcattgattggctcaaaactatctatatggggggtttgcctgggaactccatttgcatagcaaacactcagtttttattcatgttgagttatattattgggaggagctgaaggagattactgttggggctaatgtccccatcccctacctcttggtaacaaaactgaccctcaagagtcactccttgtgtggtggttttttgttttgttttgttttttgttttgttttgttttttgtttttttgagaggggtttcactatgttgcccaggatggtctcaaactcctaggctcaagtgatcctcctgcctcagcctcccaaaattctggaattataggtgtgagccacctagccgggcccggtgtactttcttccccattcatctagaaaagtaagaaggcatattgttgatgaggtaattaaaataaattaattagcacaacaataagaaaataagtaatgtgataaaagcagtctgcaagggcataattaaaaaaatttttttcccataggttattgggaaacaggtggtgtttggttacatgagtaagttctttagtggtgatttgtgagattttggtgcacccatcacctgagcagtacacagtgcatgctatttgtagtcttctgtctctcatccccttcccaccctttcccccgtgtccccaaagtccattgtgtcattcttatgcctttgcatcctcatagcttagctcccacttaggagtgagaatataccatgtttggtttcccattcctgaattacttcacttagagtaatagtctccagtctcatccaggtccctgcaaatgccattaattcattcctttttatggctgagtagtattccattgtatatatataccacagtttctttatccactcgttgattgatgggcatttgggttggttccatgtttttcctattgtgaattgtgctgctataaacatgcatgtgcaagtatctttttcatataatgacttcttttcctctgagtggacacccagtagtgggattgctggatcaaatggtagttctacttttagttctttaaggaatctccacactgttttccatagtggttgtactagtttacattcccaccagcagtatagaagtgttccctgttcaccgcatccacaccaacatctactatatttttttatttttggattatggccattctgcaagggcgaaaatttaaaagaacacacaagaacctgaatttgaaagagtaaatggtggtgaggcacctttgaagggagagtgctctgaggagcaggactgaagagcttggtgttgagaatgtcacgcagagctgacattaggttcaatcaggttgtttctcttcccctggaatggcagcctttgggaaataaccccaagagcacaaaatctctctctctctctctctctctctgtctctctctctctctctctctctctctgcctccctctttctctctttcttttgggggctgaggcccttgaagaccctttgcaattccataaatagtcagagacatccctcaaatactacaccatgttcctctgcatgggaaaagtgtggtcacgcatacacgtaactccattccctcccctcctttcctccttgcaatggaaggagcaggaagtggacaagaaaacagaacagtattagagaaacagaatgtacctaaatggggaagactgggctgaatttgaggaggctgagttttacttccaaacccacccaattcactactgctgtatctcttgacaaaataagtagacatagtctgtggccaattttcttctaacttcatctcagaactcctctctcctctctatgcatatctgccctccgcaagcctcagacctcatgatgaacgaggaaggtaaagcatctggaaatgtttcctatgaagagctgctgaaaaagcctgagatgttgtttagtgtagaaaagactcaactttgcatttcccacaaagtgtttcatggaacaccctttgtcttagtctgttccagctgctgtcacaaaataacacagacagtgtggcttatgaacaacagaaatttatttctcacagtactgaaagctgagaagtccaaaatcaaggagctggtgtgttgggtgtctggtgagggcctggcttcctggtttatacatggtttcttcttgctgtgtcctcacatggtggaaggggcaaggcagctctcaggggcttcttttataagggctctaatctcattcacaagggatctgcccttgggatctaatcacccccaaaaggtcccacctcctaaaatcatattattgataactagatttcaacatgtgaattttgggtcaaccaaagctatagcactactcacaagaaatgttaatgggtgttcttaaacaaggcagaagggttccatggacaaaataaatttggaaaaggatgaaataaatataaagcaagtttcttaacttcttcacttttcatagcttttgacagattgttgtgattctccagtaaggactacagaatgtagcatttcccaaacatatttgaccaatgaactaccatcccaggtgtacctattaatgtctcttaggggactagtgggaggttgcactgtttgattttaaagaacgcttgcaaaaccagacaccatgacttcaagttgcccttattagttagacctgtcttctgaggtccaaaattgacctccttcttcctttctctgaaattcatataattatatgattaaacaaatttctactaagacaaatttggtataatcctctagctcttcatttgctattcattgttttaaaagtttcttatttgaaataaacagttagataattataatgggagatcatcttttttgagggcttttctgtatgctctttctagtataagtcacctctttctcttttactgttccttggcaagcaaaaacacaagtttaggaacaagccagagttatcaaaagttctacaggagtgaggaaaaaaagagcaagaggaacgcaggagaggcaactcacttgatgacatggcagaagcatccaagctgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagaggagttgagtttggatcaaatcctatcctaaccattatcctattttggagttgagatacctacattttagaaatatttttaatccagaataggtcacatgctaaatattctgggtaaatggtgtttatttgttcattgttttttttcttggcatgtggaagagaaatcatcttgaatcaattgtgttcattggccaaacagtatgataatttgttaaattttactgattaatgatgcagagtcttgactttcattgtaagtaaactcaggacacaaaaagcactaagagatgcccaaagtggttttctataatttaaatggaaataaatttgtatcgaaagtacactagatttcacatttcacatccttttagttttagatttaaaaaaagagcgatactttctgacttctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtatttaaaaaaaaaaaaaagaggatgtcacaatcatactgcctattttccaggattattgtgagtatccagtgaggaaaatatataaaagactcttataaccttcagatttcttacacatacatataattgtttttaacacatttctgatctttgttcatatgtatatatggtttcaatcacaggaccctatacacatttgtgttccacttttcatatctaatgttatagttgtgccataatttactagccctttccctattgatggacatttaaatggtttacagttgttccctattataatagtgcagtaataaacatctttgtacattcaggcttttgtctttctctctttattatttttttttttttttggccaatttctctgggactagttccagaagggaggttgtggagtcaaagtgaatgaccatttttttaactaacctgtcttttgagcttttcacttcatccaaatatctttcccttggtaactttcctagaaagtcacagagcactcaaatgccttcttgaagtcagccagaaagattcagaatctacatttggtggccatatttccattttcaggctctttcagaaccactggcctgtgaggcctcccctagactgcaaggcccttcaggacaagattgtgccttaatcatgttggcatcctagcatggcctggcttgtcacaagaactcggtaagtgattaatcaatggagctaaacagagcagatgcctaatacatgataggctccttatggtcacctgacttgccaaagcattcattcatcaaagagtttttaacaatgtcaggcactggtgctagaaactggagacagagaggcaaatgtgacacaggtggcctcatcagcctagcaagcagagcccccctggcagtggaagagcttagtcttgaatctgagaattccttgagaaggggtccaagagtggagttgaccttggcccatgtaatgtgattgcagggaaggcccttgctatgcctaaatattttaatcatctaccccttaatatcagtcattctgtaacacagatcttgttacagagatggaggtgacagaaggggcctctgcaatgttatttgacaaccatatcctgtgtcaaagaacctcaagctctgttgtctgagccaggatgtgagaacagagttccttgacccagcagggttagggagggtttccaaatcccctctggagcagaaaatccctgtttgatcctatccagcatcataaggccacctgctgtgggcatgaatgctggggagggtggggtctctggccaactcaggaaagatctgattctgggcttttcacttgtgtataaatgaatgtgtctaaacattatatgctttccatttgcctattgctggaaaatttgataaagggtgcagaaattgagcaaatagttctgcaaggggatgtagaaagttttccttggcctcagactctgggctgtcttgcaactagttccttggaagtctgtgtaatttacttaaggctggatgaaaaccaatcctaggttttccatgatgcctctggtagtgctggcttagcttgaactctgtgggcagagattgtcaaagaggcagctctgctctaaatttcttgttattgttctctgtggaaactcacagagaacactgacaagtttctgagaccctaggttgttttatgttgaacactgcactgttgagtaaagacttggagttctctttatgagttagaatgttgtggctttccttttataatgctctgtaaagagctctccaaatttggctaaaaatttatacactttatggctatccattgtggtacaaccatatgttcagtttagaacaaataaacacacttgaacttataaacagatgaaactcagtttggtaatatttataatttgttttaatttgaccagaaaagtattatgtgcccaagcctgtcacttagtcaatggtcatcgctgggactgagcactgtttctgggtgtcagatagaaacattaatgatttgcgagtttcaaatgtccccagggagacggctctagcactgttgtgttgcatgggatattggaggcaatttcatatgtgcacatatagttagaggtttgcgaggtgtttattttttggctacctgtagatggtttcattatcccaaatttgtattgatgagcaaattcaaactttttcatttcagttcctatttcaaaagcgcctgtgtctgttttttctttgcctctgttaactggctctgaggtaggcatcctaatgcctgtttcccctgagccaagatcacatcttgtgtttcagctgcaagctaatagcctgtcaggagtatggaaatatatatctgaggtttgtgattctgcatgggatcaggatttccaggagtgcctgttggagaacactctgctctgtgcttctcatgtcttaatgttggttcttaatgttaattcaaaccagctgtggcagacccagttgttcctagaagttgctatctctgtctttcacattctgcaattttatatgcacatacattctatgaaacttcatgaaatttctatgatatttgtgttttggagaatgctccttataactctgatttcatgcaaaaagttactgccacataaatggggaggtgatatcaattatgcagtactggattcaaacatcaactctgttacttactagttgggtgagcctggaaaaatctcttaacttttatgtccttcgctttcttgatctgcaaaatgaagatgcaaatgatcttggtttggagtcttctagtggtctacagtatatggatgcaacacttttagggtctgctccagttacagtaccaggttataaggattgtaccatcttgttttaaaaatgatatgaagttaaactctgaagcacttagaacaggtctagcacataataaacttttcgtatgcattagttactacgattaccataaaaatctcaagaaaatattaattctctgcttcggatattggacagaactctaattaaatctgatatatgcctaccgtgggaagctcactttttttctgcattgctagagcaataaatacaatcaaatgttaaaaaaatcatcaaccaaccaaccaatcaacaaaaaaaccaatccagattctaaagcaggagaatggcaatcatattcaccactaacacaaatttcacaaaacacaagcttatatcaaagagtcaattcaaacttccaatttaatactctcccttcaggaagtgctcattactcttacagccttcaaaagacagaaactccccacctgaccatggtctttgtcaatgtttttggaagctaaatgaaataatatgttttagaatgaaatagggggtgacaaatatccccctctgcaatttttcattgattcctaccaattgcagcatcttggattaagaagcattccttctatttgtcctgacatctggagaacaggccacagattttctcaggcctccatcctggagtttaacagctatcactatatggaaatccttcttagagataatctccactgatgcgatttacaacagttttcttcttagccactcttccatgctcatcctttgaatgacagccatgtatggacttgaacctcacagtcctctgtcgcacagggaagaatgccagtgatcttgaataagactcagtttttgtgttgctggaagaaggaacagtatctgggtatctgaggttggttttgtttcctttattttctcaacatctttgagctttgtttgaaatgcaaaacctaattttaaaaattctgctgttggatatatcatttgaaatgtagaaatactctgaaaaaataaacataattgaaatagctttcaactattaataattttaaaaatacatggtttcctttgtctcctctatggttttgaaatttaacaatgggatatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttacggatgtatcattggttgtaattataccattcacataaaaggtaaataatttcaagtaaaattagaatggtatttttgtaaatccttgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatatacccctaagtatatgcattttaattttccatgtcttgtcactgttatgataaaaaagaacaacagagtttgaaaactttcagtgattgtaattttctagttagaagtttattttgttacatggttctttctttgaatctcagctgtcttttgtaattagagtattcatcataacatgcatcaactatttatattttctcaataaatagtccttagcaaccaattttgtgccttggtctctttaaagacagtcatacaggtgtcatacccaccttttcctctagaatatattataacctgaataaatcctgggccttatctcaccaagtttcagggcagtgtaacattcaaagaaacaaccaaaagcaaatgaaactctaagttttgcttgcagtcctcagaacgcattaaaagagattcaatttacagatcctagccacatcgtctaaggttcccccaactccacttcctcactgtcacagcccatctggagcccttgttctccactgccgccttcccactactcgccaacactgtccacttttctttgcctcttgtattctgtttttctagtcctacctctttcttcgcattctcctgtttctgtatcacaggaacccaggagtcaagttggggtagacaaagaagagaagctgatcaggcaaagacaaaattatctttactgggaagtggaggccttgagggttcagagtgaggctgcaaatactcaggtagtaatatttttttgtaatattactgtcaccaaggcatttttacaaagaacaccaggatttaatgcagctattaaagttcttagtttactttgttgaactttccaaaagaggcaacctgtccacagttctgaaggctgtggcaatggagtgtgccctcagagaaacctcaggagataaaatcacagtcttcttctagaatgatcttataaccgctagaagggcaaaatacacttttaagagttggagtctattccatcttataaggatgggggatttattaggactctgtgccaagattttccagaatttctctctaggagtagctaaaggagggagctgtctgagaggggattgctggggacaatgaaacttgggtttgaatagcacttcatgtaagatggaaagaacatcatttctcacagcaaagtattaggggtggggatgggggtgggtgatcaagaatcaatgcagtgtcaaaacctcagccctccaatctactcctggaatttttacagagtgtgagatgtttgcagaccaggaggctttcttgcatttatgcctcaggaaatgggtcgttttataattcttgtggggttctttttgttgtgttgttttttgtttttaaaaaaatccctcttcctatacagaatcactattaacagtggtatgtgacttttcagacattgtatgtgcatacatccccacacacacctttatgttgttttttatttatttgtttttattttttaattttttttttttgagacaaagtcttgctctgttgcccaggctggagtgtagtggtgccatctcaggtcactgcaacctctgcctcctgggttccagcaattctcctgtctcagcaacccaagtagctggattacacaggcaagcgccaccacacccagcaaatttttgtatgttttgtagagacagggttttgccatgttggccaggctgatcttgaactcatggtctcaagtgatcggcccacctcagcctctgaaagtggtgagattacaggcgtgagccattgtgcctgaccatgttttaaacaaaaaaaaaaattgacgttatatttacactttaatctgaaatttgcttttttcaatttacagtttgtcatgaatatccatgtcagaatatttaaatgtaccattttttttttgagacagtatctcactctgttacccaggctggagggcagtggtgcaatctcggctcactgcaacctctgcctcctgggttcaagccattctcctgtctcatcttcccgagtagctgggattacaggtgcctgccaccacacctggctaatttttggtatttttagtagaaatggggtttctccatgttggccaggctggtatcgaactcctgacctcaggtgatccgcctgccttgacctcccaaagtgctgggattaaaggcacgagccactgcgcctggcctaaatgaaccatatttttttaaacagttattttattccgttataccatgatggaatcttgtacacaataattcccctattgttcaatatataggttgcttccaattttgcactatatatacaatactgcagtgaataccctgctatgtatatttttgacacacctgccttagtgtttctatactattgatttctaaacttgtagtttctaggtcaaagagtgtgctttcaaatttttaattgctgatgctacaaccccccgtcttccccaaagttaaaaaccctttgtcccaaaagtcaggggacttaatctggattctgtcgctgtttagttattcatgttgggcaagctgcttcttcacatctctgtgaaatgaggaaagtggaacagaagatgacctctgtgttccaatgtcccatgagcctttacctttacaaattgatttgcccaatttcagagaattatttagggctgtttcaaaccaatatgaaaatctgctctttaaaagattgttgagagcggagctaattttttttctgattaagctttgattagtaaacaaatccattaacctcctataggattattttgacatattcaagctgtgactttttctttcacagttttttgaaagctgagagccaccactgagcaaactctcatttaggccagattttgttttattttgtccagttcgaatcagtttgatggctgtgtgtttatgcatgatcttaaatgttccccagtactgggacagggcacatttgacctgttggccgatgaacagatttggttttaatcaagttccaagtcagataacagcactcatgtgatagtgatctttcactttaaggccatgttttgttcactgaaccttgtaaaaatcaaatacataaataaaatgaagaggtcaggaaagatggtttggtttctttcaacctactgctttttgaaggctcagggccaaaagaaaaggaaagtagaatgatagggattttgttatttactatacttaactgaataagtctgcagatgtctggaactatcctgtataaaacatcctattcaccagttcctaagagaccctcaaagagacaattcgagtttaacgcataaaatatcaaagtgggccagacgcagtggctcacgcctataatcccagcactttgggaggcagaggcagatggatcacttgaggttaggagtttgagaccagcctggccaacatggtgaaaccctgtctctactaaaaatacaaaaattagctgtgcatggtggtgggtgcctgtaacccgagctacttgggaggctgagccaggaaaatggcttgaacccaagaggcagaggttgcagtgagccaagattgtgccactgcagtccagcctgggcaacagagtgagactccgtctcaaaaaaaaaaaaaaaaaaaagaaaaagaaaaaaagaaaaaaatgtcaaagtgaagatttgaaatctgttcacagcaatacagatatggttgagaattttgcattgatagggtactttgaggtccactctgcaaaatattatttgtaaattattttgtttgctagttagccaaaggtgtgaaacctggtgttaaaattgtgatcttggcttggtgcggtggctcacgcttctaatcccaatactttgggaggccgaggcaagtggatcacccgaggtcaggagtttgagaccagcctggacaacatgacaaaacccatctctactaaaaacacaaagtttggctgggtgtgctggcaggcgcctgtaatcccagctactcaggaggctgaggcagaagaatcgcttgaacctgggagtcggagatcgcaccactgcgctccagactgagagacagcaagactccatctcaaaaaaaaaaaaatggtgatctctctgtgatgtagggtcctgactagagtgactactgcacaccacatataaattattcctacttatagttaaggtgccaaagactggtgttaatttgatttttaaataaattggaattaattaaaaattatcttaaagtcactcggaaacacttgcatcctaagtgggagagaaagtgatggccattctcctgataagtcctgcctgcctccaggcctttgctcaagctgtttcctctactaggagtgctgttctcacagctggttcctattcttcctccagttcttgggttctgtgccacccacttagagaggcctcccttgagcacactacctaaggagagcccctcccttttattctttatctcagtctcttgtttcctttatagcccatgcacatttaattttattaattttctgcatgtgtttagtttttagaattttaacagctttattgagatataattcacacaccatacagtttgcacatttaaaatatacaatttaatagtttttagtttattcacagatacatgcaaccatcatcataatggttggcaattttcatcgggtaaaaaagaaatcctgtaccctttagctatcaccccatcatacatccatcacctctccatccctaagcaaccacaaatctacttcctgtctctgtagatttcccttttccagactttcatatgaataaaatcatatactatgaggtcttttgtatctggtttctttaacttagcctcatgtttttaatgttcatcagtgttgtagcatgtatcagaactttatccctttttatggcttaataatatttcaccatatggttatagtgtgttttgtttatccatttgtccattgatggacatttgggttgtttatattttttgtctattatgaataatgctgctttaagaatttgtgtacaagtttttatgtgaacatgtgttttcttttctctgtatcctgtatctaaaagtgggcttgctgagttgcttatatatatttttggatgtctcatttactacagtagaaactccataagaacagggaccacatctgccttgtcactcttactgccacagtacctggcattctaccttacaaagtaggtgatttgttagtaacttggtgaacttttcggtaaactaacatgcattgcacctaccagacatctggcatggtgctggatgcctatattagatatggcctgaaggagttactgtgccagaaatgtcagccccagcaccaacatcctcacacttactaagggaactaacccggagacccacctgcctatttcacaccacataacttagctcccacagcaagacttcacccttgagccataacagattagcccaaaggtgggcaaccagcacaaatgtagcctattacaaactggtcagtgtcctttgaggtacagcaaaaagctctacccaaacagggaattaccaagcctatcatgtcttgtttttaataatcctgaacctagtaatttgaatatataagaagtaggtaagacttagtgggagtagtttacaggtcattggcggagggaagctggtaggtcaagatgatcgtggaagttatacacaaccagaatgatgagaaagcaggacccggaagataaaaaatgtacttatagaatgaagacgagcagccagagagaaggagtatctgggtcaaggtgatgacaagccaatgacaaactgtatacactccttagttctgaacaacatgaggctttttctctttctgagacctggttgtttagcatttcctgtatgtctttgaaggcttggcctcatgattgaaatttctgtgtcctcactgccaagtgtatttgtaccaaccacttcatctcacaaaatcctgccctgttattcaaggttacttgagttgaggcttttttccttgcaaccaggaaagctgatttttaaaattcgatattaactacattttacagaagatgaaaccagagctcaaggtcatgttttagtaaagtgaaggttgtggaattcagaaccagatttatctgactccaaggtccaagctttttaccctctaccatccacccagatgtatttcctgactcattcaggagtttaactttaattgtgatagcaatattctcccatcagctaagtgaaccagcttggaaataagtgtattaatgaatttcttcactaaaatttaaaaatgcctttgtatttatgcatagctaactcctgagtttccattattgataataattaagaactggtttgtatatgaaaatgtgtttgtagcatacatttggcttcattatctccatcagttcacatcactttgaaattaaaatcaaatgagatcatgacacatacctgtcagtgacatgcaaattaaaaattcttggcaacatagattaatgatcatttttgagatttttctctcttttattaattttctcctcttgttttattacatctgggtacttattgaaggaagagactctgatagaggatattgttagtggagaaaaggaagcttggcaactttcgtgaaatggtgtgccttaaagaggaaggaatttacagtaaagcctcagggagcccaatgcttaggcaacagtctacaagttggtgaatatctctttcagattggtgttgtgctttacacgatactgtattacaaagctgctaaacaacaaatggtttttctacagataggggatctctaggcatctcaaggataggaatcaatttttcaaagggacacacacactcacacacacacacacacacacactctcacacattttacccacacatgcatatactgtatatacacacccacaatactttgtagaaatgctgccagtatctctctagactaaaagtagtaaacattctctgcagttttatttttgaattatgttgctaacctttaaaaatggggatatttcatataaaaatccaagttgttgtggtattattgaaaaattgcagttctggcagtactgggcctacatttccctatagcaatatttgtctgaagctgagtggaggctgtttctaacagccacacaggctgtctagttcatcattgtccccataattctctgttgtcacatatccagctggctgctttaccacacatcacgtgcttggctcatggagacatttactctctgattaggaacccagagttcctggccaggcgaggtggctcatgcctgtaatcccagcactgtgggaggctgaggtgggtggatcgcctgagctcgggagttcagaaccaacttgggcaacatggcgaaaccctgtctctactaaaaacacaaaaaattagctgagcgtggtggcacacacctgtagtcccagctactcgggaggctgaggcaggacaatcgcttgaacccaggaggcagaggttgcagtgagccgagatcgcaccactgcactccagcctgggcgacagagggagactctgtcaaaaaaaaaaaaaaaaaaaaaaaaaaagatagaatctgagcggttgaaggtaatctgtagctgtttgaacatattttgagacatgactgtcaacctcagatgtgtatcaacatttcctgtggagctttccaaaaatctaccttttatctcccacttcccagctcccctttcagattcattaggtctacagtggagtcagggaatctgaatgttgaaaaagcttcccatttagttctgattttgagtaagatggagtaagcacacttcatccacggtcttccccattgtatgtggctataaagtctagacaagatgtacgaaacaagctatttgaggactctgaaaaagtaaataatagtagatagattggagaagaccagaatttaagacaccagtgaactgatgatgagtttctcttttgtctgtccagtattcttccacttgaacccaacatagcctgcaacctggaagcaggcatgaatgcagacaggaaagtcctctagttctgtttcgaggaacttaacagtcagagagagtctctgtgtgtatgttgggggaggagggagagattcctcatttttcattttgtttttttccctttctcttctttactctctgtgccatagctcccaaacaatccaagatggccaaaaagagcctaaaacttggagggaggaaagccttcattgccacttggagaagtggtggtcccaacagactagggagaaacactgttgcctcttttttcttctgttttcctactcattaaccccatttctttcaaaacgtgggtagactgagcatggtggctcatgcctgaagtcccaacactttgggaggctgatgtgggaggattacttgagcccaggagttcaaggccagcctaggcaacaaagtgagaccctgtctctgcaagaaaactgaaaaaattagccaggcatggtggcaaacacctgtgatcccagctacttgggaggctgtgttgggaggatttcttgaacacaggagggacaaggctgcagtgaactgtgttcatgccactgcactctagcctgggcaacagggcaagatgctgtttcaatatataaatatatatatatctttataagtctgcttatatatataaatatatataatataatatataaatatatattatatatgtaaaatatatatatattcactctgttctgccatatactctccatgtctgcccatatatatgagtgtatatatataacatatatatatatgacagctgtttctcagaagatgatcaaacagctacagattacccacaacagctcagagtctaccccagctcattctaatattttatataaaatattagacatgaacatatatatacatatatacacatgtgtatatataatacacatgcacacatatatatatatatacacacacacatatatatatataaatattagacatggaacgtgtatggcagaacagagtaaataaagccccaactttatttctggtcagagaaccaaaaagagtcccagggaagctgaaaattatcagggatatcaagaaagagggtgaagttagggaaaatgacttttaaagttttgtagaaactcctgggctcacctctgatctgggcatgaatagatctgaccctcaacagtatatacaaaacttgagaactaaactgcactgcaaagtctttgaaaactgaaatcatgttgggtcagtttaccaaaaagatccaacggtcctaaatgtatatgctcctattaggataattttaaagtacataagcaaaaatggacagaatggaaaagagaaatagacaaatccataattatagttgaagacatcaacagtcttctgtgagaaactgacagaacagacagaaacagatagatctgatggaaaatcagtaagagaaggaagtactgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaaacaatatgcttctaaataatccatcaaagaaaaagtttcaagggttattgtagatgtcctttatttggctgaagaagttaccttttattcctagtttgaatggatgttgaaattttgtcaaatgattctttgaactaaattaaagatattttaaattaaattaaaatgaaaatacatcaaaatttgtaggatgcaggtaaaacattgcttaggagggaaattctttaatataagcattaagagcttatatttataagagaaaggtttcacatcaataaactatgcttctactttaataatgtagagaaaagagaataaataaacccaaggaaggaatggataaagataaaagtagaaatcaatgataatgaaaacaggaaaacaatttaaaacaccaatagaaacaaaagctggttctttggaaaagtaaataaaattgataaacctttagcaagaccaacaaagatgaaaagagagaagacacaaattataaacatcaggagtaagaatactactatagaccctttagactttaaaataatactaagaggacactacagacaactcttcatgaataaattcaacaacttagatgaaatgggccaattccttgaaaaatacaaattatcaacactcacccaacatgaagtaatttgaatatttccatgactattaaagaaattgacttcatagtttaaaaccttccaaaaaatcctagtgcaaataaatatattggtgaattattgcaaacattaaaaaaattctaaataatatcttccagaaaaaggaagaagatggaaaatccccaacacattttatgaggctagcattacctgacactaaaactagacaaagatagaatttttaaaaaagaaaaatataaactgatattccataaatatagatgtaaaaatcattaacaaaatattaacacaatatatctagcagtatataaaaagaaaagtcagtgggatttactgggaaagtgaggctgttttaatatttaaaaatcaatcaatacaatctactttattagcagtttaaggagaaagaccacatgattacatcaattgaggcacaagatcatttgacaaaatttcaacatccattcaaactaggaataaaaggtaacttcttcaaacaaataaagagcatctacaataaccctacagctaaaatcatatttaatagtaaaagactgaacacctttcccctaagatcaggaacaagacaaggatatccactttcaccactgttattcaatattgcactagcagacccagccaatgcaataaggcaagaaaaggaattaaaaggcatatagggtgaaaaggaaaaaaaatatggattctattcataaataacgtaattgtctacatagaaaatccaaagtaatacacacacaaaggtcagaggatacaaaatcaatactcagaagtcaattttatttttatatactatcagtgttcaattggaaactgaattgaaaaaagcaatactatttagattgctcaaaaattaaatacttagctgtaaatttattaaaatgcatacatgatcgatatgctgaaaactacaaaacattaatgaaaaaaagtctaagaatacctagaaggagagacatacaatgttcatgatcaacatagtaaagatgtcatttatttataaattgatttatagattaatacaattccaataaaaatttccacaggatattgatagatataaacaaactggttctaaatttatattgaaaggcaaaggaactagaagaggcagaacaattttcaaaaacaagaaagctacaggaatcacactttatttttttctttttttttgagacagagttttgctcttgttgctggggctggagtgcaatggcaccgtgttggatcactgcaacctccacctcccaggttcaagtgatcctcctgcctcagcaggagccaccaccatgcccagctaatttttgtatttttaatagagatggggtttcaccatgttggccaggctggtcttgaactcctgacctcaggtgatctgtccaccctggcctcccaaagtgctgggagtaatcacactttctaattaacagaaagcaatgtgttattagcaaaggcagagataatgaagcagaatagagagtccagaaatacacctaaataaatgtggctgactgatttttgacaatggtgctaaagcaattcatatgagaaggtataatcttttcaacatatttaaagagttaaaacagttaacccaattaaaattatataaaatgttttaacagatacttcaccagagaggatatatggatgtcaaataagaacacgaaaatgtgttcaacatcattaaccattagaagatgcaaataaaactgtgatgagatactgctacataacaattagaattgctaaaataaaaattactgctaataccttagtgttgatgaggatgcatatcatctagagctgtcatatagtactgatggaaatgccaaatgggccactctggaaagcagtttgtcaattgcttataaaactaaacagatgcttaccatatgaccctgtactcccactcttattctatagctacagaattaaaactgtacacaaatatttatagcagctctattcataatagcccccaaaatggaaacaactcaaagtccttcaacaggtgaataataaactgtgatatttctatacaatggaatactactcagcaattaaacagaagtactgatacacacaacttggatgcatgtcaaatgattttgctgaatgaaaggagcccaactcaaaatgtcacgtactgtatcatcccatttgtattatgctcaaaaagacaaaattatggagacaaaaacaaagcagtagctgccaggggctaggggtggagggaggtgtgtgacttcatgagggagtttctgtggttgatggaaatgttatgtttcctgattgttgtgctagttccatagatctacacatgtcaaaatttataaaacagaacacagcaaaaagtcaatttcactgtaggttaatttaaaaccttaaaatatatttcaaagcttccctcttaatcctaatgtgctgtgcagcttgcgtaccacttctctggagcaactaccaatgctagacctctttatcaactctcctccaaaaagttagaacttattttggagaatcacagtaaagggcaagtaacttgcagcagaagatagacggtcatttcaaagcaagagcagtagagagtctgagagtcctttgttctgccaagtcaaacagaaaacataaatatttgtatagctttgtaacaaaagagcaatatgggttttggcagaaagacctcttaatcgcatttaagactttaaagtaatggagccctgctcctattatgtggaaattgcatgcagatgtagtgtacatcagggatcagggtcctgtctgagggagacaatgttaaaggtaaaacccagactgacaaggagggcaatctgtctacttgtgcagatatggtggagcccatttgctttttggcactggatcttgaggagattgcatgtgctacttagaagagtctctctctttctttctttcttttttttttttttttggatcactttgcagttgtgagttcatgactttctattttcagttgcacagatagccttttagttcaaggatggggtgttttgggatcaaagacagaaatattgagctatttggaataagtagagtggtgggcattgagggagactgggatttccagtactgcctcatccccacccatccaactgcaagtctcacatcctctctgcttccaaaagggagatatttgaccctaacttctctttccataggattcagtcaaatgctagtgcatatggttatgatataaggaaatgggtcaagtagaattattggggtgctagaagcaagaccaattttagattacttaaaaggaatgcaatggaaggataaggagtaacccagaatcaatgaaaaagctggtctcaaaaataataggaacctaggtggtaggaattatgtatgggcaatctctccagagaattatcttccagatcaaggaagaaatgacatacatttcccccattctcacttcactcaagattcagcattttcttagtatgagttgagtcgcatgcccactctttggccaggcaagaggagatcaccttgagtgacatacactggggaggggaaaagttctacaaaagtaaaccagtggtctcttgtcttcagcaggggttgggtatttgaaaggcagaaacaacagctttcagatcaccatggtgggttattctacattttaaactaaacacccctggagggtgtacagataagcaaagaaggggtacaggaaggagtggaaaaggtggtgggtattatggcagaaagagcaatagttttggaactagacctggaccagaactcccacagggattggccttcagctggcattacgaccccagggcaagtcagttactctgcctggagctttgctttcttcatctaaagactgaagaggctgaactagctgtcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaacgttgtcaggtaattccaatgcaggtgatcaaagctaaagacctgcacaccatctgtttgattcccagtccctagaaggaaaccccatccattggagctgcaagcacttagaaaatgtttaaagttgaacaactggacataccctttgaaagctccctcctaggctccctagatagtgtgaggatgcttggaatacagcagacaccagggtagccaggggctccaccgcctgcatattgggacacaacgtggagatcttgcattctctccttacacttgctcactcactctgactcaagtgtagccattcaataaacccaaagggtagagagtctgctgtgagtaccttgtgagttttccttattgttctgatcgtatgaagaccttaaatagaaccttttcaaattctatgtatttgggctcagcagtgcctgctttagtaaatttctggttgtaagaagtttaacctccaggctaaacatttacactaaacacctctcatttggggagttacactgaagggagtgttgtccattgttttcttacgtgtagttatttgtgctctaccatgtatctggggatctccaagtgccttttaaaagtaatcagtttcgcatcaaggtgttccttacagacatgtggtttacaaatggtgaaggaatattttttatgtgtataaaatgcctgagtctttccctgtccactaccttgtatgatgctccattaaaatgtagcatggatgccaagagttccttggctttttgaggcaagatagaagagattggtcatttggcccagtatgtccttccaaatatatccagaggcctgaccaaatgaaagtgaattataacaagggtgaaagtaatttaaataatgtcacaacttatactcagttacatccaaggaaaccagttgtgtattaaaaccaataaatagtaatttaaaaagtaataattcaaggaggacattaccacaatgtttgaaataactatgcatattatatggtttacaatgtgcaacacactttcccatacattctcatttcatacaccctcttgtcttcgttgcgtccaaccttaggatagagagtgaatagggaaacttggtctatagcctctaacaacatgggcaaggcccattagggagaagaactctttgtagaggactgatcccctatttctttctgtgttctgtttaaaatgaaattgttgtctctgttcagaagcctgattggttgtgtacgtgctgtgcgtgtctctgtgtgtatatgtgtttaatggggaaacgaaggctaggaaaggagggagataaatttatgaaggatgaagtctacaggtttttattcttgctttatttttcactttctctaatactggggtggagaagctctgcatatactttggcttcatgaaatgttgacattcgagagaggaataaaagtgtttattctctagagttaaaaagaaactcaactcatcaagtgtgtgttctgttccacttggtcttataagtcatttgccagcaagatgagctttatatcgtctctctggtaaaacatcctcccatctcctgatcggcattcctccactcttttgcttcataaattagaagggaggatgccattgtaatacttgaccttataagggggaagagtggcccagccgttccttagctctgccctcctgtcagaactgtatacactctggaggccttttaagggaacgtggtgcgtgcagggaaaacatcccaaggcagaccatccattttctttgctactgcagagttggtgcctgcaagctctgtgtgactctgaagcataaatcataaggggttgctggtgccaagccggagggagggacatgtctgaggatcatgctcactgccaaatgcagccgacctcttagttttcactaaaatcccatctcaccactggccttctgacttttagtgaaaatttcacaagttgcacatcctgacattacttgtacttgcctccctgttgtgaattataatgatggctgcagagaagcaaccactgcctccttaaggtttcagtttatccttcctgcgctgtaccattcacttctgtacagtgaggctcgagtttggagagagagagagagagagctggctttgaaccacagggcttttttgtactagctctgaggccttggacaagtcatataacctctctgagtctcaatatcctctattaagaatggggaggataaaggtgataacatccttttatagtgtttagcacaatgcctaacacatagtaaatgctgaaatgttagctgttattattattattattactactagaagaaggctatagttttggtgtttgcagcaagtatttcctacagttccactatttcaatccagcacgctttttataaacaattttttataggcaaaacatatccagaaatacccatagaggtccctaagaacatcttggcatgattcagtgtacagagaatgggttctggaattggacaggacagggcctgactccctgcccggccacttaccagttcatagctttggacaaactatttaatctcttggtaattcagttttccagttagtagtctgaggatactggttgtttaaatacaggcatttgggttgccaggggcagaaacaaattaaattggagcaaagaaaaagaaagggtttgttgcaaacctatagaaatttcactgaaataaactatggtttattttacaagatggggaagagggaagaggaaaaggggctttgaggggaggaggggcttctacttgtaggcaaataggttgtcttctccagtagcttctaatcctagactcacttccttctttgaaatccacctttttgaagtatatttcccagtaaacaaaagtctgcaggagaggctaaaaatcacagaaatgtgacagtatgtgtcctccaaaggtatgaaccctctgttctgggacaggtctagcagtagcaacgctcttcccagggcacccaggtagccgagtcacccagggaggggttgtttggggagacacttagggaaggctgcgtgtagcctctcttgagacccctgcaccttcatgcacagcctgttcccacttagaggcttccacccagcacccaagagtcatgctaatttcattaacaaacctgcattaaccaggacctctcttctcttctcagttagctcaggggttctcaaactctttttctgtgtgcagccaaagtccacttgcagcaggagcaccacttgctacctgcagtgattttcaaagcagctggggctctgtatattagaatctcttcactcctgagtttttgataatccttcttacgcccattggaatatagtccagagatcattgttcaatcaataggcacccctcaagccctgttcattgccagaccctgaactgagttgatattcagagaaagacacagcccttgtcctcctgaagctgctggagatgcatgcaggggacagcatagtgtgaaaggtgttgtggcagaaatgctctaggtgctatgggacagcagattgtgggctgattgtgtctctctggggaaccccaggaggggcctctcattctagacttcttcacccacttgggctactatagtaaattaccatagactgagtggcttataaacaacagaaatgcatttctcacagttctggaggctgggaagtccaagatcaaggacccagcagattcagtgtgttgcaagggcctgcttcctggttcatagatggctgtctttttgctgtatcctcatgtggcagaagggtcgagggagctctctggagtctctaatgtaagggcactaatcccatttatgagggcttcaccttcatgaactaatcacctcccaaagcctacctcctaataatatcacgttgggggttaagatttaacatatgaatttggagtggacacagacctttagtctatagccctggggctctagctttgcttcccagaagctgagactgaaaggacaattaagactcagctagccgaagtgagggaagcagcatcaccaagccctggagggcaaaaagaatggcttgtctgggaattgcaagcctttggagtccctggaaagtaaaattgaggagtatttcctcaagagaggagagattcttttcctcaaggtgaacttcagctatgggtgccctctgatggggaccccatggtcagagagctttcaactcacacaggcaccttcccctacccaaggtaaggatttctgcctgttaagtgatagctgcatttatggagtgtttatcatgtgtcgcaactgcccccatctctgcctatgagcacgtgaaggcttgtagaaaagcagtgacttacccaagtccccaaagctagtgaaaggtgggcatcaggatttgaacccaggtttgtctacccaaggagccagagcttgtttcactctactgcacagcctctttaatcttagatgcaggaactgaggataagagaggataaatgactggcttacaagtgtcgcagaattaatagtgtaagagtgcaacttcaaaccccagtctgtcagattttaaatccagtgagatgcttacagctatgggggtagggtggggaggacaattgctttgcttacatttaagagagatgtccaggggaggcaagagttggacctcagcctgctggggtttgaccagtatagtcagcatgctcacatggtagactctcataccagcaccaatgttcaatgtcagttcaagtgtgaaccccttttgaggacctcttaaacactgtatgatacatgaatcaaaattcagctattaaaattgtgaatagagatatacaattgcatatgttaattgatcattgtcatttgtgtacagtttgtcttaactattttaaacttgcctaaaaacaagaatctctagaaataaaaaataaaaacaaaaacaaaaacaaaacaaacaaaaaaaccactgcttttaagtactgacacctgggctctaaccaagacctgtaacccagaatattctagcaaagaggcccaggaattcacatttttaattagcaccccaggtggttcttattatcaagaaagtgtaaaaaactttaacctcttccgaaggtgaatgatcaagtacctccagctcccccaactcagaatgttttacagcttgccaaaaagagggggaaacactgtccaagcttgtttgctaggttaggcctttaaggccactatctgggaattccatatgtgtaatcatactgtaagtttaataaaagtttacatcatatgaagtaaatttgccacttttatttggattggatatgcacatttggtttcatgaggggggaaaaatccactgtcatatttcatccagctagaaaatatgttataagtgaaggatcatttctcttttctgactcttggaacattgtttcaagattttcagagaaactcagtcaatagcttagtgctgggttagtgtgctgggattgcatgtgtctgtatctcatattcgaaatctgcataattaactgcattggaaattgacagagaaaatgtgagctgactgagagaattctgggatggaatgttcggaaataaatttgtagaaccttatgaaagcaaaaacaagatatgcagaatattgtaggaatggtggaggattcttcctgaaaccttattgtgcgagaaataacctaaggtcctgctgagttaaactatccttctgtgtccccaaaatacacagccacctacccacttgaacatccatacacaaacacatacaagcatacacacacatacacacatgcattttatccctcattggcactttcaaccccttgcctaggactgttgatattcatgaacccacttaaagacctgaaaacaattataagctccaaaatgaagacatccgcaatgccaacacgattaactgcgtaattgaatatgtataaaataccacatgttgtcactttattcttaaatttaatattcaagaaatcactataacactttagaataatttgtaggatatattttcttcttttgaaaggtttccagagtgtgcgtgagcaatatcattgccaatagttaattaaatgagtgacttgtagcctcgtcatttcaaaagcaaaattataaaaattctttcaagttcttttggagcaaaagtagatttttatgtgagatgtggacatattttaatatttttggtatgatatgggatggggcctcataaacacacattcagagagtttaccaccaccgaatgcttttgcacagggcacacaattggaaaaaataaaatatgccattcaaagttgggtctttaacagctcaaagatggtgaaaggctttcagggcctctctccattgtgtgactgtctctgaagggtgtagtctacttcctgctacaccagaattgtccttagggaacttgaggacagtagattctactctgcctgaattcaggtgaggccaatggtgagctgctgcatccagttgcataggatgtgcactgtgtaagggcaccacataccaagggggcattattcccattgcaaacaccctacacttgaatatttattatgacagcgcttcagcagatggcattaaagtgttctgttctgagaaactcagtgtgctacaatactttttaatagccataaattactggatcttgaagaagggatacctttagcacaaaaggcacagcttgggcttcagccctggcctgacagagagagaggtattcctcctgctccattcacctttatctccctccactgtaggctgtgggattttgacctaaagggactgctcaccaaccccctgccccaccacaagactgtgcccctgaagcagttccaagctcagaagccctggagtcttccattcctaccagccctttgcccttctaccaccagcaggcttgcttgttttctggcagttagtccctgaagtaaaagctccctgcccttctcttagtaggaagtttctcctaagcaccaagagcccctacacggaatggaaccacgcagaccaacgtggcccttgcctcagtctccagagaaggggggagggtcagttaagtggccttctcatctccctggggagtctctgcttctccagttgatctcaggaacttcctgttctcaccaacctattttggtctctgtctcccatagacgactagaacctctgagagaggatcggtctcagtgcaggtagcactgcacgggtgatcctgaatgcaaacagctgctgttcccatctccttcctcttcccctaccacatcctctggatctgaaccccagaacaagactgctcaggggaacagagaacatgtcactcagataccaaacagacgtactgtcagccacattcactagccatgccttcagctgtccccactaggctagtcccagagtggatgctaaggcagggctgcccttccctgctgagttcagagcttagtgcaaactaggacctggaggaggggtatctctgcttccaaggcatcaccttccaacatctcctttctcaaggctctttggacaagacatcttgctgggaatccttgatgtgagttaaaagcatttaacatagtccttcttctcccttgctcttcaaaagtgttcagtaggagtaaattcccttggaccccaccactatcatagtcctatgaagaaaatattggttggtaaatcttagccagcattttcccatgtgtgctgaatgaaaccaccaactccacaaggtgctctgtgtaaatgtgagaaatgtatactctaccctctttgtgaagttttacaatgaaatgagcatttggttttgaaatatcctgccaaagtagagagtccacttttaccatagtctcttaccttttcataataaatttatagcactggacttggtaaattaacatataaggttattaaccttttcagccaaccctttgtatgtaattcctttggaaattcatccaccatcgcttaattttatcttaaactttctggtttggttttgttttttgagacagggtcttgctgctgcccaggctggagtacagtggcataattatagctaactgcagccttgaactcctgggctcaagcaatcctcccatctcagcctcccaagtagatgagactacaggtgcacaccaccacagctggctaattttagtattttttctttttttgagccaggagttttgcctagggtggtctcaaactcctgggctcaagctatcccccctccttggcctcccaaagtgttgggattacaggggtgaacatgctgtaatctccctccttatctcaaactttcaatcatcccatgtatttgcttccactggtattttaagaccaagttctggaagcacctttatattaatgtaggaggagtccatgttctgatgggccccatgaagtttgcatgaaatgagcaagtgtctttaagcacttaccttcaagagactaacggattagagaaggagttaggtgtcccagcatctaaggcaatatcctgtgctgagtgtctaactcctggggtttgcagtggcagtacaaagagaggactggccagataaacctggaaagtaaggaagcggcctaagtccaggagggggtggatgaagagtgtactggtgtctttcattttccttcaagacctccactccatctctttctctctgctccccgtcctgtagactgacctatagggactatcaagagatccccacccttccctccagattttagttgggcttgggcaattgggagcactgcagttactagacagaaggaggagaatgcaagcagggatttctttctctccctataggatttccataggctggaaacatgactcttctgaaggtcaaggttcctgccaagcagccctatccacacagatctgtccctggatttcagtaatgaatctagggatgggacgctggtagccctgatgttacttgccctctccactagccacacctgtgtaaacagttcctgtattaaactctcaaactactcagttttgagtgtgccatcaattctgttggggacctcattgatacaaggagtatccctacctaagtgaacgatgtgtgcaaagaactgaagtggcctggtgcttgaagggggctccatctcaaaaatagtttgttatggcaggatgatgccgcagtaggagagttcatgaggccgatcactcttgccgatgcccacggagtgctctggggatccagggctcccaggcctcatcgcatttagtccccactgagtaaggagacatattatcattccattttgtaggtaaaagatccaggcttatggaggttaagtaacttggccaaggttgcactgcaagaaggggtggagctgcgtggggactgagagtccctactctcctccgtgctaagacattaaactggattccacaggcagcgcatgtttgcctgcctttcctgctcactcagccttagcttttgctgtaaaactctcacgtcccacaaaagaacattgacctttccaatattccctttcctcgtaactatgtgtcattaaactgaagtgtttctttaaaagacattagagcagaattagtatggcatgacctttccttatgcttcctgataaaattaaactcaaacctgggtgaccgaaggaaaccctgggaaggtaaatgcagtcttgaagatggttcctttcaggcagggtggctgcctgtgcatcccttgatatatgctcgtcttctcggaaccatgcagagagagctgcctgtgacctgatttggcttcataggaaacagcaacctgcgtcatccattgggtcacagatcagagttacacgatgaaatgaaacaggtggaatgtggtgttcaatccatggtattctgaacccaccatggacagctgacactcacattcccaaagggaatgcaaagttttgcatgttgccctgctcagggcatctccgcctggaatcggtagagttttggccctgagagatattaatctattgtccaaaaaacaggaactccctaaagagagccaaaaataagaaccatacccaggactgatgaattcttttctgtgatattggtggacaggttagcaggagaaaaggaaggggaaatgttcatagtacacaaagtataagcatcatctcttagttaaaaaaaaaaaaaaacaggaaaggttttgagttctattcatgtaaataaaaggcactaagaatcttgggaaatgtccaggctaattaattacagttggcttcaggagcatgcacagacttgccttctgccatcagaggcatagttatcggggagggtagatcttccaagttcctccacagccctggtggcattggtgggttctggctgcttctctgagccaggtggtggtgtgtctcttcatttagtctcattaattcttcagtgttgcaaatatctgaaacctgttattaaagagctggaacgatatcccactaggttttcaatatggactattgatgaagaaacagtaattggaatagcaggggtctgagataatattgcaagacaaaagaacatacaatttcttttttgtggctcttttgcattctataatttggtggccttcgactatggctgtttgtcgctgtagaaataaactacagcttgtctagtgcctttctgatggataataggttgcttctgatttagctctatttctctttcacatatagtgtggtaataaacatccttgaacctcatcttcttgtgcgcgtgtgttcaagtttctctaggaaagataccagagaggggtttgctggattatagggcatgatcaagtctactaggaattctcaaacaactctgagtgtaaagtgagtgtaccaacttataatcttgctgtctttttttttcttttctgttttcccatgatacttcaccaacatttggtattagattttttctttttttttctttttttttgggggtgggggggtggcaggagggacagagtctcgctgtgtcacccaggctgaagtgcagtggcgagatcttggctcactgcaatctccgcctcccaggttcacaccattctcctgcttcagcctcccgagtagctgggactacaggtgcctgccaccacgcctggctaatttttttttttttttgtatttttagtagagatggggtttcaccccatcagccaggatggtctcgatctcctgacgtcatgagccgcccgccttggcctcccaaagtgctgggattacatgcaagagcactgtgccctgtccttttttttttttttttttttccttgaaacagaatattactctgtcacccaggctggagtacaatggtgcaatctcggctcactgcagcctccacttcccgggttcaagtgattctcctgcctcaacctcccaagtagctaggattacaggagcccaccaccatgcctggctaattttttgtatttttagtagaaatggggttttgccatcttggccaggctggttttgaactcctgaactcaggtgatctaccctcctcggcctcccaaagtgctgtgattacaggcgtgagccactgtgcccagcctctttttttcttatttggctaatgtgatgcatgtgacatgatacctggctgttattttaattttcatttccctgatttactatatattttcatattggccaatcagtcttcttcttctgtgacttgcttaggtcatctgagtttttcttatcagtttgtaggacttcttcatttagattagccattaatcctttgattttatgcattgcaactatcttctctcaatctatggcttacttcttttttttagtgtctttgacaaatagaaattttataatttttaatgtgattacgtttatcaatctttttcttatatttagacccaacttatagaatattctgcccattctttattcccccctcatagaacatgggacagacagtgaggtccctgtggccttgctgaaacagaatccaatatgaaataccatagcaaggaacaggtatttgctttgggaacactgataatgccattgtatttcagtggatacccatgcctcacagaattactctgttactcatagagtagtgaagcagcattatacaaatactagtcttctctgttctttcttcttcttttagagtgagtatccatttatagttgctgtatattcatttaatgtccagtgcctagatgtgtcctttccctcatgtcttatgacatagattcaataagatttctataatactatctaagaaaacatgctaattggatatagaaaagagaacaaacaaaaatagtttaagagacataaaaagctttgttttacagaaatgctttatctcctgggttggagctgtcatgtcagtaattatcacttttagtttataggagtgaatgaactgattttaaatcttccaagagtattatataagtcgtttttttttaagcttcagtaagaggtctgtataacttggaaaatacaaagcaaagcaaaacaaaacaaacagataagaagatgattcatgtcttgctagtctgggaacaatctcatggaagcctgaaggatagctgacaattagctcttgactatctctcaacttagctggagcacttgagacttaaaattccccagccctagaccctcggcaatgtattttctttgaaaataaccagagccaggaacagcttacattaaagtgctcaagcatcaaggctgtaaacacagacagttgttaattccccagatgtaggggtccagattatttaacagttgaagagagtgaacctgtggtagtttcaattttacattttttttttcttggatctttggtcaatttcctaaagccaagtttttcttctttcaattaaagttaggattttcagaaatctgcctgcctatgttgcctaacaaaatttaagatctaactgggaagagtcctcttcttttccccatgacacctacctaaaatgaaagtggagaagcttctaggtaaagcggcaaaggcccatggggttggggtccacctttatttgttttataattggtcaaactctagaagtttagagatactatgagacatgcagttatcttttgctttttcttttaaatattctttaaatgatatatttagttccctttggtttaagtgaaatgtccagtactaagagcagtgataatatcgcaactctgtaggccattttgcaaaattatatactatcccatttgaacctcacaacctctctgataagacaggcaaggcaggggttatttaatatgtggattttgaagtttagaccaggctgaaataatggaggccccaggattgaatagcactgtgctaaaatttatatatatggttgaaaaacttttgtagttatcttattttgatagcctcatgttttatgttcattttattaatacctgaaagtgtgagttgttccatccaaaaaatgggtttaagagtagattttaagattgctattagaaaaccaggtttagctgaactctgcctcattcatatatgaaccaggtaggctttcttgaaaaggcttttaaagtgcaaactcatataagccttttaccatacagcagccccagccagcagtgctagacatcaaagaagggatctgggagtgaactcatcaatgtgaaaatattgaagagctaacttgagggctgttgtgtttaatgtctgttagacattaaccagcatatccaggatgctattaaactccatcttcagtagtttgtttcttgggattgtgtaaacatcactaattcaaacatgcacttagtcataaacactgcagagagctttttcttttaaatatacttttaattgaagtataatggacatacagaaaaggcacaactcataaatgtttacttcaaggaatttttcaccaaatgaacacacccgtgtaactaccatctggatcaagaaacagaatagcacctgaagcttccttgttccccattctgatcatttattctctctcctcctgagacgtaaccactattctgacttttcccatcaatgatgagttttgtctatttttgaatggtacataaatgaaatcatagagtgtatattcctctgggtctggcttattttactcaatgttatgagtatgacattcattcttgttgtttcatctaatggcaggcagttcatttttgttgttctatggtactcctttgtgtgaatacaccacattaaataaatacaccacagttggtactaatttgcatcccttcaacagtacattagggctccacatctttaccagcacttggccgtaccactctttccagctagtcttgtggatacatagtaatatttcactgtggttttaatttgcatttccctgatctctagtgatgttgcatttccctgatctctagtgatcttttcatatgctaattgttatttgaatatggtcttttgtaaagtgcctgttcaaaacttttgcctatttttttaaggttatctgcctttaaaaaaaactaatttataagagtttttaaaatataaactgcatgtaagtcctttgttagatatatacgatgcaaatatctttttctaatctgtgtatttgagggtcttaaaaggggtctgagagttcagtgtgtagaaaatagtaccatgggcccttcttggctcttaagaaagtggacatttgaagatagaggaatggaagagagacctggatcttgtgctctttaaatctatcacaactttcttgaagtaggattccaagagcagctggatatgcctcacacacttgatatgatcagtctgtgtttttttggctactctcttgcaaggtaaacagagccatcaatatatgatattctggtagactcttatcatacataatgatatagtgctttgggttaataaatatttgaatacctactatgagcaagcactggccaggacactggaggtgcaaaggtggatatgtcagcacccctgtgcttagtgagctttcagggcacttttaaggtacttttgtatctactatcctgtttgatcacataagggtagggtgaccatcagactggtcagataaaaataatgtatccttttgctcctcaaacctttgaggatcatttagtcactgcccctcattctgtaagaactgtctttctaagatatgcctttgccacatcctgatagcctcactaattcatacctggagaaattcttttttctcaaagtgactaatttagataaagcatgcagaaatgactttatattttaaagaaagctacaagagtcaaagaccataaaatagatttacttagtcccctgctatttaacagcccttttaacaactccttaaataatatttattagtcaactgaaatcatatagcatttattgagggcaagtctggagaggcactgttttattctagacattgaaggagccatgaagacatacaagatgcaattcctgcgctcatggaagttctagcacattggtggtggtgatagtgtttgtgtgtggagggaaagtgttcagtaagcacacagcatattcaagaacaatgtgaacataaagacccataccacggaagctccgcagcaggaagggtcacgttggattgatttcagtgatgaggaaaggactatactcattaagatagtgtcgctgctactataaaaatatccccaagatgtataaccactcaaacacataaaaaggtgttttcaatcccctaaagttaaaaacaggtgttcctgattcatagttgactctgttccaaatggtgattcagagatccaggtcctcccctctcgtgggtcagccgccttcaacacatggcttttaagattgctgggcttgtccacatcaagctggcagaaggagaaagaacatggaaaatggaaagatcttataaccagatctgaaagaggagttccattggctagaacttgagtttcattggctagaactcagtcacatggccacagctaatttcaagggaggttgagaactacagtccacctgtgtgtctgaaaagatgagatggattgttgaccacgtagcagtcgttgccacaggttttgttatggtctggatgtttttgtcactttcaatattcatgttggaacttcagtccctccaaaattcaggtgttgccaatgtgatagtattcagagatagggcctttaagaggtgttcaggccaggagggctccttcctcattaatggcattaagacccttataaaaaaagcctttacacagcatttggctagcttttcctgctgcctttgccatgtgcagcaagaaggccttcaccacaccagatgctggtgccttgatctcagacttcctaacctctagaactgtgggaaataaatttctattttttataaattatctagtatcagctatcccattataagagcacaaaatggaataacaggctttatgctggaaaagcatttaaggtaggtcttcaggcaacttgaagtattctgacagacgtgggaaaggaggattaatccaggaaaaatgaatagcataaagaaggactgggcagtatacaacaacaaaatttaagggcatatttggaaaataggaaatcattcatcttgttagcagcatagaatacatagggagtagtgtgggagaaactgttggaaagctaggttgatgcaatttccaacctacgtcacattttaggaggttttaaaattctgactaaagagttatatccagcatagttttcaggctccttctcactcgcaggaaaaaatgtggcccaggttacctttctttttttcccttcacactctggcctttcctaggaagtgagttctcatgtttatctccccgacacaatggcaagcagttagggagaagggttcagcccctcagcatgggcagcttcgttttcagcttttgtactagagaatttcagagattccaggggctttctgccaaaaacccatctaatgcatggtatctgctgaatgctgtgtttgggatgaatcccaagttcaggagagggaggagagagggaaattcctttttgaccctaggacacaattaactcatacccaggatcctggaatttgattacccatattgttattttggcttggatagctgcaactgtggctcatagttataaaagtatccggtcctttaaaatccagccgcagctttcagcttgatgacctcctgactgattaattggaaagggtgggagctggggaaatccttttccctcccttcagacctgccaacttggctttgaacctacaagaatgttttggtcagagaacatacatccccacaccccgtaccctccctctcaccctcacctctgccccatgttgcgcattttatttgttatccatatgcattcatctttgttgaattaactttgacccaggcttgactatgtgctgccccagaaggcttctgtgtgacttattctctcttccttgagtttctgatgatgaaattcatgttattctgaccttccatagccttctgaccatgaaaataatgttattataaaggtaaatgaaaatttacctttgctgtatagtttgtgggtggtttctttcattgttcctaccagaatgtaagcatgattctatatctttcttaaaccattgaaaaagagagaagacggaatatttgaagtaacagctgaccacctgaaaagtgcttttcaatgcaaactggaagaggcagcccacagtttttcagtcctgagcacattcattgtatttggggtttgtgaaaagggaggtgttcaccttcccatggcaagagtttctagatgttttttttttttttccttatttgaccacaaagccaacctaaaggaatcattactatgcggcgtattttatcctgtgtttgtctttcttcctcttctttctcaagaccctcattgatcccactctacggtcatcccctgcactcacagccttcaaataactaaatcttgctgttcgtaggcatttggtgtttttctctttcagttgctagctctggggaagatgaaactcttcaggccaatgtctgtggtaccagctcattccctagcctgctttgagatctacatccttcatgaagcactaagacatttgaagagacaggatggtgtaatggaatggaacatgaggagaaattaagcagatctgggtcccaattctagcactgccccttacctctgtgaaactttgaacaaaaacttgacttctctgagcctgaaacttgacagcattgataagttttcgctgttttttaattttatctaagtggaacaatacagtatatacacctttgttactgatttcttttacttaatacagatgctctttgacttaagatggcattgcatcctgataaacccatcttaagtcaaaaatattgttaagtcaaaaatgcatttaatgctggcaatacagcagacagtctctgacatatgacggttcaacttaagaattttgactttatgatggtgcaaaagtaatagccattcagtagaaaccacaaccccaccataagtcataggagctcctcaacttacgatgggattgtatctggataaaccaatcataaaggggaaaaattgtaagtcaaaccatcataagccagatcctgtctgggttatatttatgagattcattcaaattgttgcatgcggcaatagtttgcacaataggatttatggtattacattgtatatcacaaattatttgtccattctactttgatggacatttggattgtttcagttattacaaattgtgattctatgatcatacttgtaaaatcttatatatacaccctgttgagcaacattgcacactaggttccccaggaagcagctctaagagatatttgctttcaggaagtttattcctttctgcctttaagatcaaagttgcattcaagatcaaaacttataggggagtgaggaaggaggattgaacacagagaagttggattgaaatgcagtcacaacaaaggcctcagccaacttgtggggagctctggagctgaaatggccctctagagttgtgcaaaatttgggcaaggaggccaggcctttatatatccctttataccagtcattgcatgtggattaacccaggcatgggaacatgatttggggtgacacatttctctttggcagagaacaggggccacatctgcgagctgtcagcaatcagccttcctagtagctggtagaatgcatatttttatcctaaaatgtctaaagtgtgtgtgtgtgtgcacacgtgtgtctaaggggtagtaggtgagtgggtgggggtaaatctgagcagtgcatcacagttcatctttagtagatactgttaaacaatattcccaagtgtttatgcccaaataccctcttaatttagattctgatatccccacatggactctttccaaaaagataaagaaaaatgtatagaagtgaaacaaatgtaaaaaatattctgtatattaacttattattttctatatggtggagaaagcaaaattgagaaccattgaaatgggttgtttattattttctaacttatggcttgatatcctgaaatctgtcaacactacccaggttgttctgaaatctagctatggatttagtagatcctaaagacttcctactgtgctgagaaaaaaaaacagaaaatgaaatatatgaattgacttttctcaaatttcatttttcagagtggccaaatcaatgaaggtccctgtatatgagaccccagctggatggagattcttctcaaatctgatggactcaggacgttgcaatctgtgtggggaagagagctttggcactggtaggctttgttgggttgatattactggggagggcggctgcagccttttgtgatctcagtttggagatctgtgaactttctgtgaattacagaggaacagttaagtagaggcaaaaaatcagagaaacctagtagagtatgtgctgtgatatgcttacctcttttgtccattttgtttcttctttttagaaatttctctttctttaaaaatttctattatggaaatctttaaagtgtataagagtagagagaatatcgcattgaatccccatgttactgtcactcccatttcaaccaccataaacttgtgatcaatcttcctttatctctaccctcatccgcaggggaacactcctccctgattattgtgaagcaatcctctgtagctcattgttttatccgtaagcatttcaagatgaatctttaaatataagggctcttgttcagaaaaaccacataaccacagtaccattatcacacctaaaatgttaaaaacgttttctttttttacatactttaaatacttcatccagttgttttctggcttgcatcatgtccaagaagtcggatttaatttttatgtttattcctctatgtaaagtactctgtgtaaagtaccccccagtctcctgcctttggctgacttcaatattttttaatctttgattgtcaaaagtctaatcatattaataatgtgtctaggggtgtatgcatgtatgtatttaaccctatgtgggattctcttgaattcttggctctgttgtttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctgatgagcctgttgaaggaattcttcttctccgatactgtgtgttttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagtagatattcaggtcaattgtatttatgcctagaaatgggtacaacccttttttggggcaattagtgtggaaggttaagttaacctagtcaagcggtgatctgggtttgggttttactgtttctgttttaaccttcagtgtaccacaggcctcaaattcccccagcagtggcatatttttactgggtactggaactggggaagggtactggagaggtttttaagtgttcctgtttctccctcagttttcagtagtgactgcaagtctgtaacacaaaatacagttctatctccagggtcttaaactttccctggtagcagagacctctgactagtattggtgcaggattctgagcacaagttttcctaccctctccccagaggcagaagagtttttacttttgcccgtctctcagagacaatagatctctttctggacctggggatgagaaggtttttagcgtgtacacctaggaacataaagcatttgtttcatgtaagagaagggtttgggggagcagaagggcttcatccttgtctcccagtgacagctgatcgtcgcttgcatacctgtaccaccaagtttccttctttgttcctaattttttgtgaggacccagtggaaatctgtggaaaagaacttaaaaatgtgccccttgtatctggaaccccaggtgattttaaagtaatgtaaaggcctatactaggcctttaagaattttttaaactcttacatgatttcttattatctggtttttatggcagcctcctctttctcctatgctttgccaaagctgagagaattttcaggatctgtctctccttggagtggctctttggaattcacttgactgtgtggtcatctcagatctctgagttcaagaaaacttaccatgtttgagatttcctggccttttaccattgctaggatgggaatagctttctcttactgatttgcatatcctaaagagaagtacacaagtggaactctaaaagtaatttcttaataatttcctctatcctcattttccccctccccattaacagtttgttctaattggatctaaaagatcttacactgtaattggctgatatgtctcttaagtctcttttaatctacgtttctcttctttacattttgcccttattatttattcattgaagaaactgggtcatatttcctatagagctttaaaattgctttgattttgatgctgctgtcctaattttcctttctaatttgcttaatgtttatatgaagagaagctattgattaatatgctttttctctggtttgcaacttccttagttgcaattatagtaattattaatttaattatcatattaattgtagtggattttttttccaaaaactctatattctcttgggattttaaaatatataatcacataatctatgaataaaatattttttgtgtttttcccctaaaacctacaacccaccctcccttccttccttccttcctttctttcttggctcaggtgcacatgtgaatgtttgttacatgagcaaactcatgtcacaggggtttgtggtacagattatttcatcacccaggaattaagcccagtacccaataattgtcgtttctgctcctctccttcctcccaccctactcctcaagaagacccggtgtctgttgtttccttctttgtgttcataaattctcatcatttcgctcccacttataactgagaacatcatgcttatatagactattgttcccattcctagttacttagagtcttatatattgtatacaataattctgccactagttagtcaaataaatctagcaactggaatgaaaactggtaagtacaggttatcccttttctctgtctttataagcatttattaagtgtttacaatatattatagacttttagtttccaattaaaggggtaaatattccatgtgtaagccatgttacgcttttagtaataagtatttgcctatttcaattcaataaacatttactcagtgctgacagagtaccaggcattgtgttggatggtgtgtagaatacaaaatgctcaacaccacacccttcagaattttctaataatttcctctatcctcattttccccctccccgttaacagtttgttctaattggttctaaaagatcttacactgtaattggctgatatgtctcttaagtctcttttaatctacctttctcttctttacattttgcccttattatttattcattgaagaaactgggtcatatttcctatagagctttaaaattgccttttaccattgctaggatgggaatagctttctcttactgattttcatatcctaaagagaagtacacaagtggaactctaaaagtaatttcttaattgctttggagatggactcttgctctgtcacccaggctggagtgtagtggcactatctcagctcactgcaacctctgcttcctgggttcaggtgattctcatgcctcagcctcccaagtagcaggaccacaggcgtgtgccatcactccctgactaatatttgtatttttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtatgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgccaatattgtaaatgccctgaagacagggcccatgtctatctttctcagctctatttctttgatgaatggtaggccctaagtaaatgcttgtaggatgggtggaaagataaaaggatgaatgggagaagggaaggaaggttggaaagatgaaaggaagataggtgggtggaaggaaagtacaaagaattttcgttttgttatctcttccttgtattattagtagttatctttttgtcatccttaaatggatgtatttctgaagatctgggtatttgggtatcccaagatttgggaagatttataaaacaaaatcacacaaatacagaccatttggaaagggatggggagagatgttatgaatgataacaaaattagaattatataaaatataatctttaaatattttcaatcatcataattattagcacaaactaatagctaacaacatgcttctagggagatctcccttcctggaactagtgttaataaacagattttaaattatttataatttattatgttaacttgtttatttcttatgcctgtagttgttgacaataacagaaatagccatgttcaacagtgggctaggttccagctttagtgatcttttgtatgcaccaaattcttactgactttagcatagtcattttgtgctctgttgtcttatggtttatgttatcattctccagttactttgtgaatgagcactttatttcccctgagagttgtagagtttgtaacatgtttagggccatgcctctttcttcatttatatttcacatatgaatgatgtatatcctaactgaagattgggttcacaatagtgctgttgcacaaatactgagtaagtttaactgtctcttatttatacaattattacatttactattttatattcctcaaaaggtaaaatataggaaaactttagtccattccctatctggatggttattccctctacatttgtctcttttcgcatctgccgattctagtctctaggagagagaaagaggccatatatccatgcatttcagattactgaggtcctactgcacttctttttcttatttgtggccagtgtgtataaatttggctgggttgcagatgtgcggtgtggaggccatgatgacagcattatcagtgctagatgagcagtttctctgtggggctatttgaaacaggctgagtgcatgtgtgcatttcaatctaggctgggccagagcacagaggtgctatgattgacacccccgtgagccttcttataaagccagaaaattgaaactcccttctgggtcctctgtgaatgatcaacccctgtgccgggaaacagaactctcacttagcattggaagaatgtctccatcactaagatccttttcttggaatctcaatggtcccagttccattgatccttctattaatcctccaagctaatgaaaagtggtaagagggagtgttgtgtgacacctaagggtggagcaaaaacaaaggaatggggcttctgaaaccacatctgtactgaccagagtatcctgggactgactgggagtcctgagacatcatggctcttagtcagagactgaagacttccaaacagactaaggggttcttttcccagtgtctagtaagggacttttaacaaggagaactgtcccttgggatttaaaatacaatccctaaagttgtgcttcgaggcttcccaatctgcattctaggagactactggttgctaggtggccccactgagaacacagtacagtgactgtagaagtgacaggtcttcaaccttaaaagccactggagagatttttgattcagtgtatgacctgtcaagaaacaattcttaaacaggttatggtggtttgtgcctatgtgggaagctgaggcaggaggattgcctgaggccaggagttcaaggccagcctggtcaacacaaaaagaccctgtctcttaaaaaaaaaaaaaaaaagagagactcggtgcagtggctcatgcctgtaatcccagcactttgggaagccaaggcgggtgaactcctgaggtcaggagttcaagaccagcctggccaacatggtgaaaccttgtctctattaacaatacaaaaattagccggatgtggtggcgggtgcctgtaatcccagctactcgggaggttgaggcaggagaatcacttgaacccaggagatggaggttgtgatgagccaagatcgtgctactgcactccagcctgggtgacagggtgagactccatctcaaaaaaaaaggacaattcttagagtcctattgttcctatctgccttggtgacaaaaaaaaaaaaaaatgagttgggatgtatgagttaggagcatgctggtatgctctgtgagggaagcatgtcagctggctggccatgatatggttaatgtgctccctgctctgggatggatggcttgatgcctcctaagtgatagacacaattcctagtgcctcctgtactttattttagagtcttcttcacaatgatggtatagagaccctaatgaccccattttgttgatgaagtcgttgaggtttagggaggaatgtcaagccgctggccaaagtcacactggctgagccacaattcaaacccaaccttgctggcttcacagtgtctgctgctgatgttttcagttcatgctgatgagtcatttcccaccctccccaaccccctcctggttattcttttggatgaaggtagaaggaatgccaggggacttgggagaatggtctcatgtaaacagcatggcatgagaagttgagggacccagcttccatcttgactccccctctcttagacaaatagcttagcttctctgtgactcaatttcctcattgcgagacaacttcgtctgaggggatgatctgtaggtttcttccatcatgatatttcaggttgcttctaactagctacccttagtgaggagcaaacctgatgaattatatgcactacatactaaagaggcattcatttattcattcagtgaacatttactgcacaccttctatgagccagcccagggtagagtgcgagtaatttcagacacaggcccttccctcagggagtttatagggtgttgctatggtcaggatatcagccttgtgtgaaacactatttattactattttacttattaaatgtgttgtgacacagaattattcactgggagccacattgcccacagcacaggatgtgtcctttgctgctgtctgactcttctgcgcttgcacctggctctgacttacatgcaggagagctttgttctctaattgatgaacattaggtacatttaagaatatttttttaagcatagaaaggtgacttttttttcagtgagccttgctttttcacctgatgttaaagatctgaacataagtggtttgagaaatgaaaatcaatctatctatcagtctaccgatcgatcgatcgatctccatcacaattctgtagcatgttctcaaatctcagatccacccaaaaagagtgaccccactttaacctcataactccactatttttcaaagacaaatctttatcttgagtagctgaaaaaaggatgagaaggctgcaaattaatgaaaaccatttctaaatgaaaaaaggtaaactggagaaataaagggaaaatttgcagcttgtcctttagaaagcctgccccagctctcaccacataggatgctttacccgctttcttgcaactcctgagggccacagcattgctgggataatccagtggcagttaagtccataggctttggagccaaattgcccagcttggaaccttctttttaccacttagtagctgtgtggcctcatacagatgacctaagctcaatctcttatttgtaaaagggggctatcaaattgtggaaattaaataatagatgcataaaatcccctagcgcagtgcctggtgccttgctgctttcttcttagaatggaatttatcctccttgtgattgtgcttcaaaaataatcaggaacctctttgagtgagtggcctctcttattgtatgaccaacaatcctggtttgtccaggactaagaagtttcatgagatgtgggactttatgtgctaaaagtgggaaaatcccatgcaaaccaggataagttggtcactccaaagctggcaaagtcctcagttttccagatgaaaatggcaaggagaaatcttgatactgaagctgactccagtgagaacccccccatgtgagcaaggccagggccgtgaattaaatgagagacccatggctgctttcccttagcaccacattcaagcaaaaagaggaagaggcctcactcactacccccaggcattctgccccaaacatgagactgcatacggtgcctttctgctgaagcaagtgactttcaagcccggctgcctgtgaaaatcacccaaggagtttttaaaaaagaaataccaatgcctgggccccatcattaaaagtttttattttattggctcagggtgagacctgagcatttgtatttttttaaaatctccttgggtgattctaatgtgcagtgcagggttgaaaattgccaacatatgttacaacttggagttggcaacaggtgcaaattgacttatagttttcctaattgacaaatttagaatttccttatctgagtttcagctgtaatggcttgatctgttagtaatgcatgggatgctttattgagctgatgtgtccatactggtgtttccatgtgaagaaaacatctttaagatgattgagcattctctttatttttcccttttcttttgtgagggcaatatacttattagtgtcctgcctagctcaagtagcatggttttgaagattgagaaaattcaaagtttaatttgagtggagggggaacagtgatatttctctagaaaaaaaaaaaggccttcttttttgtaccagtttttgctggagtcatggcagagaagagctgagcgccctccttctggtatgtggatggagatggctgcttctcagggctgctcagagtaagattgcgtgggctttgggctgggctaggttggatgagaaaggcaaggtgagtggtacttacagctttggaaatatgggtatattctccctgcaatgtcctgagccaggcagcaagcttcaaaaattgtgctggtgttattcaatgctaaaaagacactcactctcaagccataaaaagacatgaaggaaccataaatgcatattattaagcaaaagaagacaataaaaaaatacatactagatgagcccaactatatgactctagaaaaggcatgttttaaatgtgaatttctatgcaccattgacaactttgtttactttatttttatttattgttttttttgagacggagtttcactcttcttgcccaggctggagtgcagtggtgtgatctcagctcactgcaacctctaccttctgggttcaaatgattctcttgcctcagcttcccaagtagcagggattacatggatgtgtctgccatcatgcctggctaattttttttttttttttttttttgtatttttagtagagacgaggtttcaccatgttggccaggctggtctcaaactcctgacctcaggtgattcccccaccttggcctcccaaagtgctgtgattacaggtgtgagccaccgtgcctggctaacaactttaaaaatttatttttttcttatgaaataatacgttgttattgcgaaaatatttaaaaggaaagagaggaaaagcatctgcagttctaccacttcagagataataaccatgttaagagtttggtgtatattcttctgtttacttgtgtacacacatatatacatatctatattttttataaaaatatactgaatattcttttttagtaaactgatttttcatttattaaaattgaatgcacaattacctattggatacaatgttttctatttaagtgatgagtacactaaaagccactaggcaatatatccatgtaataaaactggacttgtacctcctgaaactataaaaataaaataaaatgaaaagaattgaataaacatggttttctgtgttactaaagattcttgtttgatttattttgtctacccacaaggttttgaatgaattttgtgcaatgatcctattgttcaacaattaagcctgggcaacacagtgagaccccatctctaaaaaagtaaataaataaattagccaggcatggtggtgtgcaccttgagtcccagctactcgagaggctgaagtgggaggatcacttgagcctgggaggtcgcggctgcagtgagccatgattgaacccctgtactccagcctgggtgacagagcaagaccctgtctcagaaaaatcaaaacaatatttttccaatttttctttattctcttatctacttcattgaatgtcctatgacttaaggttaagaaataaaatagctgggtcgaaagctgcatgatatttttaaagactgttgatcattattgccaagttaactcttcccccgtcaaacctttgctaacctgacaggccccagatggtatcccattttacacacttttctttgaccacagtgagggtgaacatttgttccaatgttgactattattattttcctctgacaattgcatgcttgtgccttttcattccattgtccattgaggtttctctttttcttattgacctatgaaaacattaaaaaaatatccagcctattatccctgtcatatatatagtgtgaacatttctactcccatttttactctgtttatagtggggttttagaaaaccatttgatacctttgtgctttctggaatttcttgtttaatctgcctgtcactgatacagcatagcgttcacttgcctgaaagcctttttaaaaggagagttatagcccccaaatccactccaaagtacactataatcatccagtggaaacatctgtgtaattgaagcatcattaatgtctctgtcccaaactcaaagaactataaagggcattgttaattttacttcatcatcagccccttattaatcttggcaaatgtttaacttgtaggcaaggatgtccaagccaactcacaatttactatgcaattggctacaaatgttgaggtgggtttttttgtttatccacctaaaagaactttatgtccctctagcactaaattatgacatcttatctcacagatttaacagcatctaatggttctatctctaggtaatgtaatccagctggagttcgaaggtatgcaaagcccatgttttagaacaaaagggtatttttctctagccagtaaataaaagtgattttttttttcagctgtaaaaggacaaaaggttttgaagtgatcccactgggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatgttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagaggataaaattacatgaataaccaagaacaatttctgaaagcaggtattgaggaatcagcaccttgcagtaattcacacagctttattaaaattaccaacaacaagatcaacagcaaagatatgtgatatcccagccactgttctgaacatctgggcatatttagttgcttaatcctgacagtaaccccatggggtaggggctgttattgtccatagattacagatgagtaccgcaaacaaaggtaaatggctgagccaggattagaacatgagaaatctaactctagagcttgtcctcttaacttgattaagttgatacaacaacaatgccgcaaaatgggtgatggggtccccattttacaaatgagaagctgaggctcaggggaattaatgactttgtaataactttccacacatctgtgaagtagcagtttggcttaagccctaattctaaagccttccccaggataccacatgtctcgtactacaacacatttctttacatacagggctttattcacttcagagagagcttataactggctaacagacagatacccaaatgggcctgtgacacactcttctgggttctcattgcacaggaagctggtcatttagactgcagtcttcatttgtgtgcctgatgcaataagaactgcctccaactctttctatatgaatagctgtaggatataccttctctattcattcctgcctcaggaactttgctttttctgtgccctagcttggaatacgtcatccccagatcttggcatgtctgacttcttctcaggggttagctcagatgccattgcctcagtgggggcagaccctaactatctgtattaatctcctagggctgtcataacaaatcaccaccaactgggtggcttaaagcagtagaaatgtattctcttatagttctggaggccagaagtctaaaaccaaggtgtaggcaggaccacccttccttggaaggctgtagaggaggattccccttgcctctttcagtttctggtggctccacatgttccatgacttgtggcggcacaactgtaatctctgcctctgtctgcacatagcttgcccctctgtatttctcctcttctgtgtcttctcctcttcttataagaatgtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacatcatcacctctttattttcttcaaagcacttgtccttatttgatgcatcttgttctcttatctacttttctttgcctgtctccacctaactccatctacttggattcaaactttatgagtaaagaactatcttgttcactgctttaccccaagacgtagaacaatgcctgatatattgtaggggtcactaaatatttactgaataaatgaataatctcattgggctaatgagatgtcaacttggctctctgatcccttcagaaatttccaagttttattttttttactattttatttgaatttcagttggatatttttcagaaatgcaaatgtattaggagacatatatttaatataatgggtaaatgatccaatcatttctacataacattcaatcactaactggtcttcttaattcatttagcttttgctttgctcccacaaatgaatgctcagcagaatttttctttcacctttaggctctgaccacctccgagagaaggatggcctgtgggctgtcttggtctggctctccattattgctgcccggaagcagagtgtggaggaaattgtccgagatcactgggccaaatttggccgccactactattgcaggtgaggagaaggggaagggtctctgtatggaccctgaagaactactcctagaacaggtttctaaaactgatgggctagaaccttaaaaaggaggcatcaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcgtgaacccggaaggcggagccgagatcccgccactgcactccagcctgggcgacagagcgagactccgtctcaaaaaaaaaaaaaaaaaaaggaggcatcttcccagaagatctgaggaacacagaggctggagctgaatcaccccttatagatagttgggggtggtgtcaaaggctaccaagctggaaggcaccaatttcctttcccctgatgacatcactctttaatcttttcatcaatgcctataaggtaggtggccctctcaagaggaactctgaactgcagagctttgaaaagttatttggtaactatcatggctgtgagagccgtgcagtcaaaccagaggcatttcttgttggttttccattcatatttatcaagtaaaaaaggcagacacagaagctgtgacaggttggtatgctttcataatcctctctctacctctttcttacctcctcaccaataatcagattcagtgtccaagatgcctgagctggcaccccttgaaggaacctcatggttcaagagccccagatattgttaaagttttgtcctcatgaaaagaggtacaggccaggtgtggtggctcacgcctgtaataccagcactttgggaggccgaggcaggcggatcacctgaggtcaggagtttgagaccaggctgaccaacatggtgaaactctgtctctactaaaaatacaaaaattagctgggtttggtggtgcacacctgtagctactagggaggctgaggcaggagaatcgcttgaacctgggaggcagaagttgcagtgagtggagatcgtgccactgcactacagcctgggcaacagagtgagactccatctcaaaaaaaaaaacaaaacaaaacaaaacaaaaaaacagggaaaaagaagtacagaaaaggaaaccattattttggaaggaagaaaaggaaagatcagtgggtaggagcttagggttgggggtctatatcactttcccgttgtttaagtaaatgaaagtaagagtattctggaagtgtggttacttgctaggagtgtgaacctaggtatgctagatatgtgtacataacaagaacgaagccatgggttaggaggagggagtaggaaacgatgttaactgtaaagaacttggaggtggggcaagggaatccttgggtagtctcagagactctgtattaaaagcagaaagattgtgactcattttgctttgtttatgaatagttaactactttgaatgtttggttgtgtttcaagagcttaagggacagaaagagagctttagactttcctcataaggtgattatttcttctgttaagaagacttttacttagatatgtatcagagaataaggaagcccatgactgtactcgttaaaatcaaagagattacaaccttctgggagatgtaaacaacaacaacatcatattcttagttcccatttagtcaagaaagctggggatgtgatagcttgcaaaacaactcgaattattcagtgtatcataaaaaatgaattctcaggacaggtagaaacttggtttactcattatttctaacaagtaccaaaaccccctgattcatgtgtgttttcttttcctggcataccaagagttaattggcacatgacattcttctattgcatgaagctgttccaaaacgtccaacctgacaaaatatattatgattgacaacctctggcctagtgagatcgctttgagtcagagatgtgttcctcataatttgtggaatgattatctaggtttctgctggtgtcttgaataattggtgttatggtaactgtatttataatgtagtttattttttgtggccaagagcttacatgataattacttcttcataacaaataccatatttgaaaataatatgcaatacagatttaatttcttctaggacattgagttatgtttcagatttctttccaaaaagatcacagagataaagaaaaagggaggagaaaatacatagaatgaaaggtaaacatttccttcaacccccagcaaatggcaaattagaaggtgcttgtgaaatgtaattattcctagcttgacaattttcttggcaggctgaaaataataaaacaatttcactttaactaatactgagcctgaatatctgagaaaatcttccagattatttttcttgtatgagtagaccccagaaggaatcttccatttaaagatttcttccttgaaaagtgtgttgttattggtggtgatcagacggggatttgggggtggaaggcagtgctagatcctgcttgtatatgaaggtgaacgtttgggcaaacagatctgatgattctcaaccctagactgaacgtgatctatcatattagtggatttttttcaactcctgaatctctttcaatgcctctctgtctcctgctagactctcttctcctgtcttcctgcccctttctccttggttgggtctttaccttctccaaatgtctacctttaaagtgactgcagtctcagaatatatgccctgctgaaaaagaatgttctgagggagttccttttttttccctctgaggctgagaaaaaaacaccttgtgtaggaggaagagaataaaagaaagggatgtagatgcaggggacccattgctagacatggtattattccatattttgcatcttggctaatatgctgatgtttactggatgtcttaaagatcttgagtggaaaaaagtagtaacaactattcagagcttccttcttccagttcactctgagaactcacatcctttctctatgctacaggaagcccaaatgtaagatcctccaagtgacttgggtgcagctgcccctcctatggcttccttcttaaacagacagtcctaggtgtgccattaggtctcagccaagaccatctgacattgtaaaatatagtttatttatggtggtgatggcaaataaaagttgttagctgtttttaagcacaagtgcctggcactgtgccaactcttggtatacatcatcatattttaaaccccacaatgacaaatgcaattggtattatttttagtcttttattttattttttctaatcgacttccagccccattgttacatttaatacgcttggctaggaggacttttttgaatggaacaattgtgatatttcttccaagtttccaagagttctatattgtgctcagttccccttctccctttctttttaccttccttgatttttctctctttccttccttcctttcctttctcccatttttcattccattctacttacatagaacttactatgtactagaaatagcagagagcaagacagttcctggagctcacgttctggtggccaaagacaggcaatgaataggtaaacaaatatacaaacaagatacatacagtttgggataactaccaaaagaaaatatgaagggtgatgagagaagaagacgagtggggaagctgccttagatagatggtcagagaaggtcacattctaatggtgacagtgggtttgaaaatggaaggaaagaacgagcctggtatttgaagagctggcagaagaatgtacaaggtagagggaacacacagctagcgcaagggcccagaggcaggaaagggtgcaatgtcaatgcacactggagaagagaccagtgtggctggagccagtgaacaatgataaaaagacagaacaaagttgagtcaaagaggtgggccagggcagatcccacagtgcctgatagaccaaggttaaagtgttgagttttgttctcaatgtgatgggaatttatagagggatttaatagaaagaaagtggcatgatttgatttttacaagattactctggccgctgtatggggaatggactgtaagggtcagatgaaagaggggagatgagttgaaggtgcatttctgtgctgtccttccctggaaacagaaccaatgattaaataactgtaagtgggccacccagttgctggttctctgattaggtttctgttcctcctgtgtcctcaccaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacaggtacttgctaggaaatcactacaacgggttatcaggcagaaccagtggccaaaatgtcctagaactggagaggtccttagggatgatctaaggtgacctcattttatagatgagaactgtgcagccaggaaagaggaaagcccttgatgaaggacacctaacaagttagtgcacagggtagattagaacatgggctttctgtggccaggcacagtggctcatacttgttatcccagcattttgggaggccaaggtgggagggtcacttttgagctcaggagttcaaaaccagcgtgggcaacaaagtgagacccccatctctaccaaaaaaaaaaaaaaaaaatagctgggcatggtggcacacaattgtagtcccagccacttaggaggctaaggtgggaggatcgcttgagcccaagaggtcaagtctgcagtgactcatgatcacaccattgcacttcagcgtgggagacaaagtgagaccatgtctcaaacacacacacacacacacacacacacacacacacaaaacaaaacaaacaaaaaacaaaaaaaaaaacaaaagaacatgggtactctatgtccagtatttgtcccacttggtaatggatagaccaatatgtcaaataaatacagacccaacatttccttatgaaatgtttgtagcctgcaggtgctcatatgtggtggccattattggtgacagattcagaaaagttaccaagaactaaagatccctgtccttggggcctcagtgagtcagtccttggaattgtaaagtcaggagctcagctggcatctttgagcccccgtgccctggataggtcttttccagttttggaccacattcccacttccattttacaaacttttcttagattcaagtctcattttgatgtagaattcaagagatataaaataatgtgccttttaaagtatccttgggatatttttgctcaccgacaaggaaggctcggaaaccattccttcaagggaatggtctaatccgcactcagttatggattttatctacttgcaagaagcttgtctgttgagcttatttgttttgctgttaatgcagtattcctctaccttatatcttcctcagtgtactcagtgcttggataccttttccttagattttctttaactgttcacatcaggccagttctgcaactggatctcaagttcatctatttatttcatttcccctccccctccataactctgactgttggttttcatttttacactggaatgtgtttgatagggtttggctgtgtccccacccaaatctcatcttgaactgtagctcccataatccccacgtgtcatgggagggaccaggtgggaggtaattgaatcatgggggtgggtttttcctgtgcagtcttgtggtagtgaataagtctcatgagatctgatgtttttataaagggcacttcccctgcacatgctttcttgcctgctgccatgtaagacatgtgtttgctcctccctcgccttccaccattattgtgagtccattaaacctcttttccgctataaattacccagtctttggtaattcttcatagcagtatgaaaatggactaatacagtattgatttcccccaacctcttctacactcttctgtctgagctcaattgtagctataaatggatacatgctgccaggatctgctcttgggaatttttctggtaaagaaagaaggaagttttttgttccttttcccagattccaggacccaggtgatatcttcattggctggtggtcctgagacacactagagcttctttgcaggtctgggtttagctcaaggggggtgatgagagaccagttacttaatacttagcagcatccccattgttggcaagttacagatggttcctttgctgccgttggtcctgttgggtagaggtggaatccctgcatagcagtgttgttgagaccctctcaggatgtcaacatgcatcagcattcagccccagggatagttgagtctggggtacactttaggtaacatagtgcaaaataagcatacttttcaaactatagacatctgaaagacatatttgaatttaaataaactagtattctaaaataaccattaagtaccttggtgcattcattcagtggatatttattgagagcctaccaaatgcataatttgttttttttcatggtacagttttaaaatataaatatatagtatctttattgatatataattcatataccagatggttctctcatttaaagggcacacttcaacagtttctagtatatttacagaattgtgcagttatcaccacaaccaattcagaacactttcatcaccccagaaaagaaatgttgtgctctttagctgtcatcttcctcccaacatccctccaacccacagcccctggcaacccctgatctttctgtctctatggattcgcctatttgggacattttgtataaatggaatcatataatacaaggtcctttatgactagcttctttcacttattgtaatattttcagggttcatccactttgtaccatatatcagtacttattccttttattaccaagtaatattctatcacgtggatgtaccacagtttgtttatccatccatttgctgttggatgtgtgaggtatttccactttttgactataatgctgctgtggacatccatctacaagtttttgtgcagagataggttttcaattctcctgggtacatacttaggagcggaattgctgggtcaaatggtatctctatgtttaacccttaaaggaactgccatatggtcttcgtaagcaattgcaccacttgacattcctgccaacagtatatgagggttccagtttctccacacctttgctaacccttgttattatgtctttgtgatttaaaaatactgttattttaaaacaacctactatattatggattatttttaaattaagatagaaggagatttgatttctataaggagaaacagaactatatctctctgttagcaaagctcagaggagacataatactgccaagtgtctgcttcctacaggaggcaggttgttgtggttctcttcagtattctcttgtgttggagtcagatagacacaggattgaaagctggccttgtcactgcctagatttgtgattttaggcatattatttaacttctttgaacctcatcttgaggggaggagctagtgataattatcacacatgcatcatggggaaagtttgaagagaaagtcatgtgaagcctcaggtacagcggcaagtacctaattgatgctcaagaaatatcagttccctccccttgaccagaatccttaatttgattgaatatcagttcaagaaaaggatacaactattctctctctctctctctctgtgtcacacgcacatacacacacacacacacacacacacacacacacacaaatcaggtgtatatttttaaaagtaataatcagtgtgccctagggttagaaaaccctcacccaactcttctatttattctattttaaaagtactttgcagtaaaatttgaggctcagattgatgatcccaaggtagtgggagattcccagttgtctcttgtttgggttaaattctacttacttaaaaaaaaagtagatagcagaaataattttcaacaatgaattgttaaaatttgtgctgttcccgttttatacagaaattctcttcaagagcagctttctgctccagagcacccaaggcaaccttggtgccactgtaaatcgtgtgagcaatggttgggtgtgcaggcttgaagtcagaaagttttgggtttgagcctcaactctgccacctccttgctgggttatcttaggcaagctattcaacccccctacacctgcatttttaaaatctgtgaaataggaataataattgtggctgtctcatataagcgtttgggagaattaagtgagatgacacttataaaatcctggcacataacaaatgataacaattggttaaataaaattatttatgttttaaaaaaagcatccttgggaaagactgtagcattgaatgaaccagatatgataagaaaagcagaaaaaaaacacacaattttgcagtgtcacataaagatttgagaaggccccttcagtttctaagtcatctgggaattgattcaaactcatatttctccccctctcccatcccccagcacacacactctgctttagaaagcgaaaggttttttaaggcagcttggtctcctttatgtccttgacctgaggtcagagtcaggaaataaaccatggaaaaaaatcctgtttcacatacatctccagagataaagtagaaatgcttctccatccaaaatgaaattaaaatcctgttctggtgataaccaccccactactgccaaccctgctgctgtggaaacgttcagtgaaggctatcctgcctggctttatgggaccattcaaggagcaagaaggaaaccctgaagttctcaacccctgacatgatttcccagggacctccctggcctcaatgtggcatgtttggtttcatgggatttactatggctgcctccaagtgtctgatgcatgtgtgacctcggatgccaagagaaaaattgatgtgtgctttccactatacagggcccaagagagactctgtttgatttagaaagcattttcatgaggcatggttcaacaactgcagttcttccttctatcttcatgaggatatgtcactattttcaagtgaaatctagtcacatgaaggactgactgatgctattttcttcaaatataagtggaaaaaaataagcctatagctacaatgagaataggggagcactttgatcaaatggctaagtagttaaaggagttcccagtttataccttctaaagagataggacagagaggagttgtgtgattcatgtgggttgcagggtgagccactctttcttcaggggcgacttcattgtgcaaacatcgagggtttccatccatcatgctaggtgagctctttcttcccttcaccatcgataccctaaagaatattatcaagattgtctcttactatgatcttttctccatctctaacatgtggcctaagtcctggaatctccactcagtgccacagttgtgagactcccccagctctgatagaaggaatactccaatcctggtattgtgagtgaaggacagtgtgacagaaatggctccacattgagagacagcatatttccactatggtgggtatcaatccagaaccatgacctatattttgaaaactggatttgaaatgagaaaccttgacacttcaggagcaaaatttaagcaactgagtctctttttatgactcatcctaatcctatgttgttgttgttgttgttgttgttttcttttttctttttcttttctttttttttttttttagacagagtctggctctgtcgcccaggctggagtgcagtggtgtgatcttggctcactgtgacctctgctcccgggttcaagcgattcttgtgcctcagcctcctgagtagctggggctacaggcgtgcaccaccacgcccagctaatttttttatacccttagtagagacagggttttaccatgttggccagtctgatctcaaactcctgacctcaagtgatccgcccacctcggcctcccaaaccaactcctatatttctaacaagctcaaaaatcatgaaactcttccagtgctgaagtcatttgcaagtcacagttcagctgatggttaaaaagctgatgtaaataaatgcataccagttaggtgatgtggaaaaccaaatccaatttgattatgtcaggctaactctgagctgattaatacctcttcaagttaagcaggctatgtggaaacattttgatgttgtccttaacctggaaaaaaagaaccgtttgaatttagttcagagaaaaagcacactttgaagactgattttgaagtcagttttcttttagcgttgttattttaatttgcaagaaggtgtctgctctttttaatttcagtgtttagaaatagtaaattggcaatctcaaagtcacattttatttccagcatgtggtgttttaatatgtacctcgatgcaacaaacccctggtcagcaaatatgaagcagctcactaaggtgttgtccccagcactgtataaaagcaactgaatcatatcaactggagaatctgaagctttaagattgagttcttctctcttcagagttagctagtcaaatttcagcttcaactttttgtttttgttttttgttgttgttttgttttttgttttttgagacggagtctcgctctgtcaccaggctggagtgcagtggcatgatcttggctcactgcaacactgcaacctccacctcctgggttcaagagattctcctgcctcagccccccgagtagctgggattacaggcatgcgccaccatacccggctaatttttgtatttttagtaaagacagggtttcaccatgttggtcaggctagtctcaaactcctgacctcaggtgatctgcttgcctcgggctcccaaagtgctgggactacaggcgtgagccactgcgcctgacctcaacttcaactttgatcacattctaatcaatgaactaattgagagactataattgtaacaatttatccttgtcccttttgctggagtgccatttgctggagtgtggtttgcgcatctggaagtagagcctcagaaatcattttagtcacactgattaacccacctatagaatttagttaaatctgaaaattagcatacccacaaatagcacttctacactgagtcacagaactgtttaagtgaatgggctattatcacatttagtttattgtgattcgatgtgggtttaaaaaaacctttttctttgaaaattgtgatgttgaaaagaatctctgcaataaacatatattcctttcctaacttagtctaatatggtgaaggttgttagaggctgattcatttacaacttcatctattcagtgagtatttaccaaacacctactagacgccagtcagctcattagcaccgaggatacaacagtattcaggacagttgagattcctgtctgctgcttaaaatctagcagggaagataaattgatattaaactttaattactgtagagtttgttgaacggtattacagaggaagaacttatttggtgtgcatagcgggggaaactagactagggctctagaaagttctccatagagaggtgatatctaagttgtactctgaagaatgggtagaaggcagcccaggtgaaaccattttatcagactctttgcttttcttcagtccaatgtggttgttatatggttgtttagctctccagataaagagctaaggtttcctataggcattctcaatgggatgctacgataactgtgattaggattctcaacttcagtgctcactctacaacactgtagttggggaaaataaagacagtcgggctctgtattgcactatggcttgtgctaggacattttgaaaaccataggtttaaaaaaataatttctactagccacttttcctgtgattttcctatttgtcctctgaaggccaaacgcatattcagtactttataatgacctgtcagctgatttgaaaataaaatgggaagctgggtgcaatggcttatgcctgtagtcccagctacttgggaggctgagacaggaggattgcttgagtccaggagtccaagatcaccctgggcaacacagcgagacctcatctcaaatttttaaaaaagcgagaaagaaaatagaatgagggagaccctgtttctggttagtcgggaagttctcatctccctgtttctggttaactggagtattgttataaagaattaccttctcctggcataagttgattgctttagaactattgtctaaagtgtcagtagtaaaattgtcctaaaatgtgtagcaagcgtgtaagcattatcgaatgacaacacagttactttctattggaatactaatgtctctgtgttgtcgggtggatgagcttcaccaggaaatataaatataaaagagaaaagctgcaaatgatcacaggaactaagggaggaagctatgccgttgtctgggtaaagtgtgcctgaatccaaaatatcccagaactggggtggatattgtgtgaacagggatcagcagtcattggccaaagaaatggggaaatagaaggtgcatgattttgttccattgttccagttttgagagttggaatttggatgaggaatagctttcaagtcttcgccctccagcagccctctcatcacctagcatggcttttctaggtgagtgctttaaaagagcgtgtaaggagtcacttgaccttgatttccccagatagttctttgcaattgttagcccccaagaaggctggttggtttttaaaagaggctgggtgagaactgctcccaagagcagggcagctgagtatggctgtgcagtcagcacactgcacaatggtacccagcctaatggggaaggagaagctgaagtccaagccagccgaaggaaggatggttttctgcaatttatccatgctgggggtagaggggggcacctgtttttaactcacacaaaagcaccatatggagtaactgctgccttgctcaaccacttttgaactcatgctcacagctaactctatgaattattaaacaaagaaaaatgggtaattctaggtgggtttttttagtgtgtgtggaaagatacgtctgttcaatccaaatctcctgctttctaggctgcatgcccacttctacaaaatatggttcagatgttacgaagcagtatcttcaccttgacgctttccagataaatcgttgtgatttcctgtgggagataagatctgagttaggctcgcagagtctctctcttccaaggctgtcctgtctccaggttcacatgcctgctgtggccaactgactatatatgcgacactgtaccagattgcagggccatatgctgttttcccctggaattcatcccaagtcagtatttgactaggtccaatgctgccaaataactgttggtaatgtacagttcacccttccctgcctggctacaacatgtcctacagtctccaaactaatatctggcagctctgtgtgtatttagcaacttacagatttccctgtattgatttacacaagggtttatttttaaaattaaaaaaatagtaaaaaccctaacatttatttatcaaacatttatcagatacctactctacataaggctctgtgtcagctttgggaaaaatacaaaacataagatattgttcagatatttcgcatgagaagcaatgtgtgaatatcagtagttgcatatggttcaacctcagattgtaagcctagagtcagaagacctaaatggaagtaaatgaagctcctccatttactaaatacgttaccttgagcaagtgttttaacttctttcttttcaataaaaagagagattggcaagaatgactctaagatccttctttcaggatgttaagatctgacactcacaacaacccaataagctaggctgtattatttttcaactgctttttaggaaactaaggcttagagagcttaagtgactcaagaccaccagctaaaaaagtggccaagccagcattctagcctgagtttatccagttgctattcttgtatcatttccaaactgactcttcataaacagcaaatcaaagagggggcaaatccagggagaaaaagagatgctacagtgataactggaagcacactgaaggatttttgtgtggagatagctgcatatggacaagggttatgaaatcctttatcaatcattcttcactgggacaaagctaaggtgagcagaactcgactgtcatcattaaagctcacaaccacaggcactgaaaagtaaggaaaacactaagctggaactgaagtgctcttttgatacccacactcctccccaccacataattaacattgtcttctaataaaggagagcatatttttcccttttttgagtgtgtggctatgtgtcatcctggatattccggctactctagctgctgtggctagtgagatatcatgaattctttcacagttgctccaggaattcctacgaagactgtgctaaaaaaaaaaaataataatgtcagatggttcaagaggtggttctgctgctgacaaggccccagggggaagctttcaggattcagtggcatgaagttgttttattagcctcactgtgttaacagccctcctacagtcccagcccagtgagagcctatgtatgaaaccttaaatcctaaagggaccttccttataagggacatgtagcacagtccagtcacttgatagatgaggcaagtgacccagaaaaaagaggttattgcaattagttactgcacattagaatcacccagaaagcttttaaaatcctaattcccaagtaacaccccaaaagaattaaatcacaatgtttggggtgaaagccaggcaccaccattttttaaagacctcccactgatttcaatatgtagcattttgcaattaatgagctaatggtttgcctaaggtcatacatctggggacaagaacctaccatggttcaactccattgtttttagccaaaactggcccttgtcttaagacatcttgagaaatggtggaggaataaacagtcaagccctgccatgatgatgctatgccaggcactttcttagtttatcttttgcaaccactcttcaaggtagatacatcagctctagttcaccatgaagaacgtgcatgtgttttcatgtagcctgtggatccttgctaaatgcgaaggcaggctctctgagactgcctcagggggactgcagtggtgctcactttagttgtcgaacgtgcagtgacattcattcaacaagtgtttatggaaggtctacagtgtgccaggcattgtcctaggctatgtggataaaatgatgatgaatgaggtatataaggctctgtcctcccagagcttgttagctaatgaagaacccaaagtcataactcagcaagtccaaaattttaaggttaacactgcggtggaaacttgttttattcattttcactgagccttgtttcttcaagacttgtggcggcaaaaacacacataatgaagttgttagaatataaataagaaacataaatcaagactagggaatatataagtaagagtagagtcaagaacagaagaagaaaaatttatagtcatgcaagtcatgaggatccacttgggctgaacctcaaatttggcattaagtatcctggcagccatatcgaaaagggaaatgtggttagttacaaagttcttattgtcagaaagaaaaagaatacaagttccttagggaaggaaaggctttcctaatacttggctcttgaaggaatgtctcaggcagagcttcatacagcctctaacaatatttctactagtgactacaaaagtggattttataagacatagcttgtagcatcctgcagtaaaagtgagaacataaaactaaagtgcaatttaataaattcatttatgttaggagtaggtggtgagaggtaagttgatttgagccaaatacaggttcaggtgaacctatgactagaagctggaacaccagggaatggagggattttatatccttataacaatctacataaacataatttctctctactgagattttgataattcaaatggttatattttctatcttatgctgtagggataaaaggcaagtattctatgttgtgaataatgtaatgccttataccaggggtcagcaaacattttctgtaaagggctaggtagtaaatattttataccttgggggctagatggtctctgccacaactattcatctctgccactgcagcacaaaagcagccatagacaagatataaatgaatggacacgactgtgccccagtacaacttgtttcataaaagtaggtggcaggtcaacttcttacctacaggctacatagtgccaacccctagtataacctaaaaaataaatgcgattattggtattctttcattgaaattcaggaacaattggaaactttgcaagtcttggtcagtggtaactttggcttcatagtttaaatgctattgggtgatgacacatgatggaaagaacatggctcgtgtctgggttgcaaattcattaagttcgttgaaagaacatgcagatcccaaagcaatccaatacagctattcacacataaaagggggcctcagcagacatggtgctgggattgttgcagcacagaactaggctggctctaaagaaacccttacattccatgtggagaaggagaattaatgatgttcctcacctggaatggtcttgaaaagcaacatggattctcagttaagatctcatggttagtttcctaggaaagagggaagatgctggaccatttccagtaggctgatgcatgctattcacatctttgtcatctttccaagtgagaaatctattccaggctaccagacataggttctaacaatcttctaggcatgtagcatgtagtatagtcaaagacattataattaacctcaggggaaaacaataacattatttcatttttaaaaggcttagttatgagcagataacacatgtttatagtttgttatgacctgaattcttaaatttcccctcactggccaaaaatgaatctgagaatgttaattgtttaatgggaggtacttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaattattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactatttttccctacccacctcttacatgaaaattgtgtacttctcaatatcctgccctttcctctttaaatttggagccttcaaaatcatctttggggaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccttgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggtacagaaacagctgtgctcccagcagtgtgtctcgcagctcctggcaaatttagagagctccatgggcctttagtggggctattttacctcctggaaaggtacatgataatttcagctggaggacaagctcagggcaactccaagcaagtttaattcgttcattacagtgtttgaaacagaaaaattgctctctcgcatctatttgtaatccgtttagaccagcatttcccaaacaactgtcctctcttgactgttgagtggtttgttaattggggtaaagaaaaagcaccttttatagacaaggaaatttagcgttagagtcaaactggtgaaactcccagagtcttgactacgcttatgtaacttttgaatctccagacatttggaccatgaccttgaggtgccaatacagatgggctttgtctctgagattgctacattgtccactctgagaggagaggatataggtggccttttaagttaaggaagcacattgacaaggctaagccagactgtttggcaaagtctcctcatgttttcaacaataaggctaattaagaactcagaaaaatcataaataacacaaccataagcctctccactcccacattcattaaagctccagccaacattaattaataccagaaatgactcactttaatgttgggtacttcaagctatacagctggctgctcctgtcttcttggtgtcttcaatctgggttttgaagcaaggtccttgataagatgattttttcagatgaaaacattggttctacctgccatacttcctttgtggaaaagtagagaaacagagaaatactcactgctactcattttagaggtgctcagaatttctagctataatttgccctgatggagtaagatacctggcaggcttttctttctttgtcagtagtttaggggtttttttgttttgttttgttttgttttgtttttttcatggtctgtttctttggagagtctcaaagaacttggcaataatgggtgctacagatccttacacctgaccctacagccagaagatctgtctggagtaaaatcatcctagatgggacaggagaggctggaggaggctgagagctattctcagggttaccaagagcatgagtgggcaaagcaggtggccagcatgaagcccttggctcttcctctcaggatcatagcctttccatgcaggggatgggacacactctgccaaaataattggttagtgcgtacatttctcccaagatagtaccaaatcatgcaagaatttggggcttaccctgtctttccaaataaaacactattctacatctcatgttggggagggagattaaagcaggggcctaaaagtccagagctacgtacgtgaggaatgatattcctggcctcaccaactctgactcactctgactccgggctattttttcctcaacattcttttccctatttgcacagggcaagtggctgtgatatttgcttatttttatttaccctccgcactggactgagaccaggccattagacaagtgtcacaacaatcctatacacacaagagtctctccctgaggcagtccacaaaagcagtgctttttttttttcttttcccaaggcttcctttgaagctgaaagtctccatcagcctactcttagaaggtcatgtgagtaaaggaaacataagtcatgctggttttggtccccatgactgcacatttctcatcctgttggtggaaagaatttgccactttgaagggttggcgaatcccttcactgacgttgctgttggaatttctgatttcccctcccttctcctcagaagcaagagttttcctagacctggctcgatgggcccccgagtatgtagcacatgatctagctaaaagttttacattaaaatagaactccttgttaaaataccatacatcattgactcaccaacttaagccctattgcataatacatttgagtcaggatataacatagagtaagattttaaaagaaatctaaccacctaggggaaagcaagaagattctctcagcaggccaacctgtcttaattactgctgaactctacctaagcctttaagtgggagcattttgagggctccttacagggttgctttccaggaccacctgcttctgccttctaaaaagcctttgattaactgttgaacagagataaaagtaagatgtactcctgaagctgctagtgttattcctgatcagggcctgactggaaagacctgcttgtgttgctttctcagctaccaaaagaaccccttccaccttctctaatctgcagagattccattgctgatcttgttccaattcaacaggtagtttttgatgttttacccactctaacccaatagccatctacacttaaattattttgcaagagaacagagagttcccttcaactggcttattaatatctggctattttactttggccatggatagtttcttttccagacattttgaacacatgtgaacagagcatgttttaagcatttacactgattgccttgcagacatactcataacaatcctagtgatgcaattaggaaaacttgtgatataatctatatgcatttagaccatactcacatgtagattttccatttgcatccttttgtagaacagtgattatgctatttaagttaatatcaatttcttatctacatcaaaaatattttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggtttaaaatcacaggtaaccagaaacagtacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacacccgatctcaccccagtccttgggaggggcctgattttcccccagtcttcctgaaaattgaggaatttaagtatttgtttgtttgtttgtttgtttgttttttgagaggaagtctcactctgtggcccaggttgaagtgcagtggcatgatctcagctcactgtaacctccacctcttggattcaagggattctcctgcctcaaccccccgagtagcggggattacaggtgaccgccaccatccctggctgattttgtatttttagtaaggacagggttttaccatgttggccaggctggtctcaaactcctgacctcaagtgatccacccgcctcggcctcccaaagtgctgagattacaggtgtgaaccaccacatccggctttaagtatgtatttttgataaactgtacctagaaggctttaacaactaatacctaagaaccaggtccctcatatttattcacctgtcaaaccaaaggtcatctgtcattttgttctacctgttcttaataagactttgtaatccagaaataaagtatagagccattttgttttacataggaagaacatatgatttgtcatctaaaccagaatacagatgctcctagatttacaacagggttacaccccaataaacccatcataagttgaaaatgcattgaatacacctagactgcagaacatcacagcttagcttagcctaccttgaacaaactcagaacacttacattaacctatggttggggaagatcatctaacacaaccccattttataataaagtgttgaatatctcatgaaatgaatactgtactgaaagtgaaaaaatcggtgtatggggactcacagtatggtttctactgaatgtgtatctctttcacaccatcataaggttgaaaaatcattaagtcgatccagccaaagttggggatctgtacttttgtgagcgaaagataataattgtaattatgtttagattgtccccaataaaccaggagacatgattactctagctaccagcctgcatcctctcttagaaccgcatctctttggagatggctttctaagaaaactagcaatgaaacctggaaggaaagagggaacatacagaaatgagaagagtcagctcagaggttctcaacccaggcaggctgcacatcagaaccactcaggcagcttggtgaaagtacccatgctttggccccagtcctagagattctactttaattgttttgaggtgggacctgtagtttttaaaaaatttcccagatgatattaattagacaagtgcatctcaaactaattaccggccaatcaccttgggaatgtgttaaaatgtggattctgactcaggtatgaggagggccagagattttgcatttctaacaagctcccaggcaatactgtgctgctggtccaggagccacccattgaatagcaaagagctaggtgaactgtgaagtgctagcagcaggaccttgaattctttaaaactgtagaatgagcagcacctgtttttaataccattccacacatcgatctctgtcttctagacttctatttctgttgcttattggattccacctgaatgtcttatagacatcaccaacttgacatgtgcaacactgatttcccgccagcctcctgtgcactcctccaaaacaaactccagcatgctgcttctttcattcttctccatctcagtaaatggcagttcctaaaacatgttagaccacctcatagctctgatagaatcctcccctccacctcatttagagaagagcccaaacccttaccatgatcttgaatgacatactggaaatggcccccttctccctctgacctcatttcctatctcttttcctgcttctttctccactccaaccgctgtttggtgaacatgacgagaatgctctgcctcgtgttagttacgatggctgttccctctgcctgaaatgcttttccttctgacatctgcatagcttgtctccttacttctcagtaagggtgtccctggccacctaatataaaatagccctcacatgcaggtacttcttacttccctaccctgctttgctttctccatggcatttatcctcatcatatatatatatatttattttattttattatctgtctccacccagtagaatggaagcaccaggaggctgggactttgtcagattatttccctgtatccccagtgcacctggtacatggtaaatgcccaacgcagttttgccaaattattgcaatattgaccattaattactttggaatctctcagcccaattatatcacacaggaagctgaaatattctgtactcaggatgaatgttggtgctatcatcaggtttcctcctatgactgaggtcttgaataaaataaatgccatttttaaggtccctacaacatgcaggctccattctaaatacatcctttatcttattcatcgttccagtggcctcatggcagaattatcctgctttgctcttgcaggaaaggagactgagtcaggaagcaattcagattcatggagtaggtaatttctggattggaggtttaaactaagtctttcttataacaaaatccacattgtccatgttaacgttgaaggcccagaagagaatttctttttatttgtgcttgagtccaaggctacctctggagcctcagtacagtgttattgagaggttttttcctcagatcaatcaattctgtgattccctgacaccaactgggtgcaacaattctattcaagtcagttctgacattatctggatttagcccagaccccacaagttaagggctcagtctcacaagattgctcctactaggaatgccagctgcaaatggggtgcacaggctacccacatttttgccttgccaactacaaatttagggttttctacaatcccccttcagatttaataattcactagaatgactcactgacctcagaaaagtgcttcgcttagcattactggtttattataaaggctagaacccagaaccagccaaatggaagaaatgcttagggccaggtgtggagaaggagtgtggagcttccatgccctctctgggtaagacagcctccagcaccttgatgtgttcaccagcctggaagctcttcaaaccctgttgctgaagtgttcttatggagttttcactaggtaattatggttgattaaatcattggcccttggcggttggatttggtctccagccctgctcccctccctataggtcacggggtggggctgaacattcaaaccctctaaccacctgtttggttcctctggcagccagccctccacctgaaactatgttggggcccaccaagagtcacccactagcataaagtctgctgtggctgaaataataacaaagactcctatcattcaggaagttccaaaggttttaggagctctgtgccagaaattgaggacaaacaccacatgtatttgttattccacactgttaaaagaagtttagcctaaagctgcctccttacataatttaagtttggcctaaaggtttttccatacatagtgaactatgacctaactggatgtgtaaacagactgtaacctactcttgtgacaagtagctgagtctcagccaatcacagtggctgagtttcagccaattacaggcagccactttttcaaaatatgttcaaataaggcaaaaactgagctgtaaccaatccagctatctctggacctcacttctgctttctgtacttcacttttctttttctgttcataaatgttatctgacgtcgtggcagctccaagttgctctgaacctatctggttctgaaggctgcctgattcaagaatcgtcctttgctcagttaaactcttaagtttaatttgtttaaggtttttcctttaacaacagttgtaaaagtgaatagcgtcttaaaaacaaccagttttctgtactaattttgaattagcaatgaataggattcagaaacattatgaaaataataatgttctaaatacatattggatatcttttctagttcataagggatctagagtgagtagtcaaaaacttggagaataaagtagaaatggatataatacatatgatgtgaaagagaaacagaatggagttcagaagtgatgcaaatccacattcacttagccattcactttcatgacaagacaaagatttttgtatatgtatatgtgtgtacatgcatgtgtgtatgagagcaagatttggggatcatactaggtatatatgatttaaagagctaaaagttgtgcctcggtcctggttttgggtcaagtttggattacagtttatagccccccaaaccctgaaaaaaattatatttcctctccttactttcccatatgtagttaaaaatgaaaacaaattcaattttaaaaataaataaaagatgttgttatttaaaaagaaaacctgagcaaggatatattaatagccatatatatgagggaaaacatgaggaaatacctcattttatttttctcctcagaatttggtcggtattgctgcactttggaactatgggggagggcaaagtgttgaagagagagttgagaagagaaacacttggtgaagagttgggctctaaactctatgaccaagttaaggagctggctcattccacttagacgagaggcgtgacttggaggtcttcaggaatttaaggaataatgtgaggcgggaaagatgaccagctgttctccataactaatgaatatgtaatttgaggaaataaactcaagctgaactggaagggattcacgttgactgttagaacaatttctcaactgtcaagactcctgcccaattaggatggctagtttgtgcttttctaagtctctttgcctacatatattcaaataattttaaaacaggggcaagagtagaaagtattgagcaggataatgtctcaaagtatgtgtcagccttaaaattttagttctgtaattataatttttttttttttttaagaaacaagaaacaagttctggtcaggtgggttagatttccctctagtggtgttgaaaggaatttagtatggctgtgttttcataactggctcttggggcggaattaaacttggaaagatgcaaagatgtataggtttttttctatttctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatagaccagggctttttacagttttgatgacaataagcctttttcttggccaaacattgtgatcagatctcctttcaaggtactgagtatgcgaagccctgtgtatccacactccacatggtctaggacttgtgggaaactatggactgccaccgtgaaccactcatgttaatcccacagacagagcccatctcaaatctctctttgtggcaatatatacaaaagaggcccttaattccaaatcttgcaagaataccggcattgccagcttatcccgagaaccagtggtcttaagaacagaccactgaagagccaaaaggcatgccttgatcctggctttaggtcaagcttggattacagtttagaaagcctggaccctaaaaaaaattatatttctcctttctactttcctatatgttgtttaaaataaaaaacaaaattagctttaaaaataaatataaggaaacctaaaaatgttttgatttttttccttataatgctattctaatttctaaaatattaaatatcaacttcttaccaaaatatcttttgttttggtgccagttttaccatgtctaaagcacatgcttaaccagctattggttaacccagtgatgtttatatccacaaatcaccaagtcttgctggatcttgtttactcagcctgaaaaaggagcatgaatgaatttgcagcggtcacacaagtccagaggtcactggtcatcacttctcttgccagatggatgggtttgacaagctgtgtccagcacaatctgcctttcccagcagcctttttgttctagcccagatgcacagcacaaccacatttccgtgcctttcaggagaaagctacccaggtctcatgaactggtggtgattcaggttttctttgaagtggtgtccttccttggtgtacagtaaataatttgctttgcttatataataaacaagagtgtatcttaacaaatggggactgacagtgaacctggaggttgcctgtggccttcagaaggaagctctggactagtgtgtgcaattagccagcatctggaagcagcttttcctgggcttcccaacacggtcatgcttcattcacatggggaatacaggatctgagctgttaaggggagaatgtggctgtttttgctctcccgtctactcttggctgaatttaagtttgatgccctaatcccagaacgagaactcctgttcaagatgcaggtgagggagtttcccatcccttgtttttgactcccaggaacgctggcaggcctgacaaactccagggaggagcatctcaaagccagaatgcttaggccttgggcaggagggaaagctgttaaaggtttatacaattctggtatcgtgtttgtgtttttggttttacttttgagcatttttgttggtacaaatcatcacttgggacatactttggcaggttgggcctgtgtactataccatcatgatatgagatggaaggcagatgaggctgacagagtggcttgaaatgtagacttcattattattcaggtatggggaggccaacagatgatgagatgacggccattgaagagatagtttgttactcacagttcccaagaggaggggacacaacacgccacacagggccacgcagggaagcgccagcgtcggacaggaggcagcatgagcaaagggaaaatgtgggtgaagcctttttggagattctctgggaaaggtaaggtaaacatgatgagaaggtttaggattagcttgtttgaataatttcagcaggctctggggcatagggactgtccctaatttgctggtacctagccttggggtggttagggcagagaaatagtggcccaagtgtgagagccctgtgagggtctgagaaaggaagtgtttggtttgcatctgaaaggcaagctccagggtgtgttgtttgctgtctctaagaattagctaaccctgggaagaacaaaaccttccagagtcagccaggccccaagatgtcaaagcattagaataaaaacaccagcttaacagccagaggaaaagataaaaccactgtcactttctcaggtgggtaaaattgttagggagcaccccaacaagattttgtttttttcacataccatcaaagctggatggcctctgatacaaaggttgggctttgaaatcagcatttttttttttttttttttttgagacagagcctcgctctgtcactcaggctggagtgcagtggcgcaatctcagctcactgcaagctccgcctcctgggttcacgcccttctcctgcctcagcctcccaagtagctgggactacacgcacccgccaccacgcccggctaaatttttgtatttttagtagagatgggctttcaccatgttagtcaggatggtctcgatctcctgacctcgtgatccgcccacctcagcctcccaaagtgctgggattacaggcttgagccaccgtgcctggccgaaatcagttatttttgttttgagtcctagttctgccattttccagttttgtgatcttgggcaacttaatatcagtcaaattgagatagatatacttcttattttatattgttgtaatgattaaatcagataattcatatatgtaaagagttttgtacaatgcctgtgtaaatcaaagaaaatgaccaagatgagtctcaatcgttttagaggtttactttgccaggttaaaggtcatggcctgtgacacagcctcaggaggtcctgagaacatgtgcccaaggtggttgggttacacttggttttatacattttaggaagataaaagttacaggcaaagacacaagcaacacatgtaaagtatatattggcctggcccagaaaaacaggacatgtcaaagaaggggaggcttccaggtcataggtggattcaaagattttctgattggcaattggttgaaaaatttaagctttgtctgaagaggtaaagtcagtataaacaaatgcttgagttaagataaagaaagttgtggaagctgaggttcttgttatgtggatgaagcctctaagtagcaggcttcagagagaatagaaggtaaatgtctcttattagacctcaaaaggtgtcagactctccagagaagatctagcaagggaaggggattctctacagaaggccgatttcccccacaaaagatggctttgtagagccattccaaattacgtcaaagaaatatattttggggtaagatgctttgatttccttcagtgcctgttatctgtcatctgatgctatatcagggtcaggttggaatttggtatcttactgctacaaagagtctgttctgtcagtcctagaatctctaaatgtcaacagctaagctccagagaggaggatatattgaggcatatgctacgcccttttcctgttatggcctgaactagttttcgggatccttttggccaatgattaggggcagggaggagatgtccattcagtcagtttggggcttagaattatatttttggtttatacctgacatgtgaataaatgttcaataaatgttgattgtcactaatgttattgtttttgccctttttttttttttttttttttttttttttagatggagtctcactctgtcaccaggctggagtgcagtggtgcaatctcagctcactgcaacctccacctcccaggttcaagcaattctcctgcctcagcttcctgagcagctgggactacaggcatgcgtcaccatgcctggctaatttttgtatttttagtagagaaggggtttcaccaccattatttttattaataatggtattgactcattttcttatcacatgaggataaaagattcccagattacttagcaatttgttttataatgcaattgacttgtccttttccctcccattaacatctcagagaccaaactggatctatgagaaatgtcccaagagaactgacagcttctaaaaacctaggtcttctctgagagctcccagggctctcatgacatggcattttagatgtaccatgctttgtcagaaggttcaaggatgaagtggagtttctctacttgtctctccattcatggaacaaattcactgccctcctggcttggagtaagaggtagtgagtaggggttgttcaatgatttcatttcatccaaataatgtgcaatctgttggttgttccaagctcttttaccagagagaaagggcttgaacactggagtgggtgtgtgatgaaaggcaggttcattgaagaaaggatgcctgaagtttctttgactagccaggaggcatgtgctctctggcttcaagggattaaacagaaaaactggtcccttggagcaggagtcaagttttttctgaataggcccagagagtaaatagtttaggctttgctagctgtattagtttgctagggctgatataacaaagtaccacaaactgggtggcttacaaagcaagaacttgtttcttattctggaggttagaagtctgagatgagtgtgttgacagagctggttccctctgagggctgtgagggaaggatctgttgatctgttccatgcctctctttttggctcatagatggctgtcttttccctgtatctcttcattatcatcttccttcttgtgtgtctctgggtccaaatttccccttttaataaggacaccagtcatattggattagacctcaccctaatgatctcattttaacatgagtacctctgtaaaggccccgtcttaaaataatgtcacattctgaggtattggcaattaggacctcaacgtatgcacttatggaagacaaattcaacccataatattagtcgtatggtctgtgttacaacttctcaactgccactgttgcacaaaagccgccacaggtaatacataaatgaattagtgaagctatattccaataaaactataggcactgtaattgacttaagataattttaacatgtcacaaaatcttatttttttcccaaccattaaacataaaaaccatttttatggctgcaccaaaaccaggtggtggccagggtttggcctaaggcctataatttgttgatccttgccttataggtttctgaatatgacacgttatttacaatttctgattacattcagtacagcatgtatcaacatgagtttgggtaaaccatacacactataaatttcaaaattacatttgtatttgtgtatatttgtatacatagatgaattgtgaagttttagggaaaaaaatatcaaatctctctggaaatctccagcatgaggcttctgaggttgaactccatagcttttgattgcaaccaaacatgaaagggaaatgattatgtttgtattcatgaaatcaaattcctttttcaggtcttttgtttcttgtcagaagggttcttcatttttctttttaaagcaattgcttacacatgattttcagaagagcagcactatgtcagaagaaaagggaaaaacgttaagaaataaatgggatgaaaaaagaaaagtatgaatatgagccctggtgaattcttacaaagaaagggaagcaaacacgtgacattcagtagtgaccccaagccagggagtgctgtgacattgcatgtccctgtgaatggggcttccgggagctgataacaaggttctagtgcatttcagtcacattaacagtgatcctcaaacccagtctccaaggaacctcaccccatttccctaggaagtagcaattctgttgtttttattctttctttctttgcttttaattatattcttgggaattacagtcaggacagtcagtgtggtgtttaacaaaagctaagatactttgatgatatactgagatttcccagttatacattttagactgtctttgaccatgtaagtgtttctatattgttgaatcaagccgctggctctgactcatatcagcccatgtttttcagaatttgcagtcattatgaattcactttccttttaatggataagatttgataaaaagcttaaaagaaagtacttttacactgtttttaacagcgctttatacttttgctacactaaaggtagttcttggactagcagcatcaacatcacctggttgctacttagaaatgcagaatctcgggccccaacccagatctactgactcagattctgtattttaacaagctcctcaggtgattcatgtgcacattaaagtttgagaagtcctaatgctgggcgtggtggcattagcctataaagtgccatctactcaggaggctgaggtggggaggatcccttgtgcttaggagttgaagaccagcatgggcaacttaaggaggccctatctctaaaaaaagaaaactgatgctggctgtactggcttaaacctccaatcccagcactttgggaggctgagacgggtgaatcacctgaggtcaggagttcgagaccagcctggccaacatggtgaaaccccttctctactaaaaatataaaaattggctgggcatggtggcaggtgcctgtaatcccagctactcaggaggctgaggcaggagaatcgcttgaacctgggaggcggtggaggttgtggtgaaccaagattgcaccactgcactccagcttgtgtgacagagtgagactccatctcaaaaaaacaagcaaacaaacaacaacaacaacaaaactggagggaaaaaagggcaagaagtcctgtgatggatgacctttgggatccttatttccacctctgcttagcaggactgacattgtctccacaccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaacaagaaaatcagtttcaagttgcatctccatagaaaccctttctcaatatcaactcagcagtgttagacagttttcttcacacaattatactagttgagctgagagattcaaaataacagtggatgaggtaaagaaagttctaatttgattttgccaaggcacaaagccttgctaaaattgtgggtagacagtctagcacacttcaattactaggaaaaggtcaattatttaaaacactttaaatatgttaggttaaatggcagctgagtctaaaggcaaaggccataaaagaacatgttcctttgtccaaactgcattcataaagtgtgcattaaccatccattaatttcactaatagtctttctattgtggggaagagtctctcctcgtttacagggctcatttccatgtttttagtgcctggtgttaatgactgtcccactactgcctcctccgtaagactcaggtggccctcacggcagaagttctcttctagtttgcttctgctactcaactctgccactcagctttgctcaatgtggaagtccttgctaacttctttagaatctgatacacccttaaggaatgtgttccaaaagctatgatgtctgttccttctgttgtcaacatcaccttacgcaactgcaatctgattgtactctctctggctggatatatagggcctgttgcacacaaacagaaatgcaggcaagctttcccccactgggtgtgtcactgaccctcttgctgacacagagagatgttgcctctgatttgagtggctttctcactccaagagctgggaacaccccaacattcttaatctctttttattttatcttttatcaaaaagataacatgaactttattttatgggcaaataaacttaagctagaagggttgttgactatctaccaaaggtcagcttattgggactggtatgctggtccactcacctgtagcctacttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttgtacaaataagaaaactttggccctgagaatttgaacaatctactgtttctaaacagtgtccctggtatttgaacctagatttgggcctcagagcccaagaccttaactaaggtccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggttacctcaagtaggctgtggggtggcagttaggcgaagtacagagagactgtgaactcttctcccggagaagcagcatcaccacctggggtgaacctcaccatgggtgggcctgagaggaggtagtggggtgggcctccaccatctggccactgaggtccctgcctgggccttggcagtccctcaacatgggagggggaagagcacacactctcaggactccactcagccaggagttctccttgccaaagtgggcctggggtctcagcctctttgctttgtgacgtccaccacacagctgctttgccagctctagtgtgctcctaggagggctgggttgagtggagacagttcctggatttcatgtttatatagttctgtttttttgttttgttttgttttttgttttttgttttgagacagagtttcgctcttgttgcccaggctggagtgcaatggcgcggtctcggctcactgcaacctccgcctcctgggttcaaacaattctcctgcctcagcttcctgagaagccgggactacaggcatgcaccaccacgcccggctaattttttgtctttttttttttttttaaatagagacggggtttctccatattggtcagactggcctcaaattcccgacttcaggtgatctgcccgcctcggcctaccaaaatgctgggattacaggcctgagccactgcgcctagcctagttctgtgttgtagtcatgagcagttgagtccatgctgagagtttgcatctcagggcataggcataataggggacggggaggactgcagtacctttactccccaaatggttgctgggctcttacgcaaatctgccagccctccgcagtagtcttcaaggccctcataatacaaaaatctctatttcagaaaaagagaaaatttaaattagaatgccccagattcctggatatgtaactatccaggtaaaatttatacttattaatattaaaattatttcactgcctctagtgtactattgcttgttcagtggtagcaaattcagtcacccaccaacacaggcagtaagtcctagattggggccaatttaagacaatagagcatggtgggcactctggtgatgctcagctgtctttaattattgcattgttaatatgtgagctcaaggttgccaggttttctgattttaaaaggagcaagatatctggactttcaaatgaaatttgatttttaaatattggcaggaaaatgattacaaaacaacacaaatcccatatgaaggacttctaacttttagtagtggtggactaggtgattcaaactaaccttccctctgtaaagagctgaaagaaatatattaaagcatcttattaaaagcatggttgaccaatgacctaataaaacagtaacaagaacaggaaaagggttggcactcaggaaaatgagccaaagctctttctgtcctagggaatttgtccatctaggagaggtactaaagaagaggtgcttttgatgactggcacagggtaaaggtgacaggcatcaggtccaggtggaggaggatctggtctattacagtctgcctctgctaaccaggagactaaccaaagaggcagcaaagaggcagacctgtgtggcattttcgtgtggccaaaagaaatatggttagttaagtacacatcaaaggcagagatcctggcttaacaatccctgctctagggtgtaaacttgaagaagaccattccaaaggtggtatacagactgtactccagaggattataaatccatggctctgatcttctggctccctgaggagtctcatgaaaggaaatgaaggaaactaacaatattctaggtctccagttatttctataagcaatttttcaaacaaaatgggcaccaaacaataaaagattataaagcacttggatacacaaagcaacacataccagaatcaacagaaacaacataccacagaaaaagatctatagatactggaatttattcaatacacactgtaaaatagttattttcactatgttcatggaaataaagcactgaatgtaaaaacatcagcaaataactgaaaactataaaaatacaccaagatgttgaaattaaagagctgagaaagataaccaaaattaagaacataaatggatttaacagcagctgaagaatatcagtgaacttaaaatatttcagaagaaactatgcatctgatttttcagtttagtccttatgatttgcagaacaaagaatataagattgctgcctttggaagatgaaagatcatattcggaaaaatacagaatagagggtaagagacacaaaggatacagtgagaagtgctaacataatttagttggagtctcaaaagaggagacagaaacttgggtataggcaacactggaaaaaatgataggtgaagatttcccagaaccaatgaaggaggtcagcccactgattctagaaagccaagcaggatatataaaaataaattcacatctagacacatcaggctaaaattgcagaaaatcaaaggcaaagaatagtttgattgacaactaatttttctttatcaacactaaaaataaggagactgatggcttagaactcaatctagtgaaactttccttctaaaatgaaagcgaaataaacacatcttcagataaacaaaagctgagagagtatctacacaaaaagaaattctcaaggatattcttcaggaagaaggaaaattatcccagatagatatttggaataaaatgcagcaaggaataaaagaaatgttaaaaataggagttggtataaatgaacattggctgtataaaatattaataattgctgaaatatgtatattaattaatatggagaattaaattatacaaccacagtaactaaacaccatgagcataattgtagttaaggtaagatccttgaatatattggaagaaaataaaggtatagataaatactagactttgataggtcaaggattcatgttgtagtttctaggtaacgattaaaaaaaatagaaggaaattacataacttcttaagagaggaaaacataggaactttaaaaaattgagaaagaaaaacagctaggtcaatttcatccatgtatacatatgtaactaacctgcacaatgtgcacatgtaccctaaaacttaaagtataataaaaaaaaattaaaaaaaaaaagaaaaacagctaggtcaagtaaaaagcacataaggtggtggatttaaacttgaatttactggttattactttaaatataagtgaactaactgctgtaggaaaaagacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctgggaaattgatgatgcagtcagccatgatcataccactgcgctccagcttgagtgacagagtgagaccctgtctcaaaaaaaaaaaaaaagacaactataagctcgttataaaaaatacatcttttatacataaaaatacagaaaatttgaaagttaaaagacggaaaaagatatacaaatgataacctaaaactagctctattatttcagataaaatagactttaaggtcaaaagcattgctaaagataaagagagactcttcaaactgataaaagagttaaatcccccaggaagacacagtagttttaaatttataaagaaaaaaaaaagagggagagagagatgaaaatgtaagaagaaaataaatccacaattgcccttgagtattttagcacccctctcagtaattattagaataagtatacaattagtaaagaacatagaatatttaaacaacttagttaacacacctgacttaataggcacatatagatattacaccacgcaacatcaactcaacgtgtaaattcttttcatgccacaggggacacgtataaaaattacctatatgctgaggaatgaaagaatacagagtattataagggcaactgaattcgaaaatgaaaacaaaattgacacaaaaaaagcttttgataaaatgtatcatctcttcatgataaaaattctgtgaataggaatcaaagggaagtcctttaatatcataaaacggtattgctaaagaaaaaacctggacgtaggctatatgtgctgacagtatgctaacaagggagaacgacttgatgggttcatttagaactcaaataggctttgtcttcagaaggacaagcatcagttttacatataattagagtatgttaaattgtttgcatttccctgtgattgttatatttaataatccttaaaaaggtaattttcaaatagtgtgcctagaaacagggaaacttttggcattaagacaaatatatttataaactttcagaaaatgaaaacttttccctcagtataagggcagtctagatagtgagatacagcctagctttgaggttaaaaatcacagtactgagtaggttcagagctcagctttgccacttgattgccatgtgactgcacaagttatgtaatgagtccaagcctcagtttcctcatctgtaaaatgagaataataccacctacctcatagactgtttagagattaattcaatacatgaatttggaatagcacttggcacattttgggtactcagtgccagctattacaaaattactaaagaatcaaaacttagaatccaaggcacaaagtatataaaatggcagtgaggactgagaacactgatcgtggcttccgaagtcttttggagaagaaagggaggaaaaggaggaaaatggagaatggagagagtcctttgagtaacaaactggagaggcaaaggtccttttgtttttttaacctcggtttcaatcttgaagttttatttctgctaaccatttggtaaaggcagaggagatcctaatttccctttgacctagcaagtgtattccatgtgaaagaaacctggaagcctagtgtggatatacccaatgaagagaaatgtgaagacatgtgagggacatttgggagggatggggatctgaaccaattagtaattccccatccttttacaatgttttggtggcagaaggtgaggggagaggtggatagaaagaaagaagagaggaacagggaaaccatggccagggaaacagtcctaacaatttaaactgacaactcttgcaggtaggtttgtagtattcagcagcacagtgaaagggctcagagattgtgcctaaagcctctcagctgctcctacagacagcggccagtgctcttgctctctccccttctccatccacacagggcatggagccaattagagctcacatttgaataagaatatcgggcctggcacagtggctcacacctgtaatcccagcactttgggaggccaagacaggtggatcacctgaggtctggagttcaaggccggcctggcccacatggagaaatcctgtctttactaaaaatacaaaaattaggtgggtgtggtggtgtgcacctgtaatcccagctactcaggaggctggggcagtagaattgcttgaacccaagaggcaaaagttgcagtgagccatctgagccttttatatcaggggctcacatgaacaagtctcttgtaaaaagaagctctctctgatgaaactgagaacagatagcagactcacgcaagctccggatggtggggcagtgtgttaaggaaacaatggggatgagaatgaggaagtagatggggagaaatagaatcagagggtttggcaactgcttggatgtacaggaaagggagaaggacccaccaacaagtacttccagctgagcagattgagagttcagagggacctgctcctagcaggaaagagaaggtggaaccatggactggcatagcgaggaagttaattttggtttgcaagatgttacatttcatattttgggtttgttggtggtagaatactggaccatgatggtacctccaaacaatctaagagaaacacattttgagtgtttatcttattaattgtgattttattttaatttgcttaaaatttttgattttaatacgcaaagagaccaaagttagctcaagaaagtcaagagtagggtctgtcacatgtccaaatctcagagactagacctggagtatggttaccacctcaggccttcctattgggaggtaatggatctttagagataattgggagtcatgccattgttttctctctaccaactcctttattatttccttctgctctctttaattcttctcctggtttcaccctgctttcttataattttttgtcacctttctcagagtctctgctttctcataatccaggattaccatggagtcttatgccctcatggttaattaattataacctcgtgatttagttcccactactaactgtccgttctttcattacttacagttcaaatccccgaggcaaataatctgctaggctaggtgaagtttttgccccaggctctattgtaggttgctagccagcctctctattggctgcctgtaggtcagacagccacttctggtccaatcagctgcagccagggagtgggatcatgtgatgcaaacaatgcagcctgggtttgggctggagcaaagcatttgacaggcacaataattagagtaccttagagcagtggtcctcagagtgtggctcctggaccaacagcatcctgggaagctgttggaaatgtcagttcttgggccccaacccagaccccttgaatcagacactcaggatgaggggtgctgcagtctccactttaacagacccaccaggggatactggtgcatgttcaagttcaagaaccactcccttagactatgcaaaagcatattgactaaaaatgaatgtttgcatgaaatctggagagaaagcctggcattcaggtttagcaggttttaaacaaagtgggagtgttgttagttgatcctagggatcaggagaaagtagcatttgttataaatctctattttatggatgccagaatgtcagtgttttctgttgttggatgacctacctgcatttctggtttgtattgcctgccccgaaagatgaactatggtaattatcgtcatccacacctattcactctccacccatggctccaatccttccccgactgtacaaatgcacattcctcatagagaccagcccagcactaggttccctccacagattctgacaaatcttgcttgataagtgattatgattctggttagggtattgttttcctccgaaaaatcagttaactatttactttgagtcttgtgacattcagatcatttacatccttcctgtctattgcttgtcccagagtaagaagttcagtttgttagggttgttttttttttaatggatctaatttacatgaaagtggattataacaatgacataaagcaaaagagaagatgggagagaaagtaaaaagagaaactctgtctttccagggagtatggacaagttaaaacctaatctaggatttatgtgggctaggattaatgtgaggttaactgggtgcaaaatttaagtgggtgtggatgccaaaatactcagtaatcaagataaatatcgtagtgcaatttttaaaaaatcaaaatcaatgtccaaaaaattcatgataaacatagtgtcaaaactttaaatagagagaggatccaataccccctgtagcctgtctacattaatggacagcaaacatccagaaaaccctgcaaggtggcagaagatgccatcttgaaaggatgcaaggcctgcttggtttggagcaagataagcgttcactgcttcctactgttgactgtagaagaaatatgttaggcactctaaaaaacactggaattagaaaaaacaatgctatactctaacataattgattaaagtctccattaatttatttcctttattcacaaagggttattttggagtttccaggacattcacataacccacataactgagaacacctcttctcccactgtctgcctggttttggtcagggaggaagactggtcagtcctacccaactcctcatctgatgtgggactcatctggtccaatagggttgcaatcccatgatttccctgctcctccccattcagtgcattttgtctttctctctttatccttgtcactctcagatcttatatgcagaactgtatgatggaaaatgcagtagaggagcccactgtatgttcttatcccagctcagccaccaaacagatgtgtgaccgtgggtcaatcctgtgtcgcactgggctttagtgtcttcatctgtgccatgaagaaatcaaatgacaccaatccacattcctctctgcttttgaaattctgtgcttccagctccatgttagaaaactcacatccacagttcataacccctctttttgctcctcattccaactgcctctccaattgccccaggaaaattaactcccacccaccatgaggcatggtcgatgacatgagagaagagtttggggtttacgtgtatcagaggagtgatttctaaagaaaaacatgagtaaaaacccggcactgttgaccctcccacatgcacacaatgtcctccaggaatgcccacaggagtctctatttgccttatcatcttttcatcaaatatatcattcatttactccacaaagatgtattgagtatctcctaagcagtagatactttccttagccctgaataagacaaagtttctgccctcatcatgtggccactcattctagcacatatatactgtcatgcacggcgtagtgatatctctgtcaacaacagaccacatattccatggtggccccataggattggaatggagcatgtatagaaacctgctacatggcacttgatattgatgttgcgaatcaactaggggaaatgattgatatttagtgatggtgctgggacatttggtttcccatatgaaaaacaatatataaataaaaagatatataccatctaggtttgtgtaagtacactctataatgtttgcacaaggatgaaattgcctaacgatgcatttctcagaatgtatccccatcattaagtgatacatgactgtttaatttatacactcagggaagaaaaaatatattagtttattagccttaaaaatgggagcttgccgggcgtggtggctcacgcctattatcccagcactttgggaggccgaggcgggcaaatcacgaggtcaggagatcaagaccgtcctggctaacactgtgaaacctcatctctactaaaaatacaaaaaattatccgagcatggtggcaggcacctgtagtcccagctactcaggaggctgagacaggagaatggcgtgaacccgggaggcggagcttgcagtgagccaagatcgcgccactgcactccagcctgggcgacagagtgagactccttctcaaaaaaaaaaaagaaagaaagaaaaaaaaggagcttaacttgaagtttcctttccagaaagctggcaaaaaattcaatcttgggtatttttagggacttcttcccaggccttcctggggtcatacaaaatctaaagaagttctgtggttcctggaaaatggctgaaaagactgaacatcagtgaggtggtcttcttcccaaacactcatatttcccggaaggcagatgactccatggcatctgtgccggattagcccaggctcttggctcaggatgggagtcctcatatttaggagtttcctcatgtggcattttcttcccttcagcttgcataagcaccacggaagccctcttctctgacatgaacagaagaagggacaagtgcttggttgatgaatccagaaacagagttaagtaggtccactatacacatagatatcctattacatttgtatcataaaacatataaatgtacatgcatttgccagtattttgattttggcccaagacctgttctttaatatgagcatactgtttgccattgtgatcctctttcttcaaaagattcccactcataattcatcatctataatatctgtctttgattcctttatattacagcgggaacttaaggacaattgtgaagcaacctgaaaaaataattcttctataattttaaaatttctccctaatattttgtagtatctcacccacatctaatttgacaggattagctaatcaccattatctgttctttccaaaacactcaacttaattttcatagaaaaaaagtcttcttatttgcattcacgtttcattggtttacatataattaaattgcatagtctcaataattagtacaataggcattaacatattgggaacaaacttaactgactcctgataaacacagaactcaactgctgaagggagaagtaggtgagcatattagaaagtgatcttttggtcacggacatctagtgagctacggacgtgagtcaggatgttttactgaagaagtggaaagcacgcgttagtttgtagagttaagtggagatcagaaaagagaacttctctggtgtttacagtatttgttaaaacttgcttccccgcccttttgccaataggtaccaccacttaaagatgtggagtcaaaaaatcttgaaatttacaatgatgtaaaactgaatatgttttaatcctttagttccgtaaggttcaaattcattttcattgcattttcttaaaataataggatagtatatgtttatctttattcaccctctaaaacctcagctaaagtgattgagtttaacttcactctctttttctgtctgagtttaacttctttgataggtgttaatgaagaattacataaccaaaaagggggagcaggaaagagggaagagaagacaggaagaggagcaaaaactaataattgaatttctgtacaaaatgggcactttgctcctaaagaatagagatccctctatcttggcatcacatgggatatgtcctggcaaaatgtgccagtgtaaaatgtttctgggcaccaacagggttattaagaggaaaagaatcccttctgtttttacgaatcaagatgatcaacacggaaccggaggaaagtgccactttcttgtgttctagattttcatttttcttccagcttccaggagtctatgtgagcttgtccatctagccatcttcatagagtaagataatttaatacatgtaaccataaattgctgccagatcaatatttccaaagcacagctgtgatgtcacctttcagcccaaaacacttcaatgcctccccttgcctaatgaattaaaaccttacacctcactctagcatttaggtccctcccaacaagactggctcacatctctcaggattcttctgtatctacatgccactcaggacacaatggattgcttgtgatgtcttgtaccttgtgcatttccttgtgttcctgttgtgtggattggaatgtgtgcactccctttatgcatgggaataggttagggcccacaaggaactgaattcctctccccctcccaaaatgcaagccttcttttcctgaattacagaatttttgtttcttccattatcctaatattacccaaacttcttttctatcagtatctctatattaataggtgtctttattttttattttatttttattttttctttttagagacaggcagggtctcactttgtcacccaggttggaatgcagttatgcaatcatagttcactgtaaccttgaacttctgggctcaagccatcctcccatctcagcctaccgagtagctaggactataggcacacaccactgcactcagctaattcttattttttgtagagatgcggtctatgttgttcaggctggtattaaactcctggctcaagtgatcctctgcctcagccttccaaaatattgggattacaggcatgagccaccacgcgtggccaatatttgtctttaaattgactcactttgtttttacctcaatctacttatttattataaaagtactctacatggaaaaaacaataccacttgataaatataagcacatcatgaacatgaattcaataaaaacattcagtgacattacattctagctgggtaactcctgaggcatgcactatcttggttaaattgttaaagattggcagcaaacagagtttctccttgatgaaatcagaaggattgaagaacggaaaatagactgattttctcactgttttattagcaataccatatccatgcaccactgaaaatcattgtgagtgttgcatgctccacacctcggaaaacaatgcctcaatcccatgaaacaataagaaagaaatgagtcttcctccttctcatgtccttcaacttcccaagaacctattccttaggcttctaaagcgtgcccacctcctccagaaaacccactgaggtgcctcataagcccagtgttacgtaatgggaaggcatgatcagtcatttctgcaacgttggccaatgaattggtctgtcatttcagaaacatcaggattgtgggttctttaaatccatggccctaggatgaagaatgagcttttattctcgtgtgtgtgtgtgtgtgtgtgtgtgtgtgtgtgtgtgtgtgtgtgtgtggtgaggatgagggtgtagcagcagaagactggagtttttctgaactcccttaattcacaatgctgtcttcatacagtgctctcatgtttggtagttgggttgtacattttcctattatagataaatttcttttgaagctggttaagactttggagatcaccttctccccctactctcctgccctgcccattccaactaccattggtggaggaggaagcaaatgtcctgctcatgaagactgcctgtaaacagtgaattggaatctgagtccagatgcttatggtagaaatccatcagaatgccccaaaatgtaactgacttgagttgttcacagactttccttttccttttgcaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggactttagtggccaataaaaaagaaattcctaatttcaaccttatccaaggattgtgggtttttacttatttgtttgtctcaccagttgagaaactccagtactggtcacctatcctgataaatctgcctttcagaaaacctgcaagggctgtttttcactattatggcaagagacatgtattaaatggaacagaaaaggtaagttactcaaaactgcctttgggagtcagcagaaactgaaatggcatctagacctccactgtaactgtcttcatttcaaaataataggaaggtggctttgagctgagattctaaaacaaaaccatttcaagattgatcaccagtggaatcaaattcatgtcatagctttggttctcaggttcttgtctcaagagtggacatctatgctagccatccatgtgttcattaatcacggatgtcttggttgggacgctcagatgtattcttaggtgtatcagctctaggtaagaaaatatttattttctcaagttgctgaacttttaatgatctctaacttgtaagttcatatgtaaattagtccttacataaaaattatatttctttattttgatatggagtcatgcgtggacagtagcccaaatatatatttagccatcag

SEQ ID NO: 15730 - DNA, 12462 bp, Human
tggctctgccctggaaagggggtgacctcttgcctcgaggggcccagggaagcctgggtgtcaagtgcctgcaccaggggtgcacaataaagggggttctctctcacttggcttgtatccaaaggctactccaggcccgggtgcccccaccatccctgctgctgggcgtggggggagtgtctgggtcatcctgcatcactcacctccagctggccagatccctcaggcccccagtcagaccagcggccatcttctggcaccctccctgctccctggagggtctgagagcccagggggaccaggggaagacatggctgatgggcagactttgagggcacagggtgtgacagccacccagatggtgaccccagctgccctgtggggatgtactgggcaggcttggctttgggccaagatccagacaccacccccgcctacccctcagtgttcagggaagctggctggggagaagttgggtgtctcaaggagcaagggtctgcccatccctgggtgggggctgggcagggtagggaaaatagctttcctttccctcctggtgaaggaaaaagaggccactttaacccagggaatgtgcacgctggtcccgttcccactacgcgctgcagcttatgtgtgggggagggtccaggccatttggggtcaggcagtgtctctaaggaccagggacagtctgtgcccttgcttgggtcttgggtaggggtggaaaccgtctgggagttgggggcctcctggggcctggtcagtgtagtggtcaatcccgggggaagtccagtgttggcggttgggggtgggaggagaatggtgacacagccccacctcagaagcctggtccgtgcagggcctgctggacccctgagccccaccacggggagtaagggggacagcgtggaagctgggcttcctggaagaggtggatggagtgccacaggcagcccagggcacaaagggtatgggccacaggcagctgtggtttgggtggccctgggctgccccgctcactggtcacaagctggtgaatgccgtggagcacggcccaagcccaggtgtaaagctactaccacccttgagcggctgagctgctgattcatggcaggagggcggggcagaaggccctagggatcctgttacccaccagcccagtgggctcctggggtgccccaacatcccttctgagatccaggttcctgggctggtgaaggggtgtcagggtggggctttgccctcaggagcatctggtccaggatggggccagacctatgggaggacaatgcccacacagaggggtcaggcggagggccccagcaggtccccatccctgctggagagagtgcagccactctcagcctgggttttgcaggacaggacaggcaggggtgggatgggcagagacaccagtacttgcaatgcttggagcaggcaccccacagatggggggagcagggggaggagctgggggtccaaaagggcccacggggacctatgggactgagaggcccggggtcagtggccacaggagtggggttggggatgcagcctgaggagtttgggggacagacccctccgtgtagaaagagggatacaggcaggacaggtgcagatggaccccttgttgggggacggatggatcaggctcagtggtagggcatccttgggggtggcctgcgaagttgaccccgggaacacagggctcagcccgacttgcggctgccatagaagtcagcgctcaggctgtcaaggatgggccctgcgccctggagccgtggggagttaggactggagcgggcggggggggggggggggggctcctgctgagacccccccagggcggggaagttcagccaaaggggagaggctggcagaggtatctccgcgccgcgtccggccctttatggggacgaagctgcggggcggcgctcccctccccctgcgcttccccccaggctccggccctccccaggctccggccctcccccggcggcggccgcctcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtggtgagcgcgggccgggcggggcggccggcggggcgggcggggcctgcgcggggtgcccggccttcccgctaagcggtccgccccgcagctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgagtcgcgcggccccgctccgggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccgttccccatcctccgccagccccgggaaggactcagccccttgactcggcgcctcagccaggccctggtcagggaacacgacttggccaggcccaggggatcctccaggtctcacgccaagccttgcccccagccaggaagcccgcggtgagagcatgctcccggcgggaggattttcctggaaggggcaccttccctcttccccatcccctttccagcccctctgtggagcccactctgctgctgtccatctcccgagtcttccgacccggtggtggagggggaggaggggggcgccagaacgcagggagtgtgttgaaccctcaggagcccctgggggtgaagggtttagggagctgctgtttgaggagcactgggcgtggtggccgcctcacagacaccctcctgtgcgttgtgggggcccatcctttccagtccttccagtgagatgccacgtacagctgccctgggcctctcccatggcggtggctggctgctaagaacccgatctctctgccaggggtgctctggtttctggatacagtcccacttgtccactgccccccacgtcactcctgccctccccctggtctgggcccagcctgagggctggtggtctgggcacccggaccctacctacagggtgagatgctctggaccctcctgggtcatctgagccaccggtgccttgggagaacgagtccctgcgtccaccagcaaagtgccccgtccaccagcaaagtgccccgtcccccggttcctggccaccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccacccgcccatcacaccaaggccttgccccaggactgcagccttccccacggccccctgctcccacccacccactcacccacccgtgccttgccccatccagccaagcgctctggggctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttgtatttttagttgagatgaggtttcactatgttgggcagactggtctcgaacccctgacctcaagtgatctgctcgcctcggcttcccaaagtgctggggttacaggcgtgagccaccgcgccgggctccaccggggcttttctttagccaccgccccgctgtgctgggatctccgctgtgcctgtgggcccaccccctgggctcctggcctgcagctgaggctctttccctggaaccccatcttcctgggagactgaagctctgtgaggccacgtgccttgctcagcgggggaggaggctctgccacaggcctcagtcctgccaggccgcctccctctccaggccagcccccataccacagaggccaggccaagtcctgtggcccctagcccacaggaccctgctctccgtcttctgctaaagcactctcccgggcaccctccagctctcatgtccacagtccccgctgccccctggacaccccctctgttccctctcctcctccctccacattcttgcccatggctctggcccacgtggctccggcggagctgtccttccagcttgtgtccattcttacctcactctggccggttcctacaccacggccaggaggacgcatttagcctcacgtccccatttaaatcgtccccgtctcttgggatcaaagccaaacttccacctggtgtgtgctgccctgccggctccctctggcctctcctcagcccctccctggcctgggcctccgccacctggcctccctccctgtattcttcaaactatccaagtgtgctccctcctgcctcggccactctgtgtgtgccctctgccaggtgtcccgcagcccacatgtctacctgcccctccacccttggctgtgcaaaactccaggcctccctgggaccgtcaccccaaaatgctgaggcggcagttgtcacatgacctgtctactgtctatctccccaaccaggggtgctgaggggaccaggtctggtgggtcacggtgctgtccgcctgggcctcaccagcagaggcctggcctctttccatagcgctgtccccaccctgggcctggatctgtttggttggggtgaagaggggtgaaagggtcaggcggcaggagccctttggatggttcggagccatcccagactccgggttgcccctcccccagaagatcccggttgtcaccgtccaaaaataacctttctgtgggtatgtgtgccagggctgggccacactgccagtgggtatgtgtgccagggctgggccacactgccagtgggcagagccaggccctttggacagtggggcatgacaatgacagctgcagagggggtttcctgcccagagggttgtgccactcttggggggtgccccagcccgtgtcctctgctgcattctcaaccctatgtggcccccccaggtgatcgggctgctggacgtattcactcctgatgagaccctggatgacttcacggacttgtgagtgccgacctgggctggccgctgggcacgaggggtgttgggcagctctgggcactggcttcaggttctaggttggcaatggggttctcttcctgcagcctgagtgggggatgcacaccgcccaccccctccccataccactgtccaccccacgccctcccccacatggtcctgggacccacgggcactggcacagctgggcagagctggggctgctgcctctctccacgcctggcacctgggccctctccagcaccggaggtgtgaaccttggacctgaccatttgttaacaggaaggtcccgtgctcgggaccctggcaccaagtgtgtggccggtaactggagctgctgaccttttccagcgggtgggggagaagcggtagggaggacccaccctgcccctgccctgcagccgaccaccctgggactcacaccctgtcggccaagagtgaagggccaggccgaggaaggcctggagagggtagcaggcgcctcccgcctgacttgcagaggtcaagtcagtggcctctgggaaggtgctaaataccattctcctgtgtctgtctccaccggcccagccgacccctctgacccagatgccttgccgcgcccccatcgcccccaggcacctccctcatttctggcacaaagttgtgaagttgaaacctgactgcctccctcccctgcctgtgaagactcgagtcctgctgcctctaccatgcagcctcagcccctagcctggcacgcagggcgcttcagaggagggttcaaaaaccccaaggcagcctcctccctgcctgacagtcctcagggtgggaggggggtgtgagcgctgctggcagtaacagttgcgggaggatggagcctggcactgcaaggtggggctgcgaggacaccgaggccagtgtggatgtgtgctgcaggggtgaccttcctgggggtgcctgttggatccgggacgggtctgagcctgggcctgctgggtgggtctctgggatgcagaggctggctctgtccgctgacagcgctccggcccctcccacagttacctggtgatgccgttcatgggcaccgacctgggcaagctcatgaaacatgagaagctaggcgaggaccggatccagttcctcgtgtaccagatgctgaaggggctgagggtacgggccccgggggaggctgcagggaggcaggcagggcctcggggctgggcagaggagggccctgtggctctgagagggtgcgctgaagcctgccaaatcctctgccccccgcagtatatccacgctgccggcatcatccacagagtgagtcccggtggagaagccgctcatcagccctcccccagtgcaatccccccgcctccacgtcccacctgtgaggatgtgatggggtctgggggctgagccacgccctatgcacagcccctggtgggaacctgcctgggtgcccaggtaccttggtctgcccttgaagggctgcagagagcaagggggccaggtccggtggccccatctttaggtgccacccaggctcttggctgtgcccatgcttgggagggtggggcacagtggccacctttcctctgcccccaggacctgaagcccggcaacctggctgtgaacgaagactgtgagctgaaggtgtgtgctgcctggcagggggccctgaggtggggcaggggccccctctggatctgcccatctatccacctgtcaggcctgggcagggggccaaggtcccaggctctgggcagtggctgaggagctggtgggtgggtgagcccaagaggcagtggtacacaacatgccgtacccagggcacctgctccgtcccgagggctgctgggcttggtgcactggccagagggaggagctcggggcagtttggggtccgagggcgtggcctcaagtccttgaaggttgtcaggaggccccagcttgggagcttcaagtccaaccccccggggtctcctggaccgtgggtggcctgtccgctccttgggagtcccctagaacccacctccccaattcttcccacagatcctggacttcggcctggccaggcaggcagacagtgagatgactgggtacgtggtgacccggtggtaccgggctcccgaggtcatcttgaattggatgcgctacacgcagacgggtgagaagctgcccagagatctgggcctctcaggctgcaccatctgcttctccacttcttcacggacagccctgtggtggctgctcccagggaggctgttgagctggggtgggagccgggcaggtgggctgtgttggtgtctcctccctccccgtctcatcctgtccccctgcccacggagctgaccagggcttctatctcagtggacatctggtccgtgggctgcatcatggcggagatgatcacaggcaagacgctgttcaagggcagcgaccgtatcctccagccgcagggcggcaccaggggcgggtggggatggctcctgcccaggtgggggcagtgggggccctgatctctggcccccgagctgtgttcctgacctcggtgcagacctggaccagctgaaggagatcatgaaggtgacggggacgcctccggctgagtttgtgcagcggctgcagagcgatgaggtaaggggtgagtggggagctgggtgggggtgggggcggacctgggccttggtgttggcccctcaccctttcttcccacacaggccaagaactacatgaagggcctccccgaattggagaagaaggattttgcctctatcctgaccaatgcaagccctctgggtacggctggctagtgtgggggccaccgggtgctggagtgtggggcctcccgtggtctggcctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacccgtgagttgggggctctgggcagggcctgtgtgaacccgtgagttgggggctccgggtagggcctgtgtggaccccgtgggccctgtgcaggtggccaggctcagagtcctagatccccatccctgggatgcaggtcaggtgaggaggatgggaggtcagggcagcatggggccgtgtggcctggtggagatgacctctggctggagctggaagatgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtggcacgatcttgactcactgcaagctccgtctcccgggtacacaccgttctcctgcctcagcctcccgagtagctgggactacaggcgcccgccaccaggcctggctaattttttgtatttttagtagagacagggtttcaccgtgttagccaggatggtcttgatctcctgacctcgtgatccacctgccttggcctcccaaagtgctgggattacaggcgtgagccaccgcgcccagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgtggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaagccatgggccataggatcctctctgtagtccccacccacacaactgtggctgaggcctcagctcttaggacagaccgtggtggacatgtggccaagccctggccacctcccctttccctggaaaatccagatctagagcaatggcctcttcacacaaaccttctctcagtggttcagaccacattaggattagagaagggccccacgaggcaccgccaggcgtgtctgtgagcgactcccaggatggaaggcaaaggctgacccccctctctgttgtgcccgcccccccacccccgccaggtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccctgttctggctgtgcgtcctcatgccgggtcccaccttaagacctccgggcccttggcctgcatgtagaggaggctggcctgatagctcagacccttagagccaggaggggggcctgagcatcccatctctcccaggccacaaagctggtgcccacttcccccaggcctgtgccagtgatcttcgaacccccacgttagggcttggcccctccccttttacggggtgacctgctaatggcttagactctaagccactgtgtgtggatcctgaagccagacccaggggcagggcctgatggggaggagtgttaggatctaccctagctctctgcatcctccaatgccagcaggtccctggggggagggggcacgctgggcacgttgagacccctgtggtgaagtggtgagcgccagccagtccctggggggacggggcacattggacatgttgagacccctctggcccctgtggtggattggtgagcgcagagggctgggttttattcttgatcaaacctctagcccctactaccctgctccagtggtatcttcgtgcccaggccgccctctgcaggccactcggtgtttccaagggtggcggctggaacacaggccatgggcacctccaaacctgtcccagggcaggggttacagcagagagaccagtgaggggcagggcagggcaggccaggtgtcctcggtggacatgcccacagctggcccagccaaagtggacctgatgagctgccacgacagatgggccttctctgcccagcgaccctcatgcctctccagggcatccgggcctgggggacgtgatcgccatcagttccggagccacgctgacttgtggcatggctgctgtccacactgggcccaaagtgtgggcccataggtggcctgaggactgggggccccaaaattctgtgacccagctggatgtgaactcccgcgggggcagggtgtcccctgggctccagggggcctcaggtttcctctcgggcatcttgctccgtggctgtgcccgtgcctcctatcttcctcagtcccccaccatgctaccgcaaccccggtccagtgtccccacctccaccgaccttgactctgctcttgggccaggggtcttcttggagctagaaccggactcactccctccttaaacctcgggggcggtgctgcgcctccatgcagccacgaccaccgccctgagccggccgcagcgccacctgcctccccgcgggctcctcccgcctcgtggcctttgccctgcagacccctcgcccccctcgcctttcaccccaggtcttcctgcgcccgggccgggtgggccttggggctgcgctggaccctgacccagctggtgcagaacggggctctcatgggcaggctcggccacgggcgttcgggtggggctgcggcgaccactcgcctaaggccgggggaccccgcccctcttggaggggatcggggcggggccaatggggaggcggagccgcagcgcagctccgagggctggcggctcggggcgccgaggcttccgcgcccg

SEQ ID NO: 15731 - DNA, 19161 bp, Human
gagatattgtctggtattacatcttgtctgaaaatccagtttttttggataggaatcatggtgatggaaaatggggcaaggcacaggaattctgagttttgtggggagggagagagaaagggacagcctgggatgtcatttattcattagacatagactaaaggcccattacataccagtgctataaaaaggatacacttggctaacctctcagtctgtctgtggaccagccctgacctttctgtggtaagccagtgcaatgaactttaggcggtgcttggggatacttagaaatgctgcatagcctaaatatttggttattttttctttagtaattaatatagtgatttattaattacctctcagccagattaatcctaccttcccttaaagtgtgctacagttggaaaggcatctgatagggaaaggaaaactatgtgtgtgctatatccttttaccaaggtgcagcagcagttctgtgtttcattggaatgcagagaactgaggctgacccaaggacatgccactgagaggccatgaaggaggaagagggagaaagaaggaggaggaggaaggggaggaggaggaaagcatggaggaggaaggaggaggagtttagcacctgaattgattttacttaccctgttgagatttctctacctcctctgctaagtgttccatcttataagttcagtttgggtggagctgcatttggcttctggatctttcttcagtataatctctgttggaggtgggaatttacccctctgcaaagtccaaatgtgctgaaggattgctctgctgttgctgggacaacttggaaactgtgttcctgcttcattccccctccattgccccttgatgttgttaggatgctattcacttgtttatttggttttgggcctgagagctcttgagggactgggggcaggcactgcatctggtttataatcccagtgcctaagataatgcccagcagatcataaaccacagtgaatgtttgtttaatcactggcctagccagaggcactttttttttttttatcagaatcaatattttcttcttcttcttttttttccctcccccttttggacctggtgtggattgaaaaacatgaaaatcaatggatggatgcttagaagctagtaccaatgtatgggaatgcatcagcatgaggcaaggcttacctgggtggaaactggattttttttgccttttaaaatttattcagagagagaaactgaaatttggctttttatttgttgtgacagaaacttaaaacatccccccaacacacacttcatatacataaccacacacataaactgtgattgcacctgtgtcatttctgatctgtgaaatataataatgggcaaataaagcaaaattgaatttggccagcctttgaaatctattgatttcaaattagagcagcagtgttaattctattatagcagtaatacccagaagttagattttgaaatggattagaatgcgttcatttagaagcttataagtatatctcgatgaattagctgggagaataacacttctataagaaaccatgtgggagtaggtaactgcagccctaattctagtgcctggttttatctttagatgttttagtggcctctgtcagtagaggaatcctaagactttcactactgttgagttctgaggatccttaaacctagcacatgtccaatggcagtgatggttccacagggggaagagaccaccccccacttgctgagaattaggtggggctttcagatttgagtctcatcagcaaagtgcccagagtgttgatcctgaggtagaatgtcttgggtgtatttcttccttgcagttacagcttggctgatggttttttctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtaagagttgccattctatcttattttctcaagcacccattatttatcaaaggaggatgagaatgagcgttacagtgtagtgagaaagatgaaagttagacacttctgatggtcaaatccactgggcagttgggacagatgactatgggaagaaaagtgttggtctcaaaggattagattggagttatattaagggacaccactggccaactttagaaaatgctgtggttcacattttctccctctcccttttttgacatttatagttcagacttgagagaatgacactactgttattgtaactaggttccttttgtgttcatgttagccagtctggcttaaaatgtgtgttgtggactggaattggtcagagtctggctcaggtcacagactgggtagctcatcagatgtacctgggccagaggcacatctttgtttgagccacatcatgcttcaaacatgttggatcaattctaactaaacttgagatattccacataaggatcagggtttccaggttctcctgggaagacggaatgatatgtctatactgggcctctgttcctaaaaaggattctagtgctgagtagcctctgcctcttagacaagtggggacagttcaccaccatccccaaccatctcatttgtttgacttgtttggtcaccggaggtatttaattttgccatgcctgtcctagatcattctgctagctctttgacaaaagtagtaatagcctttgttaattcctccagataaaagcaagtatcttttactagattatgggcagcacttagcataaggggctatagctgtaagaggataatacatggtcccttccacagcgaagcttggagtctagagtgagcaacaatcagacttgtggggaataaggagaattgtagataacatcataatgccttgtgatatgtgctaaaatcaaggtgtacacaaatgggctatgggagagggtagagaagagagaaccattaatttggcctgggcccaaattctccaaaactccctcccctgggcagcagagctttcccatgacagacctctgtatgtgcttgattccaagcaacctggctcagctggagatgtgatggagtatttacagcagggctaggggcccctcttgtggtaaagtccaggtttttcctgtttctgtttgaaaagctatcatctacgattctttgctttttacaaagaggacagctttctggttgtttggctcactaaatcactcagccttctgagcagctctctgcttggagatgagctgtgtgaattacagagatccctggagtttccagagagtagcagtcacactaaatacagatccagagggagtgagtacaactttaatgtgattgtactagttggtgggagtaagagaagggaagggaataggggaaggaagtgggggaaggtagaaataccattatatcagtcttttatttttggaacacagttttacatgtggcttgtgctttatgttttcaaaagacttttacatttgttattttatcctcaaggtgggtttataaactccttctatagatgaagacttcacctgcccaaggtcatgcagataagaagaggcagctcagacacaagttttcagaatcctagtctttccctcttttttgctagttgatgctgataattcagcatgaataagaggacatgctgtttttgttttgttaagttcaacattgaaacgttgcattcagtttatgaatgctctggaatagagcaccctgggaccctgcaaactgtatggacctgtgtcattcatgtgttgtccaactgtggcccatgctgtcagaacatgtccagcgcagaacagacctggcagggagttttcttgcctgactgtttggccggtgggattcacgctttacagcaagccttcctcagtggactgggctgcaccacttggaaagctactggaggtgttggctccatgtaggatcctcgccatgctcagacaatgctgtaagagaagactcttaccagggaggcacctggtaggaggttggtaaggaggagacatgggtatggattgagtttaggtttccaattctgtttacgtttgcttggtttttccattttgtatatccccacatggcatgaccagaaattgaatttagcatgacctactctttaaaaaaatcaaaatgagctttctttttaaatttaatagaataaaagaaaactcttagaagaatgttccaaaaagaaggcagtgttaaatgctgaaaatggtgtatttttttctttgatgaaaaaggattaatgtagatttttggacatctacaaaacaagaaggaaaaacaaatctgggtttttatttacttttatgaaattgataccaaaaagcagttctgtccagtaagacaaattggcttgtattataatactttcattacttttctgagcaaagcaggtgcattatcagagacagccatgagcttgtgtatatgtgtatgagtcagccttgaaaagacacaattttgagaatattttcttaggtgagtttgagagcatgaagcaacaagagcaggaagtggaccaagaggaggcgaataaaaggttaatggctttgaaaaagctttacagggtgccagttggagacaactgaatcaatggtagttttcattttacgctgccagggagtttcttggatttttgacatattcttcttcttttcaatcttataaacaccaagagggacaaggtggtcaaatactgtatatgtagtgttctcaccatgagtgatgtgggttgatagtagggaggagaatcaatacagtgaagctaagtttagctttaagaagagaatgaaaatagcagttgggtcttctactttgtggccaatgccactgtaccctcagatgtgcctgattttagaccccatgtgtcttcagcatgtgaatgtcaatctccttacagtatggctgacataatatgcaaatgagaacatcagccagtctctacctcctcccacttaaaaaaataaactttaaatactcatatttgaggcattgtggaaagagtctgccgcataaaaggtggacaacattgggcaaattctgagcctcagatgtccccatttgcaacacgggagtctaaggtctatgacttagggctgttagagaattaaagacaatgattcattcattcagttacatgtactcattgcctgctagtgcctatgtactgcaccagttgttgagaataaaagagtgaataatagtgtatatgaaagcacttaccacagtgcatagcctgaaaaaagatgcttagcacatttttcttaaaacatttttaatggagaattttaacatgtacaaaaataaaataatacattaaactcttttgtgcctatccatgacccgctgcaacagtgattaactcatagccatcttgtatgatcagagctcctgcctttccatgtattattatgaaatcaatccccaatgttgtgtaattttatcaataaatattttagtatgtatttccaaaagataagggttttcttttaagaacataattatattactattgggacactgaaaaattaacaatgattttttttataatatcaagtatctagttggtttttgtactagttcgttctcacattgctataaagaactacgtgagactgaataatttataagggaaagaggtttaattgattaagagttccgcatggctgggaaagcctcaggaaacttaaaatcatggcagaaggcaaaggggaagcaagcacatcttaccatagtgaagcaggagagcgagagagagtgaagtgggagatgctacacattttcaaacaaccagatcttgtgagagctcactaacaatcatgaaaaaagcaaggggaagtctgcccccatgattcaatcacctcccaccaggcccctcccctgacacttggggattacaatttgacgtgagatttgggtggggacacagagccagaccatatcagttttcaaatgtccctgattttcatatatatgtgtgtgtgtgtgtatatatatatatatatatatatatatatatatatatatatataaatacatatacatatattaagcatttggctggttagaatcaggatctgtacaaagtctgtacactggctttgtttgatatgcctcttatttgatctgtgtcatttgtcctgtatggtttcccagtcttgattttgctgattgcacccctgtggtgttattgaccatattcctctaaaatatttattttgttcagtaaaatctagttattttattatattaggcttgattagtgggttcaaatattgtaactctgatctctgttatgaaattccccatcagctttttatccggattttatcagccattgattatcattgcctagatctattattttattatgagatttgaattctattatttctttttttacttattagctggaatccctatttattcacttatttttattataattttaaaaaatgataaatagaaatagagtctcactgtgttgtcaaggctggtctcaaactcctgggctcaagtgatcctcctgccttggccacccaaagtgctgggatggaatccctttttaaatgacagtattattgagatatgctttgaatacagcaaaatctacctttttaaaaatgggtttaatgcagtggttcttggtatattcatgactgtacaactttctaattccaagacatatttatcatcctcaaaggaaacccaaatccattaatagtacccatctcccctccccccagcccccagcaaccactaatctactttctgtttctatagttttgactattatggatatttcatataaatggaataatacaatatatgatcttttattgtctttttttaagtagacctttttcattagcataagttttcaaagttgatccaggttgtagtctgtcagaacttcattccttgatggacatttagattatctcccctttttcgctgttatgaataatgctgctacgaacattacatacagtttttgtttgaacatatgttttcagttctcttgggactatacctaggaatggaattgctgggtcatatggtaaacctgtttaactttttgaggaatgggcttaaactgctttctcaagtggctgtactattttacattacttacaatgacacacaagggttccactttctccacatccctgccaacacctgatgtatcataatacaacatttgcattattattactttttgactatagccatcatactggtatgaagtggtgtctcattgtaattttgatttgcattttcctaatgtctaatgatgttgagcatcttttcaagtaccttttggccatttatatgttttcatagaaatgtctatcaaaattatttgcccattttaaaggagtttatttgtctttttattattgagttgtaagagttctttattctggatactatatccttatcagatatatgatttgcaaatattttcttctattttgtgagttgtcttcattttcttgatacttgtcctttgaattgatagtgtcctttgaagtgcattttacattttgataaagtcaatttaactattttttctttatttttctgtaattttagtgttatagctaagaagccattccctaactcaacgtcatgaaaatttatgttaattttttttctaagagttttataattttaacacctacattcaggcctttgatgtatttaaagttaatttttgtatatagtgtgggatacatatccaatttagatttttttgcatgtggctatccagctgttccaatactatttatcgaaaagactcttcttacccctgttgaattgtcttgacacacttgtcaaaaatcaatcaaaaagcccatatgggcttatttttcagtttattgattgatttttgacaagtgtgtcaagaatcaatttgtcaatttctgaagttttagaattttggaatcaatttgtcaatttctgaaaaaaggcagctaggatttttataggaattgtatttaatctatgaattaatttggagggtattgccatttaacaataataaatctttcaatccgtgaacattgggtgtctttctattcatttatttcttccataattttttcaacaacattttgtagttttcattttacaggtttatgccacttttgttaaatttatttctaaatattttatttttctggatgctattgaaaatataattgttttcttaatttcatatttgtattattgctagtatatagagatacagtttttttgtatatcaatctagtatcctgcaaaattgctgaacttatttattagttctaatttttttgtatatctattccataggattttctatatacaagatcatgtcatctgcaaatagaagtaggttaacttttccttttcagtctggatgcattttctttcttttctttgcctaatttccctgactagaacttccagtacaatgttgaataaaagtggtgggattggacattcatgttttgttcctgatcttaagagaaatgcttttagtcttttttcattaaatatgtttttagctgtgggtttttcatagatgctctttatcaaattggagaaattctgttctattcttagtttttgagtttttgtttttaatcatgaaagagtgctagatttttcaaatgctttttctgcatcttttgagatgataatgtcattttcattatttctttagtatttatattaccttgattgatttacacgttaagttaaccttaaattcctgagataaatcccactactcatggtaatataattctttttatatgttgctggatttggtttgctgatgttttgttgaggatttattcatctgtattcataagggatgctccctgtagttttcttgtgatgtctttttctagttttggtattaggagaatactagcttcatagaaggagctgggaagtatgcctttctcttctaatttttgggagggtttgtgaaagattggtggtgattgtggtaaaattcaccagcaaagctatctgtacatgagctttccatatgaaaatttttaaaattgcaaattctgtatctttacttgttaataaataggtttattcagatttcctttttcttcttgagttagtttgtgtagatcatctctttctagtgtaaactaaaaataaaattctaagccctcttgactatctgaatggacccctcctctaggccaacgtcattccaaaattaacctgaaaaatgagttcagaccatgatgagaaggagaggtaagacatgcttcattataccctcctcttttttggaattcaggaaaagcttaccagcgtcaacatcaacatgaaccttaggactgatagtgcagtctctttaattctgataagaaacatttactgtctattctctctgaagttgctatctggaggcttcatctgcatgataaaaccttggtcttcacaactgcttatcttaacccagacattcctattgattctaagtctttagacaatgtattaatctgttttcacgctgctataaagacatacccgactgggtaatttagaaagaaaagagatttaattgactcacagttccgcagggctagggggtctcaggaaacttacaatcatggtggaaggggaagaggcacgtcttacatggtggcaggcaagagagagtggcgagagaagggaaaagagctttttatcaaccatcagaccttgtgagaactcactcactatcatgagaacagcgtgggggaaactgcccccatgatccaattacctcttaccaggtcgctcccttgacacgtggggattacaattcaacatgagatttgggtggggacacaaagccagaccatatcattctacctctggcccctcccaaatctcatgtcctcatgttttaaaaccaatcatgccttcccaacagtcacccaaagtcttaactcatttcaacattaattcaaaagtccaagtccaaagtttcatccgagacaaggcaagtcccttctacctaggagcctctaaaatcaaaagcaaattagttactaccaagatacaatgggggtacaggcattggataaatgcttccattccaaatgggagaaataggccaaagcaaaggattgttttggcccccaaacaaattggccccaaaggggcaagtctgaaacccatcaggggagccattaagtcttaaagctcctaaatgatctccttttactccatgcctcacatccaggtcacagtgatgcaagaagtgggctcccatggtcttgggcagctccacccctatggctttgcaaggtacagccctcctcccagctgctttcatggactggtgttgagtgtctgtggcttttccaggtgctcagtgcaagctgtcagtggatctaccattctggggtcaggaggacagtgggtgtctcttctcacagctccacttggcagtgccccaatggggactctgcgtgggattctaaccccacatttcctttctgcactgccctagcagaggttctccatgagggctctgcccctgtagcaaacttctgcctggacttccaggcatttccatacatcctctgaaatctaggtagaggttcccaaacctcagttcttctgtccacttgcaggcccaagaccacatggaagtcatcaaggattggggcttgcgccatctgaagccatggcccaagctgtaccatggccccttatagccatgactggagctgaaatgtctgggatgctgggtgccatgttgcaaggctgcacagagcagcggggccctaggcctagcccataaaaacttttttcctccaggcttctaggcctgtggtgaaaggggctgctgccaagacctctgatatgccctggagaaattttccccattgtcttggcagttaacattcagctcctggttacttatgcaaatttctgcagccagcttgaatttctcctcagaaaatgggtttttcttttctatcacatcatcgggctccaaatttcccaaacctttatgctctgcttcccttttaaacaaaaattccaatttcaaacgatcttttgtgaatgcataaaacagaatgcttttaagagcacctaggtcacatcttggacactttgttgcttagaaatttcttccaccagataccctaaatcatctctctcaagttcaaagttctacagatctctacagcagggggaaaatgccaccagtctctttgctaaagcatagcaagaatgagtgtttgttccaggtcccaatcagtttttcatctccatctgagaccacttcagcctgggctcattgtccatatcactaccagcattttggccaaaaccactcaacaagtctctgggaagttccaaacttttccacatcttcctgtcttctttggaatcctccaaactgttccagcctctgcctgttacccagttccaaagttgcttccacattttggggtatctttatagcagtaccccactctctgtggtgccaatttatagtattagtcaatttccatactgctataaagacatacacaagactgtgtaatttataaagaaaatatgtttaattgactcacagttctgcagagctgaggaagcctcaggaaacttacaatcctgatagaaggggaacaggcatgtcttacatggtggcagatgagagatgagcaaagggggaagagcccctaataaaaccatcaaatcttgtgagaactcattcactattacaagaacagcatggggaaaccacccccatgatccaatcacctcccaccagttctctttcttgacacttgggcatcacaattggagatgagatttgggtggagatacaaagcccaaccatatcagacaataataacttaactctttcaaccaattgccaatcagaaaatctttgaatctgcctatggcctggaagccccccacctcagctgccagttttctgggctttctggacagaaccaatgtacattttacatatattgattgatttcttgtgtctccctaaaatgtatatagccaagttgtaggccaacaaccttgagtacatgttctcaggatatgctgagggctatgtcacaggccattggtcactcatatttggctcaaaataaatctctttaaatattttagagtttgaccctttttgttgacactagcaatttgtacacttcatctaggttatctaatttgtggacatatgattgatcatagtattcctttatagttcttttcattatgtaaggtcaatagtggtattgttctttcattgctgattttgctaatttgaatcttctctcattttttaattttcctttgttttgtttaagttttgagacagagtctgactctgtcaccgaggatggagtgcagtagtgcgatctcggctcactgcagcctccccctcctgggttcaagtgattctcatgcctcagcctctcgagtagctgagactagatgtgcatgacaccatgcccagctaatttttgtattttttgtagagatggggttttgccatgttcaccaggctggtcttgaactcctggcctcaaatgatccatctgtcttggcctcccaaagtactttcattttttcttgattagcctagttgaagatttgtcaatttcgttgattgttttaaatgaccaatggctttgttgaattttttttaaattttattctccatttgtttatttgcatgttaatctttattatttccttttttttttcagaggaggaatttgttctcttgcagacaaccttgcctttccataaacataaggggaaagagattcctttctgacctttctgctccctttaatggtgttactgtctgcccacttttacagactagaaaacacatcctcttttggcctttctgcttccttgtccctttttttttcccaatcagttaccaaatcctgtagattctgtcttataaacttcttctgagtttatcacttcctctttatatgcactgccactgtgtgtgtccatgtccttgccacccctaacctgttctgttgcagccctgtcttcttggtcccagcttttgccccgtgcagctttcacgctgctgtcattggcggctttctaagtcacagtcacaaacctagctatgtctacttgttgattaagaccctttagtggtcttgctgacagattctttggactgatatacagggtcctccacaatctggcttctgtctacccttcgatgcctctggtgggaatgtccttttcctttcagtttggtggtgtgttagtctgttctcacactgctataaagaactacctgagactgggtaatttataaagatttaattgacttacagttctgcaggctgtacaggaggcatggctggggaggcctcaggaaatttacagtcctggcagcaggtgaaagggaagccagcatgtcttacatggcagagcaggagagagagagagtgaagggggagatgctacacgctttgaaagagccagatctcacgagaactctgtcacgagacagtgcttgggggatgatgctaagccattagaaaccacccccatgatccaatcacctcccaccaggctccacctgcaacacgcaggatcacaattcaacatgagatttaggtggggacacagagccaaaccatattaggtggactccacttgaacctttgagctgcatataacctctgctatgaagcttctccaggtaaggtcactgcttttttctcagtaatcccaaagatgcttgactgacctctcgcatagcatgcttcacattggattattagattataaaaaggaagaaggtgggggaagtctatgtagtggagagaacatggactttggaattaattcaacctgggtttaaatcttggctccatcatttacctattatgtacctagagaggctgagagcagtacccatttttctatccagctaccatatagtgttggaaggactgaatgacataatgtgtaaaggcctccagtagtatcaggtggggactcagtatatgacagtctccttttatttgtatcatctgttctgaggaaacgtcattgcattgggtgaggatcaaaagctgttattttctctctgagaaagcgacctggtgtatcctgattagtgtcagaactaaaaacaggccacgtgctcagccagtatagacaatctatggaaagataattatagattagggccacgtggggactgtctgtgatgggaaggaggaggtgggagtggagcgggtttgtgtcaggaaactgatagtgcaattaccataaagaggttttcccaagtcaggttcttttcatgtggatgttcctgaaacaccatcccatgaagtgtaatgatatctttaagatataaggtacttaagcacagggagataattatatcctcttgattgtccacatccaaacacagggagtagggctttctcttaaaggagtaaaacattggtacgcaaagggaaactcacatcctttgtaagagctgagctgagccccctgtgatgagtgtgttgggggcatgaccaagccctagggattggaagggatgagcttcaagcctggcagcaactagcctgtcatgtctgaattgagttttcccaaacatgaagagcttgtgcttgaatctctggagacgcttgtattatgtaagtgatctaaattgcattgtatttttgggggcaaggttgggaggtacagtttgaatgcttaacacacagagaaatggcaattagggttcatacaaattatattgccatctttcctctttcctaaagaaaatgggttcccaaaatcctaagtttttttgggaaaaatctgttttgtgttgattttcttctgaacaaaatgcataataatgtattcatttttattgcatttcctgctttgcttttaatgtagcccatcctcctggaaagggcagattaaaaataagcttggctgggcacggcaggacagagtgctaatatcatcttgtgctctttccaggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacgccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggagaatgtcttggttgtatgtttttatgttgagtaactacattttagcatgttcaggattggtttggaagaaaaatgttctttttggagtaccaagagcccttcctttctttatgcttttgaattttaggtatgtaccaagcatgtgctagctcttttttcagtagacttgatggtagttggcagatagaagaacatgtccatgactaaattgcgctgtccagcataaactgattaaacatgtaggtgtttgggacacactcaaaattggcatatatgaatgaagcgtgtactcttacaaatatttcttcagtatatcttttgaattttatactaatttatactgctaggacaaaatctcactacctaaaaaatattgcagagcagagtaaacctacacattcacaggcagggatactttcagtgaatggaagaagggagaaatgttgtacaaatacacagatgtgattcattatgaccggaggagtgaaacttaaatctctggaaaaatctatgccagcagctataaaatgagccaacattttccaatagccgtagagatggtaatttctgcatctcatgtagaaacttctcacaaagaaagaagacatacatacgcattttcagacagtggcagagcaattctatcccatgtggagagaatttagctaaagtgttaattttggagatgtgtggagactgtcacgcacgccaccaggggctggttatggattctttacctgaagtctttccagtggaagagccacatggatttgttatgtttgtagatgcatttcattgaaagaagggcattatcagatataggtaactctttgactcatcactcctcttaatgtttctatggcttcggagatggatataactaaacagggtttatggccacttttaaatctggaggtttattacatgcatgtgtgttaccccctgctcattaaaaaaaatcttttctccaaaatgcatttttgatattggaataagtatagttttgaggcacagcaatagaatttgggatcttgttttatcaaagattttctaattagtggtgaagtaactgaagactgcttatgtaataatagtaacagtagtagtaatagtaacaagaacagcaataatcatatgataatacgctaactgtgtaattgcatttatttattacaacatcccttgaagcaaaagtttgatactattcccattttaagatgaggaaactaaggtttgcagggaaggtggcttgcggaagttcaagagtcagtagtggggttgggctctggacccaggaggctgactccagggcctgtgcttttcactggcccctgctctgccgtgttagggagtggatttaaggaaacatcagaacagagtgcatctgaagggacaaagagccacaaacactgtcagactttgactttttaaggatgtgagctgaaaggggaaaatgctggcttatgtatcttccctttcctaatccagacatcagatacacttatttacagagacagttttctagaatgcccctcgaagctggaataggatctgagggtctgtccctgaggacactgcatggcagacacagcagaaactgtggctctgtaagagcctagaaatgccttcactggtgagaccaagtagagtaaggggagctttgacagttggacctgtgtaggaactgagtttctgcctgtgtctcatattaattgctggagagcggcttgctgtgtggcatgagtggtggtggtggcttccctctgggcttggccggctgcaaacccttcccccagccccttctcagcccggtccctgccatactcttcagttagaatccctgccacatccctaggcctccatgccacaagttgcagtgccttgtgtttattttagcctctctgagcttccccaccatccacacagggctcctcttcctcattcccacatggtgacatgctgggttccttctttctccaagacttgagtcagtggctgaacac

SEQ ID NO: 15732 - DNA, 23856 bp, Human
  misc_feature (1)...(23856): n = A,T,C or G
cacccccagggtgctgtgggatggggtgggtgcacacggcgccacgagcacacgtgcccgacacctcagcggtgcacacagccaaggccactgcccactgtacccacgccgtccgtgtcctctctacggtcctgggagaccggcgttgtgagcggtggggcctgtagatggggccgggtcctctctacggtcctgggagaccggcgctgtgagcggtggggcctgtagatggggccgagactgaactgaccctagcctcaccactcatatgtcggggctggtgatatttgggaatgtcactgcctgccatgcagctgcccaggcctgatgtgcccccccagactgttctataggggtctaggttgcaggggccagggccagggctgtggtgggatggcacctgaggtgcggctgctcctggagcctggggggtgtgggaaggtgccccccacccagggtcctaagtctgttgccttcacccccgactcccagcagataaatacccaacagtgcaggaaaggattacagggaaggcctggagtgtggggttagcctcggtggtcccaggaggaaagattgggggacctctggactatctgtccctcccctggggctgctgggggtatcagagtggtgtctccagcctccagggctcaggtttgggtgggaggggcctggtcccacccagactctgtatgtagcccccagtccctgctcctctgtgtgcatgagggagtgccagcttgcttgggaccccccagggtgagggcttgggacgggcactggggccccgcaggggctgaggcagccaggaagcccacagcataggctgtttgtgttggcgggcctccctacctcctcaaagctgcctcagagcccgtgggcctggggggccagggtgtgtgggcttggctctgctgtctgtcctgagctgcccctgctgagctgtgtggagaccccgaggtctgggctgggccaggactgagctgctgccctgctgctggggctcagagaggctgctccacgggcatggcacccaggctgctgcagacaggctgctttatcatgtgggcaggcccctctttgggttggacctccgtctggccttgtgggtgtctgagatctccttgcagctcagtccccagggcttttccaacctgcagagctctggatgtctcttttggggctctcgctcagccagggttggggtggaggctctatggttccctcctgcccttgggctactggaaggacagttacctcactccagagagctagttctgaggggcgaggtgttgcggggttgagccagcagggcagggagtagtgggcactgcgtttggctgcccaggtgggtttggggcctctccctggccagaaatccctgagtgccaggaggaggacagactccccagcctggcacccatggtggaggagggccttgcgggtcattgctggcagctccatagggagggcgtgaggccccttcctgagcctgggtgtctgctcagagcccaaggcagggtggggtagggtgcttgtgcctggtaggaagcagacagcaggctggtccaggggtccaggaccccagggaggaggcactgctgcgtgtctgtgtgggtgcaagcatgtgtcttggcctgtgtctctgcatgtccgtgctgtgagtacgtctttgaacatgtgttctctgcacaccgtgtctctgtgagtgtgagtctgtgtccctgcctggctgtctcagagccctgaaggagcagaatttggtgactcagtcattgattcagagctttcctggttggggctactcctcagtggtcttcttctccgagtctggtggtgtatcccctgcccaccccgactgcccctctgccctgtagggacctggccccaggtgggggttccctgcccttctctgggagcatctctggctgtacagctgagggtggaagccagggctccactctgcccatctttccttttgcagagcttggggcttccttggtcgcacccaccacctgcctgcccactggtcagccttcagggaccctgagcaccgcctggtctctttcctgtggccagcccaggtatgtcagggcccggctgggctggatggttgtggtgggcagcagtgggcttgcctctgggtctcactttgccagcccaggggccttgccagcggacactttgacaccacacctgagtatctaattggagctcccgtggggaggggctggactttggagacagggtcccagaacaccccgactggggtgttgaaggaccctccccgactgagctctgacactgtgccttgcccgggcccctgactgcgtctgggcaacccagtgtgaatcttgaacttggcaacagaagcaagcccagctccccgcccccacccccccccaaccccgctcctcctgaccctcggtggccttgtgaggtttttgatttcttcttgaataggcttcatctgctcacctgggcgatgtgtgcagagctttgtagatgggaaagggggtgggaggggtcttaggggacactgggactgcatcctgggcgctgggctcagtgcaggcacccagaccagctctcccttcgccctcccacccgcctgggaccctcgagccttgcctgccacttccccttccacccccagccacagagggacgcaggggagatggggcaggggtgccactggctagcctggcggcggatgctctccttggggtggctcgggtggtgtttttgactgcaggtggggtctggcttctcccagtcagcctggggtcctcccgggtccccgtggcacctgcccttgcctggcccacgagtaggtgctctgagcgctgcccaggtcacatgtgagctccctggaggcgctgcacacggctgagtgtctgccctcaggttgcacctgcgtggccaggggaagggggccgggcgccatctgctctctgggcagagctgcgggtgagggtttctgtcagggttggggtcccagggctcctggggtctctgctgggccccgatgcgtggccgccgttctgacccattcctggggcccagacccaccaaagaacccccaggggaaggacagggtaggggccatgggaagccccaggatggccttgtgggccttcaggggacctccaggccagcctcctgttctctgggggccccctgtccccttcccccagcgaggacctgggcatggggtgctgccctggggcttgggctgcagttctctacagagcccttggggggcagcagaggcttggggcacccagcccaggtcgtcaggggtgggcagagctgcgggacctccctggacacccggggcttccacggcagccctccccagacctgccacctcccacatcagtcactccaggaggacccaggcctccagagctggtcagccctgccatggagcacccccttcccctcccttagcttcctctccctcctcttcctcctgcccttcctcattccccacctctgggcttcaggtcatctgccaggaatctgggccacgtgctgatatcttcccaacaccgcagggcccttgtgccctgtggtggggctggggcttcagaggcgtggggtaggctgcagggcacagctgggggcctctgtccccatctccggctgtgggaggtgtgtgcgcatccggcgtgatgacacccaggagtgcaggcacatctgcgcacggggccggtatgtctgtacctgtcaaggggtggggtggggtcttttacaggctgacttccagcctgggctggagcaaaatgaaattctgggccccttgtttaaaaattaccaagaatttcaagacgggaacagcagagcatcaagccagctggggtgggtgcgggcgactgcccttgaagccggccccgctcccgcattggggacagcacggggcggaggccgagccgggcccacctggagcgctctgggtctgtcctggggctgccagcctcctgcggggctgcctggtggagggggggtgggtatctcaggaatcacacctgcgcttttctgtgttctggaacctcccatatagtcaaagactcaacgacacctgctccatgcagtgcaggctgacccagccccccacccgccgccggcactcagggcttccccaagggcgcccggggcggagccgcttcaagttgccaccagacagcaacggggtcaccctccatttgcgtagtgctttgagtatcgttctcgtggttggaggtctccaagcccggcccggggccagagtccgggcgaggtaccgtggggggaagggctgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccggccggcgggatggggcgttccggggcggcgggtgcggggcgctgagcggcggccccggcacacccgggcgcgatgcgccgctccagcacggacgagtccacgtaccggcgcagcccctctccggagggcaaggagccggacttcgcgcgcggcggccccttccggcgctacagcagcctatacgggcgcgcgggcggcggggacgccgggggcgccttcttcggcctgcacgcgaaccccggccccaaggcggcccaggcgcgctacacgtcgcccaagggcaacaagtacgtggttttctacctggacctctccttcatcttcctcctagaactgaagcgctgcggcatggcgcgcgcctgcctccaggccgtcaagtacctcatgttcgccttcaacctgctcttctgggtgagtccgggggccggggtgggggcccgggaaagacccggggtccctcccgcggcgggtcgcggggtctggggagtcggagtcgctgccccggccaggcgttgggtgcggttgtggggatggtcccgggaggacccaagaccgctgctccggctaggagcctggactgggcgggtggggaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcaggcgacctgtcgggcccagggactcacttccgagggtttgagccggctgccgccaaggtcccccagtcgccgggaggcgctgcggaagggaatcctggacactgagcagggccgtgggccatcagtgttcgcgggagacactggctttcccgcgcctccggcagcagaggcttccctaacttttgcggaggtggggtcaggtgtgctcagacctgcagtggtgtccgggggggccctgtgtgctggatggagcagagctgaggtagagggcggacagggttccaccccaccccagccccatgtcagcaagaggtggggcaggattcccacctggccaggttggagcaagcctcatggagccgcgaccctgtcctgtccctggctcctgtggagggcagctgcagttgggggtggccgaggatgacctggaccgggcctggggctttgctggctgggctgggggaggtgaagtgataccaaggtcattctgtgccctattcttaattcctgaaccagctcctgcagctgggagtcgggggtgtggcctcagctcctgcctaggctctgggcttcagaaggaggctgtccatctgcataaggtccagctgggccaagtgcccagaagcctgggtctgccttcccacctctcccctcctgagcccaggctccttctctagccagcttggggtggaggcaggggggtccctgggagggacagccagcctgggttgcctgctgagtgtgacccaaggaggctcttggcccagacatccacctccagaaggggtcacccaagggtttgttttctgcaagaggctctggaggggtgaggcccaggcctgaggggcgccttggaggtaggggtggtgggaggtgtgggtgtggtctggagctggtgggtgtggggggtgggctgcaggtggctgagtgaccagagtgtttctgtgacggggggacggggcagaatgactgaagggcagtgggtgtgggggcccggcaggcaggcaggcaggtcctgggaggggaagccctctctcctctccaccctcctcctgtcctccgtggcctggacacctgccttcagggagaaagaagagggtcctttcccagggggggtctctctgctctgagagcagcccgccctcatggaggacccccagtggacctctctttgctctgtgaaccccagagaagcctccattcctaccgcatggcagacacactcccccatcctcaacctgggaaagaacacacaaggaacccccttgggaccctattctgggctggaaaatgcaattctctcttttttatctttgttttttgagatagagtcttgctctgtcgcctggagtgcagtggcgtgatcttggctcactgcaaccttccatctctggggttcaagcgattctcatgcctcagcttcccgaattgctgggattacaggcgcgcatcaccacgcctgtctaatttttgtatttttagtagagacagggtttcaccatgttggtcaggttggtctcgaactcctgacctcgtgatccacctgcctcgacctcccaaagtgctgggattacaggcggccccaattattttttattaatcaatcaccaccttcccgccagtccagcaaactggagccccgctggcttcatacaccagccttggccccccccaaccctgggctggtgcccagtgggggtctaagggtgggggcggggcaggggaaataagaatgagtgggggttttgccaggagagtctgtcccgggctgatgtccacgcctgctgtgccctgagtcactgtgagctaagccctctcctcctggcgtgaggctatttcaggagtcaggcctagcgctccccttccccagggctcctttccttttgggggtgccagccccctgttgtcggggcttttgccgcccactccatttcctactcgttgggagaccaggggatacaacctggcctcctcctcctcctcctccgtcttctcaggggcgaagttcaggggttaaggtggtgggagggatgtccccccggcgggacctcaagatccccgcgtgtgtctgtcctgaccccccccgctgccggagtcctgctgggcctgtggggagggcatgggggagccccagtgggcagccagtgaccagagccgtgggcagtggtgggagccggggtggggtgaggaaagttgtgtgtgactggggggctgtgcccgtcctgggtgtggctgtgggtgtgggggcaggggctgagccctgtaagtggtacaggtgcggccagggcactgggaggggttggggggctgggagtggggtcccatgcctggctcgtgtgcggtggtcagggtgcagcttccctctgcccccagcttgcctggctgccccttagctttgctctcctgtgcccttaaccccagcctggcacccctctctcccacctttgcctccatgttctcctcaaagccccccttcttccaaatgcagaccctccaaggccctcacagtactcctggcttccaaggtctctttgggtccaggcctgagcccccctccacacccatggtcaggctagggcccctggtcactgacggcctggggcagcctgggggcctacctgggaggggaagggaggggctcgctccagaaggctgattgacgtatttctttacagcgttggttcggatttcccaggcaggcatctttgctggggtctgggagggtggggctgctggcaagagtctgtgctcagagcctccagctttgggtggagtggggagggttcctggggcagccagggtggggaggtaggatgtgtcctggcctggtggtgggggacccggtggggccttcagagttcagagcactggtgccaactcctaaccccatggacatctggggacatgctacctgccttcagcaaatagaggccctcacccggtgatggcagctccgctggggcacagccactgagccttcctttgagccctccctgcagaggttggggagtgggaagcaggctgcctgtggtggggccggggtgtctcctgggagcctcattccgggggaggctgggtgcagggcccgtgagcctgagcgaggtgtcctggtccaaggcaggtgccgacacagacacaggttagcaatggtgagggcgtggggggctctgctgccctgggacccccaccttcaggcctctgtgctgcctggtcagctcagctgctgccagcgacactcttcccctaatggaagtggaggtcccggggcggaggggagaggacggggcctgctcttcccgcctgtcagggatggaggcagccgagctatttagcaaggtgccaccacgaagggctgtcctcccgccctcctggcctcggctccttccagacgctgctccccagggtgggtgctgctcccctttctcttcacccgcagcaccaggagcttggtggaagctccggccgtctccgcactgtatggttagggcctggctgggggaccgggtgggggttggagtcccacctgccagtgcgggacgccgggcaggttctgccctccttgaggcctcattttcccatctgcaccatgtggggcggtagagggtgaggtccccatatactggcctggctcgggggttgaatggaaatgtgggaggcctctcagttccccaccacctctgcgctgatccccggggagaccccccaggtgggcagtgtgagtcttggagccaggtggtccagggccccagcctggaggggcacgggggctgtcctggctctgcgctgcctgggctgtcaaccctggaggtgtgggggcccctcagcctcactgcccactctctgttgttccaaaggaaagtcctggctgcgcttgaggcctctgctctaagatcagcagtgagcctggtggaggggtgcagtgggggccagccttggcttcccctcccctgggatgagctgagacgatgtctggcagatggcatggccggcctgcctggcgctggcctctgggcagcacagtgtccccaagggtggcagagggctctgccttcagctcccaggcctctctttgaggagtttaacatcccaggccagcctttggatcaattgttcggaaacaatccgtttctgaacaaaggccctgacgctggcaaccacagcgtgtctgagccttggggagtgtgtggctccctgtgggtggggagcagcagcggtcggtcgggggacactgcctacccagctgtgggctccaggcagctctggtgctgttgggggtaggtcagacttgtccacccggtgacacaggcctggctccacggggcctctgcaggttccaggtcccagctggcggcagggcaggcaggccgggcctctgtgtggagagggctgtctccgggggcggagatgtggcattggcagcccagggctgcagggggcaggcagagaagtcaggaggcccacgcagggggacgggagtgagcgtgggggacctgggctcccagccgcgcttgtgcgatgtgagccgtggtcctggcctgatgacggcaggccgcctccttgctgttcccacgcagccctgctgcacccacagccccgctgggtcacagtctcctcctggattcctgtgcctccagcaaactcctacccaccctgcaggagccagcattggcaccctgggcaggtgcccactgacgagggctgttctgctctccctgctttggacactggcctcagggtgggccttggtcactgggtggggctggtctcctcatctctgggccctggggtcccttggagagctcctagggtcaggggtgagggaacggaggacagatggggatgtggaaacaggacgtcgctcagggcccacagctttaaggaaacaaatcacagcgagccacacagattgtaagtggacagacttgtcatccctggaaaccagcatcccagccatgacggggacgttcccgccagcccagagggtcctgaggctgtgctggctgctagcatccctgtgtctggacagagccctggcccctgcagggacccagccccccatcctattccaaggacgtggctggcagcccagccatctgccacaaagccgcatggccggaggggcagtgggctgagggctgagagctggccagcgtggcccccgtgggcccggagggagcatactcgatggactccagtgactgcacccctgcccaaggcctacaggaggctcaagggggccgtcccgcagcacctgcccaagaggctcaggtgggctgtccagactggaaaagaagggcagagcagagaatgcatgggctcaccagcacctgcacacgcccagnnnnnnnnnnnnnnnnnnnnnnnnnnnnnnnnnnnnnnnnnnnnnnnnnnnnnnnnnnnnnnnnnntttgggctcctaatcttgggcagagccatcagttgctgctgaagatcagggtgagcgagtgtctgatggactgagcctggggcctggtatgctggacggacattggccagagatggtctcacgcaggtcctggggacaggttctgggcagtggacagtgtgagctgatgtctgggagaaggacaggccccaggcaccgctgactggaggtgaagaggtctgggacggagcccctctcctgggctgttcccccagctgccatcattcctagggttcctctccccagctgtcatggggcggggtcaacctcccacctgagcttgtgtctggcctgcgggggggcagcagtgagggagggaggctttcagcctattcctatttgtattgagcgtgtggggagggagctcctctggtttccgggtccaggcccagatgctgggtgggaccctgggagggtgcgcaggctgccagccacacccctagctgctccccatctggctgcatttgaccagagggacctggccctcctggcctcagccctgctcatcctgcttttgattttctgtctccaagctaatggggcccattttctcttgcgctttgaggctataattttcctgccaaaatgttttaaaagctgcatatgcagaaacactttcaaaattgcaggtaattttattaaccacgtgcacgcattttatctgtgtgggtctgccagcacgctggggcctcggggcccgggggacgccgggttgcagggcggtaacgcgcgcgtgtggccacgtgtgatggtgtgaggcgtctgtggcaacgtgggctgttgtctgtcacagtgtgtgtgaccgagcccgtctggtgacagtgggtgtctctttcctgccgtctccggtggaggtgaggatgtttcgtggagtgttaattagggaaatcagttcccaccagggctggggcagttgtgggaggggcccagggctggaggtgtagggttccttcctgcccagcccccatggaacggggtttcccacacctggcatggcaccagtcactctgcacatgtcctccctgtgtccttcgacacatccccatggggcgaggggagcttggaacagctcattttcctgatgacaggagaggtctgcgtccttggaaggcagaggcagatggagcaggcagtttgggttttttttttttttttttttttttgagacggagtctcactctgtcgcccaggctggagtgcagtggcatgatgtctgctcactgcaagctccgcctcctgggttcacgccattctcctgcctcagcctcctgagtagctgcgactacaggtgcctgccaccacgcccagctaattttttgtattttttagtagagacggggtttccccgtgttagccaggatggtctccatctcctgacctcgtgatctgcccgcctcggccttccaaagtgctgggattacaggtgtgagccaccacgcccggccccagtttgggttttaaatgacagttttctctgttgtgctagcacctcccctcagttcagggaccttcacccccagcctgggcatttcgtctggaatgagacttgtggggttgcttggcgcttgaggccaggatgtactctgagctgctgatggccatctcctctcctggggcctcgtttccctctgacctcctgccctcatcacctggtgatctggacccagggccatatcccttctctgcccagttacttggggcagtgatggtgtcaggccgtttgtgggtccccctggtgccctgtctgcccctccacaagacctgggaactgcgggaggatatggggacagcccaggggcaggctggggttcctgtgtgctcgggaatgcccctcagttccgcatggccttgtctgtacatggtgtgtgtgaccttgtgcccgacggtctggagggaccattgagtgggccattgcctgtccaggcctctcctgtgctccagaatgttacgagggacacctctccaaaggggtgggtgggggcgccgcgttcacagtcagcaccctggacagcccatcccccagctgctggtgcatcccatagcagggccaggtcccccgggaagtgggggcatctttgtagagctggcagacccctgcccaccctggggctgtgccccaagcccagtgctcccagtgaggacagattctcttaattagggatgtcccttggcacttctgccacggagctggcctctggtcctgcacactccagacacatccaccctggctcacacacaccctggctcacatgcaccccggatcccacccccgctgacactcaccccggttcccatgcaccccaggctcacatgcactcccggctcacacgcacccctgctcacacgcacttcggctcacacgcactccggcccacacgcaccccgctcacacaccctgctcacccagttcccacgcaccccaggctcccacggacctccgctcacatgcaccccggttcccacacaccccaggctcccatgcacctggctcacattcacgcctgctcacacgcaccccggctcacatgcacccccgcttgcatgcacctcgcctcccacccccgctcacacgcacccccggctcgcatcctgggctcccatgcacccccggctcccatgcacccctgggtcacacgcatccccgctcacacgcaccccagctctcacgcacccccgggctcacacccccaacagcttgcacccccggcacacatgcaccccggctcacacgcacccctgggtcacacgcatccccgctcacatgcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccccttcacacgcaccccgggctcacacgcaccccggctcacacgcaccccctctcacacgcaccccggctcacacgcacccccctcacacgcaccccgggctcacacgcaccccgggctcacacgcaccccgggctcacacgcaccccctcttacacgcaccccgggcccacatgcactccggctcacacacaccctcactcatgcaccccgggcccacacgcaccccagctcccatgtacccctgctcacatgcaccccagctcccatgcatcccgggctcacacacaacttgactcacacgtctcaggttcatgcatccgtcccctggtgcgtctccgggccgccctccaccgggctgtgctggctgccacccccaagcctcttcctggtctcctgggaagcctcccctatcaccctaagctgcttctggggctggctttgctcagaagccacacccaggctgggcactgtgcccaggtctcctattggctccctgcagccacgaggggctgtgtggtcagagccagcaagtcagcccctgcctcggtactcccaatcctggggcccagagcacaggggtgacccctcttcctgcacccagtctgtccagctcccctgtgcgctgtgcctggcctgctggggaggggctctgggcgtgggtgtcagagctcagcaggcaccaggagccaatggctcagcagagcttcccaagataggtcctgcgctggcagcctccggacagcgttctgttttgaactttaagcggagatgctacctctggaaggccggggaaggacagagcctgccttctccccaggatggcctgagcgtgtgtgggacttgtggggccccagcagtggggggaatctgctctgaggggattttaccctgtggagcccagagggaccgaagacaccagtgacaggcctggcctgaatcttggggcaccagcagccatgctggcccttgggcagggagctgtgtcccatctccccagcacagcctcctgcctgccagccagccagtaaaagggtggcggcctccaacctccagcctggcgctggctgatgcactgctcagggaggggcaggtgagcgtgcacacgaggagggggcatctcccacccccaggccccctgaggcaagagtgttggggctcatgggccctccgtgggccctgccagggtggaggccccaggcctgtcttgagctgggctggtgttgcaggtgggggtggggcggctgctggtggccagcagctatcccagccttggtttctgtctggaaagtggggtgtgagtctggccactggggcttgggaggcttttatggggtgacttggggcttctggtagtcccccgggaacccccagagcctggggtctgagcctgtcctcaggcatgtggtctgggtgctccaaggggtttcatcaggttgaggggtggctttgccagcccattcccaagtcctgtccagtccagggtggggcagggatcccccagggctgcgcggcccttccccagaaccagtcaaccgtcggcaccccaggatgtctacccaccacccacctgggcacccacgctgcagaccgggagctggtcagcattttcgggggactgcttgtcccgtgcccaggcctggaacatatctcccgtctcatcctgaaacggcccaagcccgaggcctctgtctgaaggtggggtcctggcggacccctgcttcccttgaggccttgctgggccagcagcctagcaccctctctctgggcgcagcaccccctcgtctccccctgcctcttcctgttttaattgatttttataagaacaagcacttaggaaacacagtaagagctctggcggttacagacactgcaggaggtggccctccgggtggcaggtgctcctgtgggacccgcctgctttgttcccaccagtgcccatgtggctgtaagaaatcataacttggccgggcgcggtggctcatgcctgtaatctcagcactttgggaggccgagacgggctgatcatgaggtcaggagattgagatcaagaccatcctggcggctgggcgtggtggctcacgcctggaatcccagcactttgggaggtcgaggtgggtggatcacgaggttgggagatcaagaccatcctggctaacacggtgaaaccctgtctctactaaaagtacaaaaaattagctgggcgtggtggcgggcgcctgtagtcccagctactcgggaggctgaggcaggagaatggcgtgaacccgggaggcggaggttgcagtgagccgagatcgcgccactgcactccagcctgggtgacagtgcgagactcggtatcaaaaaaaaaacaaaaaagactattgtggctaaaccatctctactaaaaatacaaaaaattaaccgggtgtggtgggggcatgcctgtaatcccagctacttgggaggctgaggcaggagaatcacttgaacctgggaggcggaggaggttgcagtgagcccagatggtgccactgcactccagcctgagcaacagggtgagactccatctccaaaaaaagaaaaaaagaaagaaatcataaccaggagcagagtgtgagggaatcagcgtttctcctgccacgagtgacaggggacagctggggacatcacagagatcttgtcgggagctgggaatcggaatcctgggaccacctgccaggaagccccatcccggagtgagggcagggctgggtctccctgacagcacagtctggaaaggctggagtggcctgtcaggtggggagtgagccttctgccctgcgcagaccagacggtgaagcggggttaggggtgtgcagactgcgtcctggggcctaagatcccgtccctttggctccaggccaggggttgggcggatccctcctagagggagtggttcagaggcacaagggagcctccccgactgtggccatggagtgtgggtttggggatggggtgccagcccagggtgtcgggaaagactggcctgccctggacacccccccgggctgccgtgggatctagcaggactctgggtggttctggctcaggctggcaggcggcatggctttgggcttgtgggccgggctctgccctggggtccagagcttgcattggggcctcaccctgtctgtgtctctcctgttgctgtgccccagctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcagcctttcacgggcttgcggtctccgtgactcattcctgaccaccccacccccactgtggccccttccccagcttcttgttgggggcctggtctctcagctccctgggaccggctgctgggacgatcccagcccccacctcgcctcggggatggacttacaggcagggatatgtttatcctccttagaaatgttaatcacagataattaaaaaggaaaagggctcctagatggaaacacaggcttgctactgattaacatgcctggccgaggccgtgggccctgcggagggtgtgcagcctgctgaggtcctaaatcacgaggcttccgatcactcctttgtctgggaagccctggatgggttggggcctcccttaggtcgcctcagccagtccactcccctccgtaccccttcctgggggcaagccccaagtctatcagcctccctggcatcaggttggggcccagagacccctggaggcagtcggtgggggtctgtggcagccctactggggcttggagctcctcagttgaggaagctgctgtgtgtgggccccaccaggcctgcagggaccgaagcccaaccccctttcccatgggtgacttgggaccagaaccctgggtacctcctgggggtgaaggactcctgtgtccttagcccagcaccctgtctgccccactcacgcccactctgcctgggccccccagctcctggacacatgctgtccatgcctgccctcctcttttgtgggtgtcactgacccccgcatggaggagcagcagggctggggtcaggctgagctttggggctgccgccaggcgggggaagcttgcatggtcagaggtggggcttgcagcctgtggtcttgctggagggggcatcagccacgctggctgccctgaggactgtgacgtgtgggcagaaggggcctctgcagcccagctgtggcccctgctgggacatcttcccaccatgaagacaggcacccagcgaggcacctgccagacactcagaggcccctggatggaggtgtcctgaaggcagctgacaggggctggggcctcaggaacagggatttgtgcccacttgggggtgtctgggttgccccagggatgggggcaggggaggggagcccaggccagcccagggccccacactcaggggctgagcaggacacaacagccacagtccctggacctggggccaagggttctgaggtgggggcggcgttctgggctctctgggagtgggggcctggcagaggtttcctggcagcaccaggtatccatgaggtacgtggccctggcccctggcatgctgtggggcggaggctgtgcggcctttcgggtccctgtctgagcctgccccctccacagttcttcctgctgctgctgctggtgttcctgctggaggccaccatcgccatcctcttcttcgcctacacggacaaggtacggctgccttggccgcaggcccaactgcagggctgggggctccatcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccacacccccagattgacaggtatgcccagcaagacctgaagaaaggcttgcacctgtacggcacgcagggcaacgtgggcctcaccaacgcctggagcatcatccagaccgacgtgaggcgtgggcaggtgggcggggtcggcgggtgccccctccccctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcggtgagtgagacccccaccctgggggctggtaggggcctagagggcgggaccagcaggccctgccgtgacacgcatgacatccctccctgcagccgtgctacgagacggtgaaggtgtggcttcaggagaacctgctggctgtgggcatctttgggctgtgcacggcgctggtgcaggtatggcctgggggcctgcgggctccctgcccccactttgttgggaccttctgagcccagggaacaaagtagcaaagaccttgcccccaggaacccacgatcgggggaggccggggcaaaagcaggagggcgagttcagggggatgggcagggacggcctgtggggacagtgggctccctcctagtggacagaggcagaggctggtgtggggtggaggccggtggtcgtccatgttggtcggtggcccaggactggccagtgcacagagggtggcagctggggccctggtgccagtggcccctggtttccaaactccacagccctcaggaagttctgggtgtcctcatgcctgcaaggctcaggggagggtgctgtggctcgagccacaggggttgggtggggcgtgcaagccaccaggaagctgaagggctctgccactgtgtcgcccaccctggggtcggggtcagggccagggcacctgctgaggacagggaccgctctgggcttgaggcctgagcctgtggagctgccatgcccagtcctcctcccctacctacagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttgcgtctattgctcgtctgccttccctaccctatcttcccttctggcacccaggcctggggcagggcagcctctggcatgaacggtgcttaggcagagccctggggctgtggggtcacctggtgcacaggcttgggggagctgcctgcagagcagtctccagacctccggttttaaggaaatcatgacattagctctaagaagtgatgaggccgggtgcagtgactcacacctgtaatcccttcggctttgggaggccaaagtgggtggataacctgaggtcaggagtttgagaccagcctggccaacatggtgaaaccctgtctctactaaaaataaaaaattagccgggcgtggtggcgggcgcctgtaattccagctacttgggaggctgaggcaggagaatcgcttgattccaggagatggaggttgcaacgagccgagatcgcaccactgcactctagcctggatgacacaggaagagtccatcatctcaaaaaaaaaaaacaaagtaataaaaaataaagtgccaaggcccctggggggccgtccctgaactgccagcctttgctaggggtggcctccctctgcttcacccccccaccccgggggctcctcctgaggcgggcctccctccacatcgccccctaccctggggcctgctgtcgaggcggggctgtgcttttcccctattttgttcctagaactctgcccctttaagtgagctggcagcacaaagcacctgtcacagggcatgaaaaaaaatgcatcaaggtgcctcaggattctcacagccaggggtgagggttgtgtggggaccctggccacagggatgacggtcagttcaggttggggcatctgatccccaaactgcaccccacaatctcatttccagctaattcctgccccaccctctgcccatccccccgggagacacagcccgctctagacatcccatcctgtgtggcatccccacccctgcctccacccaatgctgatctggcaatgcctagctccaggcccacaccaccctcccagacctgcgtgtcccccaccctcactccaacagaagccacaggacccccgagaacaacttgaatgttagcgtcagcacctctggggagacaaggtcagtgccccaaagccagtggcagcttgtgtttttttagacaaggtttttggagtgcagtcggtcacagctcactgcagcctcaacctcatcaagcgatcctcccatctcagcctcctgagtagccaggagtacaggcacatgccaccatgtcttgctaatttttctatttttagggggtagagacggggtttcaccatgttgcccagcgttcctcccgccacggctttccaaagtactgggattacaggcatgaaccgccgcacacaccacttgtatctcctatgcccgtgtcaagcagcagcagggcggtgggaacggctgcacctgcactgtggcagctcgcaggcctccctgacgtccaggcggaggctttctcaagtgtgggtgccttgggtccgacccaggaccccctccccagctcccgtcctgtggaggagaccccaccatgcttcctcaccaccggctggagatgtcctgaccccctgcccactgcgccctaacattactgactctaaaccagaacccagtgcccaccctgtcctcaccgtcctcaccccacggcattctgagtgagggacgcccaggcccacccactccctggactcacttctgtccccccgagagaccttgcccgggacatgtacccacctatgccctctactgcccacctcagccctgtgggacccagtggtgaggaggggagtcctcacggccagccaaggacaggatggtgacgaggggcaggggaacgagggccaccaggccttggctcatgatgcctccaaattccccagggcctccccagagcctggacaccgctgcatggcagggtgggtgtagcctgccagccacatgtcctctgccccacccctc

SEQ ID NO: 15733 - DNA, 84587 bp, Human
  misc_feature (1)...(84587): n = A,T,C or G
atatttagaccgtgtaccattatcaaaatcagaaagttaacattgatgcggccgggcacagtggctcatgcctgtaatcccagcactttgggaggccgaggtgggcaaatcacttgaggtcaagagctccagaccagcctggctaacatggtgataccccatctctactaaaaatacaaaaattagccaagcctagtggtgggtgcctgtaatcccagctactttggaggctgaggtgggagaatcacttgaacctgggaggcggaggttgcagtgagccgagattgtgccactgcactccagcctgggtgacagagtgagactctgtccccccacccccccaaaaaggaaattaacattgatgcatggtactaatctaacctacaagtctaattctgatttcatcaactgtcccactaacatcctgtatataccaagcttcttatcgtcatcatctctggtaatttccccaattatccagtgaatttgatattattagccctgctttaccaacaaagaaactaagctcagagaggttaagtaatttgcccacagttacacagacagtaagtggcagagctggaattccaactcaagtgtacttcctccagagcccttgttctttaatactgaactagaattgcagagcttggaaaggacttcacagtgcaaggacacggaattggtactacaggcatgaaaagaagccaggcacggtggctcatgtctgtaattccagcattttgggagttccaggcaggtagattgcttgatcccagaacttcaagacctgcctgggaaacgtggtgagaccctgtctctacaaaaaatacaaaaattagccgggtgtggtggcgcacgcctgtagtcccagccacttggtaggctgagacgggagaattgcttgagcccaggaggccaaagctgcagtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtttactgcaacctccacctcccgggttcaagcgattctcctgtctcagcctcctcagtagctgggattacaggcgcctgccaccacgcccggctaatttttgtatttttagtagagacggggtttcatcatactggtcaggctggtctggaactcctgacctcaggcgatccgcccgcctcggcctcccaaagtgctgggattacaggcgtgagcaggattttcattctaacaagttccaggtgagttgatacagtggctccagggaccgaccacattttgctaacccccggcttagagttattcaaagagcccgtatatgagacgcggattccatctagggcgtttaggtttaatgattaacaatttccctcttctgctctctcaaggcagccagggaacagggagaccatgattcatgtccaatccccgaggcgcgttatcaagctgctgaaagcaggccctccggactgcagttccaaagggtcccttcccagggaagacgcctgcaaaacccagatagtactatcctggagtcacgcggcggcgcgcagcctcctagccgcccccacccgcccggctcggccacagcggggcggggcgcggggctgagcaggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgctgctggttctgctgcttctgggccctacgcgcggcttgcgcgtaagtctgcgggacccgggtacggggaggcattgctaggggacaggctggcggggaaccgggctggggtcgcagccacccgcggtcccgcagggcggggagcctgagccccgaagtgccccccagcaggctcgcggccggcggaacgcaggcagtggaccggccttccccgtcgggggcgggccgggcggggcgcgcgtccttccaggcagctcggtcgcttgtgcgttccgctccggccgccctttgcgcttggatccacttccccatctgtaacgaggtgttgagacgaggtgcgtgtaaacatttcctaagttggctttccgggaggggattccaagttgcgcgggttagagggtgcctccggctctggtttggggcgccctcgctttcccagttggtgctctgcggagcgctccggaaggagaaaaatggggtcaggagaggcccttgcagtgggaacattgggttatttcccctctgggtgctctccctcttcgtgcatcttgttcctttctcaccactccccgtcgcctgccctttggcttgggtttttctttgtatttgtgggaccgttttccttcggcgtttgggggtccaggttgagggggggaataggcaggctgccgggggatgccatcgttgatcggggcagggctggcgaggcgaataggtgaggtgcggggcgtgcacagttggtgggagaggaaggacagcttcactcgctgcgtccgagctgaggcgactggctgaggggctccaaagcgctgcctggggaggtttgcatcacacctgcggaaaggagagtgggtagttgcaagctgctcctctgcacgttccgcggaccaactttggttcctccagggtgtaggtgggctgagcctgcagtatgctttaagtaagagctggtagcatttgacaccgttgacttgtaagttacaccctttaataacgctttcaataacgtgcctagggcagagaaaagtggtacatttatctacaaccaagattgaacatcttaagtatttggaaaacagctgctgaaaatgttttcattttgggaaaaagtcagcacagattatttgctgctccctcttcaccccgtctgtggttcccctaccccagtatgtagacagagttttcttgtccagaaggcccgtaggaccttaggagtcagagctagccagctgtgagaaccactggggaaggtggaactggggcacagttcaggagaacagtggcagggtaaggggctaggggaaaggcagatcttaaccagtatctgggagtgggggtagggagagagagaaggatttatgaaccaggaacaggtggacagggtcaatctgtctgatgtgagctcatcagtcttgtgcagcgtcattgggtcagggtggatgccctgtggctgccatacctgaggcccacacagggaggctggcatcaccccaggaattctcatttcaggtgcctaggtgtccctcttgggcttctgtgcccacagctaaagaaagataccagcagtctagctttccattatctccttgtttacatttctttagggttcacgccattctcctgcctcagcctcccgagtagctgggactacaggcgcccgccatcacacccgactaatttttttctttttttgtatttttagtagagacggggtttcaccatgttagccaggatggtctcgatctcctgacctcgtgacccagcggttctcaaattttaactaaattttagctgtcctagaaattaagagaatattcctttttttttttttttttttttttttgagacagagtctcgctcttttgcccaggctggagtgcagtggcacgatcttggctcactacaacttccacctcccaggttcaagtgattctcctgcctcagcctcccgagtagctgggattacatgcatccaccaccatgcctggctaatttttgaatttttagtagagacagggttttaccatgttggccaggctggtcttgaactcctgacctcaggtaatctgcctgcctcggcctcccaaagtgctggaattataggcgtcagccactgtgcccagccctagagaatattttaaactatttgttaagaaatactacatcattacacgttaataaacaatatatatatttgaaaaacaatagtatttctccccaaattttagggtgaagagttgcactgttttacatttctgcaaatctctttcaatgtctcttaatagaagacagtcaaattttcatgtttatttctgcattaaatctgttgccatatcacatgtcacatagcctctggaagactccaccctcaggacagagtgagaatggaaaaggcagtaatggcttggaattataataaaaatagttttgactaattggacccctgaagggctctctccagaccacactttgaataccgctgatttggaatgtttttataaaacaagtacatgcttactgtagagaaactttaaacgtatagaacatgtggtaagaaaatgaaaactgcccatcatgtcacaatgctgtgagtttctttttgaataataaagtatagctagcaactgactggtatttgagtagcttggattcaaggtgggttgggcagatgtaagtggcctttgagttttgaatgggtacaaggacactctaatatcccacaaagctgatgctggttcctggttgcaggcggagttgacctggaaacctctccttggccactgtcctttctaaggaactcatttccagagtccaccagcacagaactggtgggggagcctactaggagcagagaaaatggccatcttcaggcagctgtccctaggcgcgaaggccaccctggctgctgtcactgtcttcgtgtccatgatcgcctcccgctcgtatctggcagagagccttgagctcagggcctggcgttggctgcttcgcttgcagcttgccctgtttgtcaactcgctcttgctcattggctccctctacatttggcgcagcacagtgagcaacctctgccactccccagctgcagagtcaacctgttttcagctttggaaggtggtggttctggcatttctggccctggcccattccagtttctttaccatgttctttttagtggccgaagagccctatctcttttccttggcggcctactcctgcctgggtgcttacatcatcatgctcttcttcctcttcatcctcagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttcccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttcctcccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaatacccatccatgcttttcttcccctcgtgttttgtttggtttgttttaaacttttcgtacatgtacctctctcccagctttaacaagcatgacgagaccactctgccatcctttctcagctacccctgccccacctgtactctttattttttggctggagtatattaaggtaaatcatagaaaacataatgttaccccaaaattacttcagtatgaatcctttttcaaaaagcatagctatagtgtcattatcatatccaatgaaattaacagtgattcttgaatatcatctaatagctagttaggagatttggggctagtagccagatttttgacctctttaaagaagtgttctttccactctctgagtattaagtagctgtatctgtcacaaatgagtacagaattcaaatgcagttaactgtgtgaagagttagtgtttagtttttcctgattatctcaactatattttttattgtggcaaaaaaattactatcttaaccattttttttgttctttttgttgttgttgatcttaaccatttttaagtgaatagttcaacagtgttaggtatattcacattgttgtgaaattgatctaattgatctgtagaactttttcatcttgcaaatctatatacccattgagcaacaaggctccatttcccccttcctccagcccctggtgaccacaattctactttctgtttctatgaatttgactgctttagatacctcgtataagtgaaatcatgcagtttttgtctttttgtggcgggcttatttcagttagtataatgaccttaaggttgtggcacgtgactggatttctgtcctttttaaggctggactacagtaatactcttgtattttcatgccacattttgtttatccatgttgagcatgttttcatgggcttgttggccacctgtataccttctttggagaaatgtctattcaagtcctttgcctatctttaaatcaggttatttaatttattgttgtggagatgtaggagttctttatatattctggacattaaccccttatcagatacgtaatttgcagatattttcttcagttctgtacattgccttttcactgattgtgacctttgatgcacagagttttaaagtttaatgcaggcccatttctctatttttgcttttattttggcatcatatccaagaaatcattgccaagttcaatatcatgtagcttttttccccatgttttcttctaggagtgttatagttttgggtcttacgtttaggtctttaacccatattgaattaatttttgtgtatggtataagataagggtccaacttcattctcttgcctgtgaatatccagttttcccagcactgttttctgaagaaattgtccttttctaacatcaagagatcttggcatctttgttgaaaatcatttgaccatatacacaagagtttgtttcttggtgttctatcctctcattgctctatgtctgtctttatgtcattaccatgctattctgattaccacagctttgcaatatgttttgaaatcaggaggtatgagtctttcaactttgctcttctttttcaagactttagtctatttggtgtctgttgagattccatatgaattttaggataaatttttctatttctgcaagaaatgctattgggatttttatagggattgtgttgaatctgtgaatcactttgggtagtatgaacatcttaacaatatgaaccttccactccatgaacataggatgttttttccatttgtttgtgtcttctttaatttctttttaacagtgttttgtagttttcagtgtagtctttcaccttagttaggcctatttctaagtattttattctttttgatgcttttatatatggaattttttgaaattccatttaggattgttcatttttagggtatagagaagcaactgattttggtatgttgctttttgtatcctgcaactttgctgaattcatttattagttctaacagtttgtgtgtgtgtgtgtgtgtgtgtgtgtgtgtgtgtgtgtagtctttagggtttcctacatctaagattatatcatctgtgaatcgatcattttacttctcctttctaatttgaatgccttttatttctttcttgcctagttgctctgactaggacttccaaaactatgttgagtagaagtggcaaaaacagacatcttgcctttttcctgatcttagaggaaaagcttgcagtctttcactattgaatatgatgttagctatgggctcttcacatgtgggctttatgatgtggaggtagttttcttctattttgcatttgttgagttgttggtttttttaatcatgaaagggtgttgaatcttgtcatgctttctctgcctcaatttagattatcatgtggtttttgcccttcaatctgttaatttggtgtattatattgattgatttttatatgttaaaccattcttgcattttaggaataaatcccacttgatcatagtatataacccttttaatgtactgttgaattcagtttgctagtattttgttgaggatttttgcatcaatattcaccaggaatattattgttctgtagttttcttgtagtgtatttgtctggctttggtattaggataatattggtctcatagaataaatttagaaatgttcctcctcttcaacttttgtaatagtttcaggaggattggtattaattcttctttaaatgtttggtagaattctccagtgaagccatctggttctaggtttttctttgagtgtgtgtgtgtgtgtgtgtgtgtgtgtgtgtgtgtgtgtgtgcgcgcatgctgagacatggtcttgctctgtcgccggggctggagtgcagaggcatgatcttgggtcactgcaacctccacctcccaggttcaagcgattctccttcctcagcctcccaagtagccaggaccacaggcacgcgccaccacacccggctaatttttgtatttttagtagagacggggtttcaccatgttggccaggctggtctcaaactcttgacctcaagtgatctggccgcttccccctcccaaagtgctgggattacaggcgggagccaccgtacccggcctctttgaggtttttgatgactgattcaatctttttaatagctattggtctgtatagattttctgtttcttcatgattcggtcttggtgggctgggtgtgtctagaaatttatccatatcttctaggttatccaatttgttggcatacagttgttcatgctattctcttacaattctttatttctgtgtcatcagttataatgtcccctcttcatttctgatttatttatatcttcttttttttaaatctagttaagtttctcaattttgttgatttttttttcaaaaaccaactgtttttttttcctactatctttctattctcttttgtttatttctactctaatattttatttccttttgctagctttgggtttatttttttcttcttatggaattgtctttttatagttattttgtttgaaacaggatctaaaaataggtctatattttgcctgtggtgtatttcttcagtctccttaagtctataacatccccttttccttattttttatcatttatttgttcaagttatctgggtcatatgtcttaaaattttatacattttagattttggtgtcatttaacatgttcatattttctgtgagctcatagagctaaagctctctaaaggttagagctagaggctggttggattcaggttcaactttttcgctttttgggtaggaagaattcattgcttcactgatattaagattgacctgttggtccaggtgttgtcagcttgatccctccgctagaaaattccgcattatctttccatttaatgtttcagcagtcattggtgattgttgcctaatgtcattatttcactaaagattgcagaatagtgatttgtaaaattctaccctttttttcctgcatttactggctatggatcctttacaaagaaatctcctcattaattatgtggttactctgaaaaagcctataacaaaggcaagacagataccagattctttcacttgattccttagtttatagcataatgatctgataccacagcaacctccaagaatgaccaataagcttttcttctgggtgggtgaaatattgttaggaatttagatatttagatattttatatatctgatgttttttagttcatcaaagtgttacatcttttaatactcaaaatagcccatctttggccagttgggaccttttcatttttcattttttactttttagagtcttagtcttgctctgttgttcaggctggagtgcagtggtgtgactgtaactcactgcactctcaatttcctgggcttaagcgatacactcactttggcctccagatagctaggactacaggcatgcaccaccaccaccactcctggctctttttttttttttttggtagagacagagtctctctttgttgcccaggctggtctcaaactcctggcctcaagcagtcctcagcctcccaaaatgctgggattacaggtgtgaacctgtaatcagcctcccaaaatgctggcattacaggtgtgaaccactgcacttgagctggttggagccctgtcatcttgtcattttgatgagaccctaatagttttgtttttttttttaatctagccctgttttgtacatcttatgccacagacttggattaactaatttcttgaagaagcagctttggttacttttagtgggaaatgtttgcagatcacaatttaggcgctatatgggttagattgctacccgctgatatcatttccaaactgtgtctttgggtattgctaggaaatgcaatacttttttagagagaaaaaaaatcataagtgtatactagtatttacaattcaaataagagattatggattttattgttttttaatggactatattttttagaatagttgtagccttatagcaaaattgagtggaaggtacagagattttcctgtatctcctgattatggggttcttaattttgtttgattttatgtttgtttctctctctctcgctttttttttttttttttttgaaacagactcttgctctgtcactctgattggactgcagtggcaccatcactactcactgcagcctgaaccattctgggctcaagcaatcctcccacctcagcctcccaagtagttgggaccacaggcatgtgccaccatacccagctaacttttgtttattttttatagggatgggatctcattttgttgtccaggctggaacttctggggtcaagccatccacccgcctcagcctcccaaagtgctgggattacaggcatgagccactgcacccagcctgtttctcttttacactgaaaaatttggttcttagtaacctaatgtagttacttacttcttttatcctactacatatataatagaaccaaaatagtaacgtcaatgtggttattaagatgaagtctactgaatgcagtttgcttttgtttttttccctgaatgcagtttaagctgtatttttatccttaggccaaatatggtcaatgtagtgtggaaagttagatctgtatgtttttaattttaaagaaattacatattttttaatttaatttttatttttttaaactgcacatttaccttttctctgagatgagggggcacatttaaatctgtgtatgtccagagtccgtgaggattgggaatcagtctaaagctgtgctcgcttctcctcttccattgcgatttgccttctttatccagtcttttggaatgctgaacaaaaatgtttttggcacaaggcaggcgtgaaaacataaagttaataaaaatcgaatgcataagctagagcagattatccacagattcttccatctccatatagattatcaccattgcctgcacctgttttccttctccagcctatctgatggaatggtgcttccatgacatgtggtatttggaaggctcttagctctgatgtaatcagggtttgacccatagtcacctgaaatagttcttctgtttctctttgttctatgaactgaagggtctcagaagcccgtgttatgcaaatacccttccatccccttccctctccccttgcctctatccatgttccctcagcctcagggtgcttgcaggctaagaggattgggtctctggcatcctggagctgaacagctcgtgtcaggaattccccaggcccttgagtctctggggtgagttgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaaactgaataaataactttttaaaaaattacattggccagtattaggttcctgatacgtatttggtgttttgtttgtactgctgggttttttctctccagtattggatgcgttaacggggagccttgagaagttatgaattttggtttgttcggaattgctttttataagttttctgtgacctcatgcactaaatactgatgctaccacactcctgcaagtatgaaataaaagtatgtctcttcagtattgcattcctgcgccaattcatttagaagggtagaatttgcacacaggtcaaatcttgcattatttgcatttggggggaatacactctgaaggcagttttctctctctctgtctcctttttcctcctttcttcctcctattcccacttttttttttttttttttttgagacagagtttcagtcttgttgcccaggctggagtgcagtggcgcgatcttggctcactgcaacctctgcctcccaggttcaagggattcttctgcctcagcctccaagtagctgggattacaggcatgtgccaccacacccagctaatttttgtatttttagtatagatgaggttttgccatgttggtcaggctggtctcgaactcctgacctcaggtgatccacctgcctcggcctcccaaagtgctgggattacaggcgtgagccactgtacctggcctattcccactttttttgatcgccttctgtcagtagttccacagctcagaggaagctcaaaggaagctgggtcttttttttaggtccgtaacttttgagaggggtcatcttgggtccatgaagtggactgtccctgtttactttggctgtgacagtcaacaatgatgaactgtcttttaagtgatactgcttctgcagctgtccatcttgatcccctctctgtggcttttctaggtttttgtttcagagacatgtcccctgctctcctggttcaaataacatggtgatgttcatctctcagaccatgacagtccatgaatgcacagacagtccaggtctcgtgtgatacagcagggcagtggacacagccccgggcaagagggagaatatactgctgtcctgcccactcacgaactgttttcaatcctttttatcagtaggatttgaaaagattagaacattaatcgcaaaccaaatatcagaggctgtgttgttctgtcccagtggtaatcccatacctacatggtagctgcttttggagctactactcggttaattaagtggccaccatcatgtactgtgatctgttttttctggcagaggctcacgggcaatttgaatgaacatgatggaaatgatctttaagtctttgtggagggggcactaatagctacaattcccagaggattgtggtcttgcttcagatttatcttgagtgggagtggggagtgggcagttccagagcttccacttgatccatgatggctcctactcattatgagggttctgcaggccattatgtaaaaccatcccactttgaactcatagccagggaaataaccgtgtgatggatcctctgatttgttggactctctgtgaaaaggactggggccaaggctcccattatccctggcctccctaagagtgataagggagagtgatggcatttcaggttccctggtgctaccatgtcagttcagactgtatccagtagtcctcagaaggtggtggccttggggtgccccttttcttaggacacagttaccctgagtcttgttgggaaggattggaggaatatttactgtgtggacttggggtggtaatgcaggatccttcctcaaggggatccatccaaccttccatcaaattttgttgactgtatgttagagaactggctcaaagctgggaattggatgaaggaatctcaattttccatgcagttgttgacatcagccttttgctcacaagtttttaaacatgtcaagcagtactcttgctgattgcctggccaactcaccccacagaaacgtgtggcttatgagccactgcataaggtcactcctggtccacaggtcagcacaccctggttgccactgtgaccttgctggttgttgtggtaattgtgccttcctgcttctgatggttaagcggtcccatgctggttatgccagaacctcatcatccccagcgacactagggcgccccttgcctgcagaggatggccccactgggggggcttcccaagtatgccagggccctcctcaccagtgccttccttcctgaagggagagttctctgggctctcctggggaatagagccaggtagtggggtctctggtcaccctttttacattcccacctcttgagccattccatacctttctcaggatgccaaggcagtcctggcatcctcacctcatttcctgtagaccagcgtcatgtctaggttccaaggatcctcccaacagcatagggactgggctcttaccaatagaatataggtcatgggagaatacaccctaccagtaacttccccatatccggcctgggattttccccctcaagatccattcccagtgacccccatagttaggtcttacttttctggcctgagatgtgagtctctttaaacattgccacagaagcctctgatattcataggatgccctgagtggatggctcacctgagcccatcaaaccgtcactgtcttcaaagcttccaaatctgttaataaaagccagctaacctcacactcctttcaatgaccagtgacccccacctctgccccgctccaggggtggagccagtgcagataccgactgctccccctctctccatgcctcctcccggtcccacagagttgagggccttggtatttgtctttgaggcgttaccaccccacttagcaccagctataaggttcttgctatttgacattcatgagacaacaaggtgcagactcacatcctgatgatctgctgttgaggccactcctggtatcaaggtcgtactttgggtccctctagaagcagaacattgggtgcaagtggtttgagaagtgatccaagagcataggagcaagggacaggtggaaagaagggacagcctgggtcagaatgcatattgtagttatcactctgggaaccgggacatgattcttctgagacctcctgaaaagtgcacaaagtgtctccagaattatttgcctaaaaaacaagagaatgcagttctccaccctctttgtccctcattggctgaaggttgccctcaggggcatggactgcctggtgctcctggacttctgggctgaacccattcccccagtgttggggcagaaaggcaaaaagacatgagatctgagtgtgagttgagacaatcagcacaaagcatactgagcttgcacaagaccattcacagagctacagctgatgtaggcatgtttttaaaaacttttaaagaccaggcgcggtggctcacgtctgtaatcccagcactttgggaagccgaggcggcggattacctgaggtcaggagctccaaaccagcctggccaacgtggtgaaaccccgtctctactaaaaatacaaaaattagccgggtgtgggggcaggaggctgaggcaggagaattgcttgaactggggaggcggaggttgcagtgagctgagactgtgccattgcactccagcctgggccacaagagtgaaactccatctcaaaaaacaaacaaacaaacaaaaaaaaacagttttcaggctgggcacagtggctcacgccagtaatcccagaactttgcgatcgtgaggtgggaggattgcttgaggccagcagttggagaccagcctgggcaacatagtgagatcctatctctacagaaaatttgaaaattattaactgagcatggtggcgcacccctgtggtcccatctacttgggaacagaggtgggaggatcgcttgagcccaggaggtcaaggctgcagtgagccatgatcatgctgctgcactccagccagagcaactgagcaagaaagaccctgactcaaaaacaaaaaactctctcctctgccttctcttttcaccctatatccctcccaaagtgctgggatatccatcggagatcatttcacaatggcaagggctacatactctccagagctgcgtaacatttgatcatgtatgtgtatttgtatatatacaaacatgcatgtacaatacacatacaatataaaccataattcattttatcagtctgcatttttatttgtgtcaacattttgctaggaaaatttttcagagagggttgaaagattataccattaacatattactatcagtccattcctccatctatcaattcatcttattttttgaatgtatttcaaaataagttgcagatatcaatgccctcctcttgctaaaataaatacttcagtaggcatatcattaactagcagtcagtgtttgttagtagcccctttttcttccaaggtaaaatttacatacaatgaaatgcacatatcttaaacgtaccatttgatgagttttaacaaatgcctacacctgcataatccaaaacccttatctagctatggaatattaattaccattaccccagaaagttccctcacgtcccttcccaggcaatacctacctctactctcccagagttaactattctgattttttcttccaccatagattagatttgcctttcccaggacttcatataaataggttcatgcagtatgaacccaattgtgtaaggcttctttctctcaacatttttgagatttatttacattattacaaataccagtagtttgttcttttttattgctgagtagtagtctatcatatacatatgccatagtttgctgaagcaggagaatcgcttgaacccaggagttcaagactgccatgagatatgattgagccattgcactccagcctgggtgacggagcaagaccctgtatccaaaaaatcttaaaaaattataatagtaaataaaaagtaataaaaataaaagaattaggatccaaaccaggttcacactgacctaatgaatatcgtatcatttcatattacgaatattgtaccataccttattacacatatcatatcacatataatgatctaatgcaatcattaggccattattcctctgaagttctttcatttccaaataatactccctttctttcttttaataccattgatttgttggaacaactgaatcattggacttttaaaatgtcccacattttggatttggcttattgcttccttatggtattattagattcgggttcaattgtgattttgattcaataatgaggactactttctagatgagactgtacttcgtgttaaatcataacatgagagacataatgtctggctattcgacttttattgaggctgaaattgagcagatggagcacaaaaaatatgcccaatccttcacacaatttccatcagtgtttctaatggttttagcatctattgatgattatagcttaaatccatttcactaagtgttggggaaaaggtgttttcagatgcttttattccttctgcatttattgttattttgagacagggtccctctctgtcacccaggctggactgcagtggccctatcacatctcaccatcgccttgacctcctgggctcgagcaatcttcctgcctcagcctcctgagtagctaagactaccagtgcctgccaccataccggctaattttgtttgtttatttattttaaacaagaagtttaaacaacaagcttcttgacttgaaggaaaaactatctaggattcctttttttttttagactaatttatccctacttaaagacaaattgccctacatttaacaactatgtacaacaaagttataaaattgtccttggttttacaatgataaatgaaaaacattaacattctacaattgaataaagtatgcaaggatttttatgttttttttttgttaaaacagcaaaataacttactgaaatataaagataagagctgaatgagcatgccactaatgaagaaaagggagtatttttacagaatcggtatttttccccatctcatctccacttgatatcaatcaaaacgtaccattggctgtttagttaaaaaaaaaaaaagtaatatacttgtgcacatttaccagttactttatgtacaataaaggaatggggaagggggaaatgaaagaatagagaaaactatactgtagtagtcaggatgtggtggaaccaaattgcagttttctaattgagaatgtgatcttggtctgtaaagaacagagttctggagtgaagtgggaggttccctttttagtagacaccccctgactgctgttggaacatatcggttgtatcttcatcctccatttccaactgagcaggtgtgtctctttcattgattggttgcctgtcaaattggaatctgatctgtctcattgaccatccctatcgttcacaacaggctttcattagtttactaagtggtgtatgcctcttaatcctaaactgcaccacagaaccctcctgccctgccaccttcaaattaatatgatctttgttctcagtctcgattccttccttgggcttttcatctgccacggcaagcgcctaagtctcagctgccgcttcacaaaagaggtaccaagactgcaccgaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctcccaaattgctgggattacaggcatgagccattgtgtccgggcccttctgtatttaattaactgggatccagtggagaattttccattgtcaatgttttgataaccctgaaatacagtttttatgtgaaggggaagtaaactgcttgactctttctctgtatttatcacttttcatagtaatgagttggtactctagcagtctccaaaagtgaccaatgaattttttctccctgtaaattacgatgaactgataggtgttaatatacacgtagtcatattttttaaattgatatatctcttaagtctctcacatgctcgctctctctgtctctcattttgacactcagatttctccccaagaacagtgggagcctcttcaggttcgcgcctgtgcctcacatctaactggccaccatcctggaatgtcctccttctgcctcctgcccacctcattgtcaccaccgtgggccatagccacatctcttctgccttttttgcccattcaggaaaaagccaaacatttgaaaacacatatctggtcctatcattctttcatttcagttgctctccatggctctcagcataaaatccgggcccttgaatctggacttcagggctcattcgatctggccctggcctcctcctctgcctcagcagctgccatgtttcaactatattgaggctctgtggctcctggcctgtagtcctgccctccctcccccaggcctcacacgcagttttctccatctgtgtcaccttcccccatggctaacttcgctttatcctaggccttggctcaggccagtggttctcaaccttggctgcacattacatcatctaggcagctttaagaaattccaatgtctgggttcctcccaagaccaattaaaacatgaatgtctgggggtgaggtcaactttgctttttttttttttttttgagacagagtctcgcactgtcgcccaggctggagtgcagtggcacaatctcggctcactgcaagctccgcctcccaggttcacgccattctcctgcctcagcctcctgtgtagctgggactacaggcacctaccaccacgcccggctaattttttttttgtatttttagtagagatgggatttcactgtgttagctaggatggtctcgatctcccgacctcgtgatccacctgccttggcctcccaaagaactttgctatttttaaaagcttgcgtagatgattttgctgtgcagccaagattgagaaacacagtttggggtgtttcttcctttgagaaacttgcccttgcccctcccctcaaccctgccatgcctgggttccctgccatttatttctgctgcagcattctgctctaacccttactttaccgcctcgacctcactgtgttaacccttgggtttcttctaggctagatggaagctccatatgggttgtggccacatctgtgtggttcttgtctgtgattactcagcacgtaagaggtgcttggtaatactatatttgtaaatggatggtagggagatatttagactagactgaggtcattggagggtagagacagtgtcccaccatgtatgggacaaaggccagattccattgtctcccaccatcattttttcccagccttatctcctgctcctctgaactttttcacttagacaggtggatttcaaacagctctacccttttccgaattctgccagtagttgcttggcctcctttctacctgtctaatgaatgttcccacctcatgggccacctttgaacttaggaaacttgtgaggaacacttatttgacacttagccatgtatatactatgagaatgttttcaagagcatccattgagacacctggtgtaagaaataatttttctatttttgtgagtttaggggacttttcctttgaacagaaattaaaaccttatttactagaagaataaagtgatgttaaattgacacttgcccttttaaaaatgattcttagttgtttgtgtttatttagctttattgagatgtaattcacttacagtgaagctctccatttgcccctatgaattcttctctgagttgtttaacttccgctcgccagttggatttcaggcatgtgtgatctaggactcatgctgccacagttgcttccaaatacagcttcaagggcaacccccaaagccaccatggactatgatgctactgtgactagagctagtattgtgacctttgaaagcctaaagatgcacaaggaatctgacccataatggaaagcactagttagttggcttcttaaaaccctggttctcttggctcctgtggcctgttgctgccttatccaccagagggcagtgttccactcggcttaacagtcgaacccccacccccaccacccgttgaggtcttgcctttcaaaatcctaacattttagctcctgaagtgaccccaaaacagtgtttcttaaaatcgtgcttggtagaaataaatcttacattgcaaccaaatatacatgcgtacatatacaactccacatatgtatatataacaaaagttttataaagtaatactttactatgtgtaatatttctttctttctttctttctttctttctttctttctttctttctttctttctttctttctttctttctttcttccttccttccttccttccttccttccttccttccttccttccttccttccttccttctttctcgttctttcttttgacggagtctcgctctgtcacctggctggagtacagtggcatgatctcggctcaccgcaacctccacctctccggttccagggatgctcctgccccaatctcccgagtagctattttttttttaatttttggtagagacggggtttcaccatgttggccaggatgctttcgatctcctgacctcgtgatccacctgcctcagcctcccaaagtgcagggattacaggcgtgagccaccgcacccagcctctattttctttcttgccttttttttttttttttgagacaatgtcttgctctgtcacccaggctgcagtgcagtggcatgaacacggttcactgcactctcaaccttctgggctcaagcagtcctcccacctcagcctcccaagtagctgggagcataggcgtgtgccaccaagcctgcttaatttttgtttgtttgtttgtttgtttttttgtagagacgaggcctcgctgaattgcctaggctggtcttgaactccttagctcaagtgatcctccaaccttggcctctcaaagtgctagcattataggcataagcaacggtgcctgctattctttgatttttatttttatttattttattatttttttgagacagagtctcgctctgtcgcccaggctggagtgcagtggtgtgatctcagctcactgcaacctccgcttcccgggttcaagcgattctcgtgtctcagcctcccaagtagctgggattacagacgtgcaccaccatgcccggctaatttttgtatttttggtagagatggggtttcaccatgttggccaggctggtcttgaactcctgacctcaggtgatccacctgccttggcctcccaaagttctgggattacaggtgtgagccatcatgcctggacaattctttcatttttaaaagatgcttattgccaccaaaaatgagtttattattcacaaatcaggtcatggcccacaattttacaaatattgccttaaatgccttaaagttcttttagtctaataccctggatagttatggatgaagagaggtagggttagagatgggacttatccaggtcactatgggattcagagcaatatctaggatggggcgtcaggctctggagttttaatccattgctttttgccctgtattttacacttagaattttgttaatgggtcttggttatcccagtgacattgttgttgaggtgcatccagtgctcaggcaggtcacagcaacaatggcgtgtgtgcgtgcatgcgtgtgtgtgtgtgatgttccccagccccatgaacagcacagtggaatatcatctcagccactgattgtcagctcagtgctggcctctagaagctaagccttatggaatcctgcatgtggatcctcttagatgatttctcttacctgagtacccctggtggacctggcttagcaatggtttgtatgatagctcagaaaacaagcattaagtccatcagcacattatacaaattcaataggcagagagtcacttgctactctcaaaggatcggcttctgaaatgcagaaggtggaagttctcatgtgaccccatccttgctctgtagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtaagtaggagggcatgtggctctcacctaggcctgaacacccactctggagagaagatacaactgtatttctcagggtggctattttattgctcagaaatgggaaatggtccagtgtgatgttctgggaggggcttgtcatgagccggactggccctttttcaaataattaactacttcttccaatcttcaattttaatcatcagaaatcattaaataaatagcttaaaaaggaaaaggatgggggaagcaaacagaagtaacaatgattgagcacttaccagatacagggcactttatactaatgattccatttcctcgagataggtattattgttcctgtttatagctggtgaaactgaaatttgcccaaggccatatctttggtcagaggttcagctagtatttgaagggaagggaaggcatgcaggcagctgtagcacaggtatggctgtagtcatacaaaaagctaggttaacaggagaaaagcataacagatatgtaagttttatctgacatgagagtcttcagaaaagaagacccaaggaaaactttttacacttagattccatgaaaggttctgacctaatggtggtggactgaagtgggaaaccctcaaggcctgcctcaacagattcttcttggcctttctgggtggcattccttccttctgggtatggagcaggacccctctgcaatgagggtctagaagggagaagggagaggtgacctttctaggttttctggcttgctttgggagagaggggttctaatttctatgacccacactgggggaagatgaattctggtttgacttgcttcaggggagaaggaggggtgggcaacagaagagcaggagaaggccagagaaagaagatttgcttctaaggccttccgatctcctttagttcaaagtacttagcatgccaaggtgccatactttggggtattgttttctgagccccaataacagaataagccttgtgcttaggtagatttctgaaacccagtttggctttgtggttctgctgcggtaattgtataacttcagggtgtagaattatcccaatagctatctctctgcatctcttttgctattgcaaagtaactaactaacaggcaagaaagttggtgtggctggctgctctggctcttgcagtgctgatgtggattgctgataacttctcaaagatgaagagtgagaaaacccagaggcagattccgaagatagatacttagggagaatgcgctcattattctggttctaaggccactggcagagtgaacccaagttcacctgtttataattccgacagtgagttctggaagaccaagactgttccagggaaccctgaaatcatgggatcacacacacgcaaaatgacacaacccagggtcttcaaagagagctttgtgatggtaatggatggctccatatttaactttgtatcccatgctgtctgtaggtagacagaggagctggtagaaggttttgtcattttacctcctgccacatgattcctgacaaaatcttttgtcagaggatctagggcttggagtttttcctacacgtactaaaaattatttcttcaaaaaataaatatgtctcttactacttttcagcaaaatattcttatttttcctaagcctcacatggacatatataatttttatttttatttattaaaacaattttttagagctggggtcttgctctgtcacctggctggaatgtagtggctcaatcatagttcactgaaaccttaaagtgggctcaggtgatcctcccacctcagcctcctgagtagttgggattacaggcactgctaccacaccagctaatttttttgttttgctttgtttttagagatgaggtctcactatgtttcccatggtggtcttcaactcctggactcaagcgatcctactgctttggcctcccagagtgcagggattacagaagagagctactgtgcccagctataatttttatgtaataggaattagtgctgatataactctggagttttctgttgttgttgttgattttaagaagtgtccccatgaagtctgactagcttggggagctgctgtaaaaattcataacaaggcccctcccaagaggctgccaagcgggaaggtctatgtgtcctgtggtttatggttctacaccatatctttctctatagacagtttagaaatttatgtaggatactggatttttgagctctttccccttccacagagcacctcaattcaattatttatgcaaaatataattacaaaaagctaaaaacctgacttacaaacaagtatataatggacatatgtcagaaatttatttaactggataaagaaaatgtggtacatatacaccatggaatactacaaaaatcacaaaaaagaatgagatcatgtcctttacagcaaactggatgcagctggaggctattatcctgagcaaacacagggacagaaaaccaaataccacatgttctcacttataagtggtagctaaacatcgagtacatatggacacaaagaagggaacaacagacaatggggcctacttgagggtggagggtgggaggaggggtgagttcccctatcgtgtactaggcagattatctgggtgactaaataatctgtacaccaaacccccatgacacgcaatttacctgtataacaaacctgcacatgtacccctgaacctaaaataaaagtttttaaaaatttatttaacttattactgaggaaactagctagatggtaaagctaattcaaaggagaatttgaggaagggaggtttacggtcagtcaagaaagtcatgttcaaataaagttatctttagagataaaactggttagtatcataaagggcaatgaatgaaaaagcaacctttagagttgtcttctctgtatgacaatcatttgtttctctctcaggcaataatctacaaattaatctgtaacttcaaagttcttcccttaatcaatagtaaatagtaagtcaaacaaaatatctcccctggagaatgaaggaagcctcagtgggcccattggacagtcctccattataacatggaaaggaaatgcagtcacccttttgccttatatccaaattctggataatttttcttttcttttctttctttattttgacacagggtctcactctgtcatccagtttggagtgcagtggcacaatcacagctcactgcagcttcaacctccctagcttaagcaaacctccacctcaagcctccagggtaactgggaccacaggcatacaccctggctaatttttttgtgttttttgtagagacggggtttcaccatgttttccaggctggtgtcaaactcctgggctcaagccatccgcccaccgtgacttcccagagtgctgggattagaggcctgagccactgtgcccagccttggataatttttctttcaaagcgccttctccctcttatccatgtgttagcaatagtcctaatgaggccctttccccacgcttctttcttcttgactctgccaagtatccaggaaggggctgtgtgtgtcttggcaggtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatggtgagtgtggctagactgggctctacctggtgtgtgtgagctggcaggcagcagctctggggcaaagggaattaaagcagacctgcattccagagagcatggggcctgggactgtacccagcacaggtgtcttttaccttgacaaggtgcccaggcagagaaacaggccagggtcagggcatgggctctcctcttggtggtcactcacatacctcagcttgctcatctgtaagaagcagttaatggtgtcttctctatctacgtcacagggtatttgtgaaattaaattgaaaaatctttatgaaaagggctttggtccttaaaacattgcattcatgcagagtgatcttaattgtcctacattccaatttctaatttctctgcaagttataaaccaaaaagcccagctcaaataccccttgtcccttgaagcttttattcttttccataactactaatagtaatttctatctcctctgagcacccttcacggaacagacattataatggcttgttttccctgaactagggaggattacctgcttggctgctagagaaagagtctattcttctccgctcctccgacccaggtaggttgttacagatgtcttgagaagatttataaaagcttcagcctaggtgcggtggctcacgcctgtaatcctgacactttgggaggctgaggcgggtggattacctgaggttgggagttcgagaccaggctggccaaaatggcaaaacctcgcccctactaaaaatacaaaaaattagctgggcatggtggtgggcgcctgtaatcccagctactcaggaggctgaggcaggaggattgcttgaaccctggaggcggaagttgcagtgaaccgagatcgtatcaatgcactatagcctgggtgacaaagcgtgactctgtctcaaaacaaacaaacaaacaaaaaagcttcaacaatttatatcaaaagggggaggtattttgaaggctggggtacctctgcacaaatacttttgaaagtttagtgaaagtctgagtgtttatcactgaccagtgcatagcaacaaactaaacctctaggaaattaggctttgaactacgtaaccagatcttactgataaactggtaattctttgaattggtattgaaccctgtttgcggttgaccaactgacttcagtgctttctcttcctatttacttagcatattccacagccaatgatagcacctcgctaatcaaaatgacaagtcaggcatggtgactcacacttgtaatctcagcactttgggaggccaaagtggagggattgcttgagcccaggagtttgataccagcctaggtaacatagcgagaccctatctctataaaaaatttaaaaattagccaggtgtgctggcacatgcctgtagtccgggaggctgaggtgggaggattgcttgagcctgggaggttgagactgcagtgagccatgattgtaccactgcactccatcctgggcaacagagagggactttgtctcaaaaaaagaaataaggtcgggcgtagtggctcatgcctgtaatcccagcactttgggaggccgaggtgggtggatcacctgaggtcagnnnnnnnnnnnnnnnnnnnnactaaaaaatacaaaattagctgggtgtggtggtgcatgcctgtaatcccagctactcgggaggctgaggcaggagaattgcttgaagctgggaggcagaggttgcagtgagcccagattgcgccattgcattcctgcctgggcaacaagagcgaaactctgtctcaaaaaaaaaaaaaaaaaaagaaataaaaacaaaatgacagtttctgggatggtgtcattggattgcttggtagctgcaatgccttctatattctggccacttttatagagcaatgtgtaaatgatagtttttttctttgtcttactccagtaccttcatgttttgcacgcttagcatattattggtgttttcactgtggtaactcatttaatctttatgccaactttatgtggcatgtacatttattattcctatttgacaatataaatatataatttattagaacttcattttatacggaaaaaaagccttcctgtgactgagaagaggatacactgttcagtcactcttttcttcattcagcaaacattgcttggatatgttctatgctccaggctttgtgtcctatggcaaggatggtcttagtctgttttctgttgcttgtaacagaatacctgaaactgagtaatttataaagaaaagcatttatttcctacagttatggaggccaagaagttcaaggtggaggggctatatctggtgagggccttcttgctggtggggactctgcagagtcctgagggggcacagggcatcacatggtgagggggctgagtgtcctagctcagatctctctccctcttcttataaagccaccagtcccattcccatgatgacccatgaatccattaacctattaatctattaatccatgagtggattgatctacttatgagggctgagccctcatgactcaacacctcttaaaggccccacctctcaatactaccacattggggattcgatttcaacatgagtttcagagggacaaacattccaaccatagcagatggatacaggcacactgatcctcgtcccctgaggagctcagctgaggagacaactacatgcaggacaacttttatgagacttttacttcagaaggtacttgtcgagtcctgtatatcctgatctctgctgccagccctggtgtaataaggctgcactggtgtctctttgtactaaatcataatttttttttttttttttttgagacagagtttcactcttgttgcccaggctggagtgcaatggtgcgatcttggctcaccgcaacctccgcccccccgggttcaagcaattctcctgcctcagcctcccaagtagctgggattacaggcatgcgccaccaagcctggctaattttgcatttttagtagagatggggtttctccatgttggtcaggctggtctcgaactcccgacatctggtgatctgcctgcctcagcctcccaaagtgctgggattacaggcgtgagccaccgcacccagccagaaaactcagaatgtttttaaaaagtttacgaatttgtgttgggccacattcaaagccatcctgggctgcatgtggcttacaggctggggttggacaagcttgtgttaaacttttcttgttttccagattacctggcagctgtggacaagtggttgggagtccttctgcccaagatgaagcctctcctctatcagaatggagggccagttataacagtgcaggtaaccctggagttgagcatggatggattgggggaggggttcccatccatctacattacataaatgatagaagtgatgcagacatgagcctcataggtctgtttctttaagaggtaatgccacagatagtgcttttagttcaattgcatttgggaaggcattgccatttttgaatgcctgctatgtggcaggctttgtgctgggtgccttgtaaatgctattcaattcttccaaccaccttcttttttcagtgaggaagtttgaaaaggttaagtgacttggctaaggtcacccagccagcaggtggcagaattaggatagcaccctaattctgtggatcccagagtttgtctctctgtttctcctgcaatattgttttctggcagcaggcatgcagcgtggactgaaacactttggtatcggcactgccttgacagtcagataaccctggaatggaaaaggatatggtcaattggggctggctgttatgtttcctctcttacttcctgccccattctccttcttctatgtgttcttggctctgcaaggactaatatactgtggggtacattgaactttaacagtttttggtgttggtaaaattacttaggtgaaacataaaaccatgttcattggacattgaccaaggatgccatggatgctcctttttttttttttttttttttttttgagagagagtctcattccgttgcccaggctggagtgcagtggggcaatctcggcttactgcaacctctgccttctgagttcaggcaattctcccacctcagcctcccatgtagctgggattacaggcgcatgccaccatgcctggctaatttttgtatttttagtagagacggggtttcgccatgttggccaggctggtctcaaactcctgacctcaggtgatctgcccgccttggccttccaaagtgctgggattacaggcgtgagccactgtgcccggctatgaccaaggatgctcttatggaaaagagtaaaggtttttttttttttttttttaggagacagagtctcgctctgtcgcccaggctggaatgcagtggcacaatctcggctcactgcaacctctgcctcccaggttcaggcgaccctcctgtgtcagcctcccaagtagctggcattacaggcgtgcaccacgatgcctggctatgtttttgtatttttagtagagacagggtttcaccatgttgaccaggctggtctcaaactcctgacctcaggtgattcacccacctcagcctcccaaagtgctgggattacaggcgtgagccaccgtgcccagctatgaccaaggatgcttttatggaaaagagtaaagttatgtaaaagtggctgcatcctggacatcccagggatgcaaagtggcactccctaggggagtgtgggccaggcttccttcttatgaacagtactatgggcagcttgtggggatggatcatagtagggtgggagcatgggcactgccttgcctttcaggtgtcggtggacagaggtgctgagagggctgcactggccagggtgtccgttctgaggctttgtggtgggaggagatgtcttcttgagagaggccaggttgctgctcacagagggatgtgtgagtcaccccacgtgcccctagtttttaccatcttgtgtctgtactggttaagctaataggaaccacattttcctacatgaagatatcaagtctgaaacttgggtgtgtctttgctctgcatggctgtgtcttcttcctttcttctggcctcaggtgcaaaccctcttttgatgccctctttttttcagtctctgcctctccttgaatcactttcaatttctgctcacaacttttctgccccttttggttttggaaatgccacaaaaagtataatcaagtattaattctgcaaaggagaatgaagttgactgtgtggagatatttcttcttgtgtccatccctagcaacctcagatgactttaacttgaccctgggtcctgccaggtgactctgtccccctcctcctcctcctctccccttcccatctccacatgcttgaatcccactaatcatttttgccccttgtttacaaaataaacaagtatagacataagaaagcagaaaaaacataattgttactcaaacctcaggagccatagcaaagctcttcacattttgggagtttccttgaatattttttatgccttttttttctgctttcttacagagtaagttcattctgagtgacctattttctgtgtggctttttttgcttcattctttgtcatgagcactttttcatatcgttcaaaattctttcatcatctttcatggttgtcctacttaccttctgacgcacagttcctatacgtgttccttctgtctggaagccatcccagttgacatattggcttccgtaggactttcagaaccgtcactgtcgcctccttttgtgaagcacatgtgggagcagtttcatccctgacacactgtgtctctagtctcctggccttccacgcctctgcctggtagccatgagggcacatcatgcatttgtgcacatcacatacccaccgaacggctctggaatggaatagaagctgattgctttgataagaaggaaccgggggatttgtagacagtaattcttttcgttgttgttattgtttttgttttttgagacagagtctctctctgtcaccaggctgagtgcagtgatgagatctcggctcactgcaacctccacctcctgggttcaagtgatcctcctgcctcagcctcctgaatagctgggactacaggtgcgggcaaccacgccagctaattttgtgtatttttagtggagatgaggtttcaccatgttggtcaggatggtctcaatctcttgacctcatgatccgcccacctcagcttcccaaagtgctgggatgaaagccatgagccactgtgccaggcctgtaaacagtatttctgtgtgtgaagatttctgtaaaagggccaaggctgatggctcaatgcccgtaatcccagcactttgggaggccgaggcaggaggatctcttgagcccaggagttcaagaccagcctgggcaacatagtgaaactccatctctacaaaaaatttaaaaattagctgagtatgctgccatgcacccgtgttcccagccattcagggggcagaggcaggaggatcacttgagcctgggaggttggggctgcggtgagccgtgatcacaccactcactgcactccagcctgggcaaaaaagtgagactctgtctcaaaaaaaataaagatttctgtaaaagctgatttctgtctctgtcttaattcatgttgaagggtagaaaatggtggctttcctcaattcttgatgctggttttctctctcagtgctcagagtttgagatggccagggaggagctacgtgtttgcagccagggtaaaaatgagtcagaccagaaggcttaaatccctgtctgagaacatttagggccctcaacactgttgtgttacagatacaggaagccaggtctgtgcttttattcatcgtcatgattcagtcagatatgcagatgtttctcttttggggggattagctgagccagtgccacctatgatggtttgcatatgtggatgtttatctcagtttctacctgaaaaagctaaagccattgataatatccaaggtgaaaataattaggagtggacgaccttccacccacaacttaacttcatccaattaacagggcattcatcatgaggtaataagcctatttatgactgtttggaagatcaacatctttaaaagtctctggtgcttaaggagcttacagaatggagacagttactctaaaacaaagacctgcaaattatggctgccacctacatttttttgtaagtaaaagtatattggaatcgccacactgtttatatatcatctgtggccgcttttgtactatagtggcagagttgagtagttgagatggagacctctatggctgcaacacctaaaatatttactctctggtggttttttgtttgtttgtttgtttgtttgttttctctgtcacccaggctggaatccagtggcgcaatctctgctcatggcaacctctgcctcccgggttcaagcaattctcgcacctgagcctctcaaatagctgggattacaggcacctgccatcatgcctggctaattttttttgtatttttagtagagatggggtttcaccatgttggccaggctggtttcaaactcctgacctcaagtgatccacccgcctcagcctcccaaagtactaggattacaggcgtgagccaccacgcccagcctggtgttttattcaaaaagtttgttgactcctgctctagaaacatcggtgttcctctgaacctagccatgactttttctatgggtttttcaagccttttcatttgtgtgtctcacctacccccagccttcacccacctttttttttcctaattggtcgtaacatagaacttgagtagagtcttagctgctaacattttgagcacttactagatgccagatctgtgcaaggttctagtcatgtattgactcagttaatcctcatgataacccatcgagttaggtacactttacaggtggagtcccatgggtaggaagtggcagagctcagatttacatgtagacagttgggcccctgccagccgtgcctgtgactagaactctaagctgcctcgcaattgtgcttttctcgctctctcaaaacctaaccaaattatgtgtacgcattttttacaagcctgtttattttagagtatatgatacaatgatgataatggataaataagacctggaaaagcaagatgataagaaaaccaaggttgggttggggcatgggggtgagctcaagagaacatgaggtacagaggctgtgagaccatttagttgctggagctaacttttaagatctttagctctgaatttcttgacagccagatgataaaaaggagacacagtcatgtaagtagcacttataaaggaggagaaaagaactttgccagtatttacaaagcttttcttagcatttatctaaattattgcaaaaggaactttcatggaactcatcaatgggagttttctactcttgtaagcagcaaatacttcctcttccaggatggtttcatgaccagtgaagtctctgtcctgggcatgcgtgctacagtctgttttacttcttgaaccccaaatctgaaagtattgccagagggatcctctctgagagaaggatcattcatgaaaccttgtgggaggcaggactgtgcagataatgacggcagcatttaattcatttttgtcactcaccattcttctcccactctccaactctgcacgtggatgaaattgagctgttggtgatgtcaaatatgtaggaatatcctctacccattcccttcccaagttcagagccttttcttctagagctacctcgggctgtccctccaaggaaccttccctaacaatctctcccaggcactcaggctaagcacctcttttctgggactcacagtttcttgtgcttacgtttaaagatcatgtattcccaggatcacaaatatttttgtattatgtgcatgttaaaatgttatggttgggtattttttaattttttataaatgaaatatagcatacatacgtaaatgcgcagtatgatgaatcactatggtgtgaacacccacataaacaccaaccaaggtcaggagacagcacgtggccagtgccctagannnnnnnnnnnnnnnnnnnnnnnnnnnnnnnnnnnnnnnnnnnnnnnnnnnnnnnnnnnnnnntatgtatttttcagtgtcatgcttctttcacttcacattatattcctgattctttggtgtattgggtagagctgaagttcatttgttttattgcttcagagcaatgtttcttaacctgattttttcatcattgcccccaaggatcccttttaaactttttttctaattgccttctcctctccaccatgaaattttattacctgagatattgtatattggtttatttgctctgtgtgtgtgtgtgtgtgtgtatgttttatataaataaggaataattttttttatccccaaagcatcaatttttacccccttggggatgctacccacctcactgggaatgcatgcttcagagcagggaccccaccctcagcactattgccatgttgcacctgataattcttcattgtggggcttccctgtgcactgtgggatgtctggcagcatccctgggcctctacccactggatgccatgagcatgtctgccgaggtatgacaacctcaaacatttccagacatagccacatgtccccctgtggggctaaagagctcctggttgagaaccaccgatgttattgagcacaaactgaacaccggtgtgtgtgtgacagcaggtcaaataaacatgctgtgtctgtccctggcattcacccttcttcttattgccatggagattttgcatagtatattaagggaaaacacaattacaattggtgcatataatatgccagttttgagggaagaaaacactgctgtatattatttgcgtatatttggggagtgtgtgggtctgtgtaaatctagacggctgtatactaaaatgcttgcagtgattatctctgggcaatggaattaatggatacttttcctgttttcttttcatttttctagcatttctaccatgggaaggtattatttatgtgatgtttaaagtatctactttctattctagggaagaataccactacaatctgaacaccagtttggtgttttttgtttttcttatttctcagtggtgggagagggttaataggaggtaaacttttatggtgaattgttggtgttttttcttttagtcagttttgaggtctgagtgaaggaaatttttccggcagtcattaagccttgtcatcttagcagatgctcagatattttcccacacaaaagcttgcattagggtggctacattaggatctcctcatttttccctgctcttttttcactcacaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggttggtgtttgtagtaacagaaattgcagcttaaaatcagctttttactcagtcagttgctctgggcagctgttgttataagtgtcatgggcagattgagatttttcatgttttcatttttcaaggaacaggtagaatagaatacttgcacccctcagtaacagagggttatctgtaggccaagagcttccagggtagctgcattttcagcactggtggagctagcctggaaaatggagtactgctatctcaggggctaggctggcccacccaagatgaagaagcaggtaggcatctccagctgtgagaagctctaccttgaggcagtcaccttttaggctgtgtctggggcgcgcttctctgctctttctgccctccctgtcctcccaccttggcaggacactcggggttatgccttggctgtagccaaccttgaggtcagccactggctgggaacttaccttatgctttgttgtctttctgcataacttagaacactgaactgtcagggctggaggtggtttggcagatgctacaaaggctatgccagattccttacacagtgctgtgtaaactgtggagatgctgcaagtgaaagttacagatgggtgggcaatgtggttaggatgcttctggccataagtaatattaagagagacttcatttaggagagtggctttcataaaggatatgacagctgtattcgtccattcttgcactgccctaaataaataccagagactgggtaatttacaaagaaaagaggtttaatggactcacaggctgtataggaagcctggtggcaacagcttctggggaggccttaggaaacttaaaatcatggcagaaggcaaagggaaagcaggcacgtcttacatggacagagcgggaggaagagataggaagggaagtgctacatacttttaaacaaccagatctcataactcattcactcactatcaggagaatagcactgaggggatggtgctaacccattcacaagcactttgcccccacgatccagtcgcctgccaccaggccctacctccaacactggggattatagttcgacatgagatttggtggggacacagatctaacacagatccaaaccatatcaacagctaaatgtctgactggactttttttgtgtgtgtggctatgaaagacattattgagaaattgcaatctttgaataaagtctgtagattagataagagtactgtatcagtataatttcctgatttttagaagtatattgtgtttatttaaagaatgcctttgttctgagagaatgaacactgatgtatttagggataaagggccatcacatctgcaatttattctcaggtggctcagaaaaatgtatatttttatagagaaactgatagtgtatatctagtaaaatgctaacaattgggaaatctaggtgaagggaataggagagtttttttgtactattcttacaacattctgtaagtttgaaatcactgcagaataaaaagttacaggctaggcatggtggcaagtgcctgtagtcctagctactagggaggatgaggtgggaagatcacttgagcccacgagttcaaggctgcggtgagctgtgattgtgccactgcaccccaagctgggcaacagagcaagaccctgtctcaaaaaaaaaaaaagatacacacacacaaaaaagaccagttccttgagtagcataaagaccctgatgttctcccctctgaggtaaaaggcacttcatgtgcattgcacagccaatgtttgcctctcttaagagggatgtacagaagactgaaatgaggaaattagcctggtgttgcttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagaggttgcagtgagctgagattgcgccactacactccagcctgggcaacagagcgaaactccatctcaaaaaaaaaaaaaaaaagaaaagaaaaccatgacaaaaaccacaattacttttgcaccaacctaatacaaagcgctgcagaggaagtgacatgccggtttcctcctgctttggccaggcttctcatcacagcgatgaaaaagcacggcatttttctgttgggaggaacaaattgaaggtgattatgattgtgttttaagcataatttgtatgtgaggtgacagcgtgactgtcactgctaggggttggagaatagacaaccacaaggccagggtgcctggggcagatgggccctccagtctgaggcttttgccagcttcattgctttgtgtgggagaggggcattgcccgatgggtctcatgagaacagtgtttaaagagctgaatgccacctaatgcttaatagtgagaaagacagccaatgagattctgctctttctcaatcagcatattctgtcctgaaagctggccttacagagaagccaaaggcccatctcagagcaagtggttatcagagggtcttggctggggccacgtccaccctgggatacctgctgtgggaactgggttgtgaagtgtggggctagggcattctctgctcgggttggtgtggacactgctcatgcttcctctttccccagtgtttggcagcccattccttctctgtggagaaattcttttttgttttagaggaggaagggaaaatagaagacacgagaggcaagacaagacacccctaatgggacatttcatgaggaaaacttgagagcaagtggtttggaatggctgatgtacaaattagaatccagagtatattccattattcaggggtaaacacaattagagcccccacatccctttgatttcttaattaactggcaaatatttgtggtagtatcatgtgtatggtgttattgaggctgtaagtatcttcaaaccaggctcatcctgtggggtgcatccaggtcaaccagatgttcttgtgaagagataagcccacaagatatgtgtccaggccctggggaaacacagataaagaagacaggcctgtgaagggaactcttgtgcagacaggaaaggccacggggacctcctcagagaggaagcaatgttctctggtccacacacatcttcaaatgggtccaatcagaagctagcttggaagtattccaggcccatggggtgtgggaagggaaaggggcctgtcttagtcagtgtgggctgctataacaaaatatcttagactgggtaatttataaacaaaagaaatttattgctcacagttctagaggtggtgaagtccaaaattaagatgccagcagattcagtgtctggcaagggcttgctctctgcttcaaaaatggtgccgtgccttcttgctgtgccctcacatggtcaggaagctccgttgagcctctttttatttatttattattattattttttttaataaaaaaaatatttttgagatggagtgtcactctgttgcccaggctggagtgcagtggcacgatctcggctcactgcaacctccacctcccgggttcaagcaattctcctgcctcagcctcctgagtagctgggattacaagtgtgtgccaccatgcctggctaatttttgtatttttagtagagatggggtttcaccatgttggccaggtggtctccaccatgccaggctggagtctgtttttataggggcactaatcccattcatgaaggtggagcccttatgacttaatcacttccagtggcctcacctgttaatactatcatcttgggtgttaagttccaacatgagaattttggggggatactaacattctgaccgtagcagggcttcaggcccgagtcccatgaagggctcttgttatttaacttcttgtcatttccacgactgacctaccttctccctcttacaattttcaggcagcaacatcacagatgctttcctaagccagaggaagtgtgagcccaaaggacccttggtaagaatcgagggtgaggtgtgtgtttgcagctgttaagagagaaaagttacatgctgctgaaactgggcagtaggcccttgatgtttttggctctggagtcagcagctaatgggattgtggagtcatagccattctggacatgtgaatgacagcagaaacaatgtttctatttgaaattgagctcctgcactggggtggaacagactggggaccaacatgaatggcctgttacacatcaggttctgtgctcctgcatcctggtctcatctggtcctcagggcaactctcataagtggtcttattgtctccatttttattgaggctcagggaacctatgtcacttgccagggtcatatagccagtgtgtggctaagccgggatggttggcaagctgcaggtgggtgtcaacaatctatcaatccttctctctccgttcttcccgtctttggctgaagttgctattcttgttgtcactcagcccagtttaaggggttaatatcctgcgccttctctgcactaggtcagactgccccacctgtgtacaagcctgatttataaaacagccttttctgagtctagtctctgcttagtgagcagtgcagaccctgcattcatagactttgggtggagctatttcctggaacctaaaacaagaagtccccacaagaaggtccagacttcttttttgttctctagaccaaggcttggcagggcaatgcccaagaaaaacatgaagtgtttgaggcctgctttgcagaatactgggacaagccttcctcgttataaatcaacctgagatctgaaaatctggattcatacaaaggttgaatttggagctgttatttatttatttatttttaaatggagtctcactatgttgccagactgtagtacagtggcgcgatctcagctcactgcattctccacctcccgggttcaagcgattctcctgcctcaggctcctgatagctgggactacaggggcgcaccacgatgcccagctaatgtttgtatttttagttgagatggggtttcaccatgttggccaggagggtctcaatctctagaccttgtgatccgcccacctcggcctcccaaagtactgagattacaggcatgagccactgcgcccggcctggagctgttattctataaaaatattttgctacccagtttctttgcccaacaagactttcctactgtgtttaaacaggggatcagctatctaaattttaatataggcaccacttttcaggaatacttgcattgtataagatgagatctactttaggttagaacctgaggactgaacataggcattgctggtattggaagtgctcactggggggcggctctgggttaagcagtgcatgtcagcatgtcaaccccctttacacctgtcatagatggggcattgcagggaagccctggcattggaaggtcataagtctatcctaagggctacgttctttttttgttttagatcaattctgaattctatactggctggctagatcactggggccaacctcactccacaatcaagaccgaagcagtggcttcctccctctatgatatacttgcccgtggggcgagtgtgaacttgtgagtgttcattgcctgaggggagggtgccctcagtagccatgggctcacagtgaagtaccgtgttcttttgtttccttgtaggtacatgtttataggtgggaccaattttgcctattggaatggtaagagcactttaatatctgtagaaacttatgctagaatgtttctgttgattaatttggggaggggtgtgcccacagacaattttattttcctttttttgtttatcctctcctaaattttcttttttttttctttttctttttcttttttttttgtagacagtctcactctgtcacccaggctggagtgcagtggtacaatctcaactcactgcagcctccacctcccaggttcaagggatcctcctgcctcagcctccaagtagctgggattatgggattacaggcatgcaccaccatgcctggctaagtttttgcatttttagtagagacggggtttcaccatgttggccaggctggtcttgaactcttgacctcaagtgatcctcccactttggcctcccaaaatgctaggattacaggcgtgagccaccatgcctggccctaaattttctaacatataaggattacctatgtaattttaaaaaataatatttcttactttttttttttttttttttttttgagacgcagtctcgctctgtcgcccaggctggagtgcagaggtgcaaatcttggctcactgcaagctctgcctcccgggttcacatcattctcccaccgcagcctccagagtagctgggactacaggcacccgccaccacacccagctaatttttgtttttgtatttttagtagagacggggtttcaccgtgttagccagggtggtctcgatctcctgacctcgtgatccacctgccttggcctcccaaagttctgggattacaggcgtgagccactgcgcctggacaaaataatttttaagggaaataaatgtgagcatttagaagccttactgttttaaaccagggtagttgggcaggcttcagtcacagtctataactgtagcttatttgttcaaatattctactgtggtctctttcttttaacgttttgttttgttgaggtataattcacaaaccataaaattgacaatttttaagtatatgatgcagtggtatttactgtattcacaaagttgtgtaaccattaccattatctaattcagaaacattttatcaccccaaaaagaaactccatacccattagcattcattccacactctccctcctctcagcccctggaaataatatactttctgtccctgtgggtttgccaattctgaacatttcgtataagtgaaccacatatatacacctgtatgacttctttcatttagcccaatgtgttcaacgctcatccacgttgttgcacgtactagtgcttcattcctttttattgctgaatagtattcccttgtgtggatgtacagtattttatttatccattcattggttgatggacatttgggttatttgcacattttggttatagtgttgctttgaacattgatgtacaaggatttgtttgaattcctgtttcagttcctttgggtgtataccaagaagtggaacggctgtgtcatatggtaactctatgtttagagtttcaggaactgccatagtgtttcccaaaaaggccacaccactttacatttctgtatttttttgtgtaggaaaaattatgacaaaatttttctgtaacgtctttgatttttgttggttttttgcaaagacagatgatgctgtactggcttttcgctaagcttcatttcccacctgtctctttatttgcatttttctctctgaatcatggaggatgcccagctgttgagttttgaaggcttagtttgggcctaaatctctcaggatctgaaattggatactgtcagctcttaatgaagtttctcctttgaactgctatcttttttgcaggctgagatgggctaggagaagacatcgcttacaagcattatcaattttaatactattagtagagccaagaaatgaagatattgcaaaactcaaatgtcactgcatataagataatagtgtgcctggggcgtgtctgggtggggtgaggggagggagagcatcaggatgaatagctaatgcatgcagggcttaatacctaggtgaccaggctgggtgcggtggctcacgcctgtaatcccggcactttgggaggctgaggtgcgtggatcacgaggtcaggagtttgagaccagcctggccaacatggtgaaaccttgtctctactaaagatacaaaaaattagctggttgtggtggcgctcacctgtaatcccagctactcgggagactgaggcaggagaatcacttgaacccaggtggtggaggttgcagtgagctgagatcgtgccattgcactccagcctgggtgacagggtgagactttgtctcaaaaataaaataaaataaatacctaagtgaccagttgataggtgtggcaaaccaccatggcacacgtttacctatgtaacaaacctacacgtcctgcacatatatcccggaacttaaattaaattaaaaaaaaggaaaagataatagtgtgccaaggttggtcactgatattttagataatccctctgtgttcatcttatgagaaacagttgagacctggtgggtgcctttttcacttagtagatggggattccccctagctgccattgatgggatcgggaccaatcatccgatccaggaaaaaaggcatcgtttttggaactttatggttcatgacacaattttttaaaaatcttactgttatacttaaaataacacattcatcttaaaaaaaaattggacattatagaaactgtcagaacataaatgttgtccttaatcctctctcctgcccctccctctgccataatccatagaattcccctttcttcctctgttgccttatttagcctgcatattagcctcatcttaattagagattatcagcaccacttttcagataagaatagctgaatacaaaaaaaagtccacacgttttctgttcagctggcaaggggtgaagcttggactggaactcaggtggtggtgagccagagtcactgcgctttggatcaccctttgcaccctggagcccctgagccagcccccacacccaccccactgtgttctgccaagcctccctgaagctgctttttgccctgtctctttgaggaagtgagagaaggccagtctgtacttagcagctgttcttcaggccagcttcctagaggagagcagggagagaaaggcatcaggagtggggagttcactgcccatcccacccacaggaacatgcacctgcctgtgcaggtgtgtgtctccttcctccacacctgtgtgtgtccacagctgtgtgatggctgcctacagggtccaggcgctcctgtacttctcacacaatgtggaatgttgatgaatgcaaagtctcaccatttctttcaccttcccacctcacaccctcttaagtggccagaggaggcttgaatctgcaccatttctctgcgatgctgccctttggtggtctaaaaacacccaaagtaagattctgccagtagaactagaacaaatacttagtcttccaatccatccttaaacccactggacagcttcccagcctgggctccctcggcctgtaaagtgtgcttctagaggtcacactttcccaactcaacctggcaaccccctccatgctgggctctggctaaggactcaagggcaagtgaggcacagtctctgcccctgaggtgcaagcagtgtagcatggagagagacataacaaataagaaacacagcacagcatgggtgactaccacattagaagcagacgagggccacaaagaaggtgagttccttgcagcaacggatgtgggtttttttttttctttgtgtctcacaggaagggatgtgttttaacctatgaatcccttaaggcaggcagacctgttggctgtgagttgtctctgattaataagaaatgggggaaatggtatgactagatcagttcagttggttgagtggtccagatctttcaaagtttagattctgtgcagagaactaatgaaaaagtctttggagctgacctgcttgatctgatcctcagccttgctcatctgtcacctccacaaccagtaggtcacccaaggtggctccatcattggtgagctgcatccaaggaatttattactaatcctaggtaaactatcatgttttgtgcctcattgatgtacaaattaggttggacaaaagactattcctaaaataacttcattctcacacacttgcattgcaatatgctctctgaagtagaggaggaaggcacaaagccttgctggtctatggatggcagcatcagcgtcacctggacacctgttagaaatgcagtttcaggccccactccagacctgctgaattagaatctctgggatggggcttaggaatctgttttaacaagctctccatgtgacacttaagcatgggtaagtttttgaagtaccacccaatgttgcagacaacctcatacctgtgaacatcatccctgacaaggtcgggatcctctggtctagaccccgccccttgcacagtgactgcaggggcatttgtttttctagtccttttgtatactcagtgttggcattatccattggtctttgttgtaggtcaagttcccagggaaacagactctgagattacctggtagaaagcttattgattgtgctctctggagcaatgcctgtaggatagagagggagaagtggggctatgatgcagcttcacaagtggcctcatccaatcttagagggagctctgcagctgggttggctgttcgaggcacattggtcagttgttggatgtgggctatccctgagggttgtaaccttgggtgaggcagctcagcacaggccagcacccagagacggacacatctgagaaatgtcagcagacaacagccctagccgctgggagaatgagtgagtgccctggttctaaagggggatccaagaggtgcaccacagccccatcgacagtctttgtagatgcaacaaaggccctcggattatgtttgaacctctgtggctgatgtgggtctgctgtcatctcccgctgtgtttggtttaataagccctgggttttctgctgatccatggcctagtcatctgtgtcttcaccactgagcttttctcagccacagcttgaggacgtgaaaaagttcagagttgacaggattaacagtcagagatgggggtcatatcataagccctgccattactgcttgtgaggtgttagcagatttttgtggggagcttcagattccctgcttgtccagtgggggtgatacctgctagaatcacagctgtgagcttctgtagagagtggatggaaagagtccttggtaaactctaaggtgcctggtaactgctacctgtagaaagaaattccttcctctaaacgttgcatcctgagggtcacgtctgtgtctcccaacaagtggttttaatgtgtcttctagttttctctctctacagtgctgagctcatggatcccaaagaacttgtcccagagctgcaccatcagtaataactagtggcacatttttgtcttctaggggccaactcaccctatgcagcacagcccaccagctacgactatgatgccccactgagtgaggctggggacctcactgagaagtattttgctctgcgaaacatcatccagaaggtgggtgctttgtatgagctgtggtgggctgatcttggacagagcctcttttgaactcactgtggctctgtggacaacttcctgcctggagccctcctgtttaaaaggatggatgaagggaggcatcagctagacttgggtttgcatcttgtacccacgtggttaagagtgagtctatgagcagatgcttataggagagtaggagatataagacatgtatttaaaaactgcaatatataatacagtgttaaatgctacttacagattcacttcttatatggtgagaattcacccggggaaatttctgtctccattttcttctccttccaggccagattatctttccaaaagttcaggtgagaggtagggtgatgggagagaatgcacagatcctcttgagactatagccccgattaaggcagcatggatatatgggagcccctatccttgagacacagctaatgtacttcaatatcaaaagaggtaaagctaagctctggtttctttatttaatgcatcatctgaaaaaagtaagtttccagtaaccaaagtgtataagaattatttctcactagaaaataactccgtccttatttgcaagagagaagaagataaactattttcctttttatgtgtggcccaatatacagactatgtgatttcagaatgaggaacaccagattttgaacctggacactatttcttcaaccttaagccagttgtgtaaattccctttatataaaagtagaggtagccgtacttgcctcacagacttgtacagtttaaaaataaatggcactcaataaatgtttgttttcttctttcatagtcaaataaatgaacaataattatttatttacctaaaaaaaaaaaaagagtgagtctatgagcaaatcagtctactgattgttaatttgtaaaactgggattacagcatctggttgtgctgtaaagcttgaaaagaacgtatgtaagccatccaggacagttcctgacacatatatgtctaataagtggtagccgttaactattatttatcttaaatgtaagaaaatgtgtgtctacttaaatagctgatgtacataggaaaaaaatcttcagatactgtgaagcatggtgcagatgtcagctgtcagtgaagcttcatttttctatttggagcaagtgattgctgtttctggactgcatctgaactgcttagtcctgctagcgttgtacccttttgaggcacctaatgcacctaggtggggtttcctgtctctgctgtgggttaaaagaaaaaacccacagtttttatgctcagtcacctgagttttgaagttaaaaaaacaaaggttttctgcctataaatggtatggttttttttgttttaagtatgatgtcgttttaattttaagcatgtgttaaaatgaatattacaaattttttaaatataaaaaatacaatctagacttaccacacttataatttgtccatttcatctaaattttcaaatgtattgttaaaatgttgcttatgttattcctttattatgggtttaatctccacagaatttatagtaatgtctcccaagctctcccttgtatgtttgttctgttttgaagctttctgttcctatctttattatttccttcctttatttgaagcttagctttttaatgcagcctttcttcttttctaatataaatatttaaggttataaatttccttcaagtactgctgtggctttatctcgtaagttttgatgtgcaatctatttcttactgtttgcttctaaacatatctattttgatttctcttcaccattgatatgtgttttttaaattactggaaataagtactttcctgtttttttgatttctagtctttttgcattctggttagagaatatagtctgtgataccaatcccttgaaagctgctgagcctagtcttagagcctgacatacaccaatattaatggtcaatgtgcgcataaaaagaaagtatattttacagttgttgactatattctacatacatgttcatcagattaagtttattaatggtgccattgatatctttgatctgcttcctaattttttgtcagttcagtctactatttagtgagagttgtcctcatgtatttccctttgtagctctgccagttctgaggttatgttattaggtgggcaaattgagaattacatccttcagtacttaatagtaaagggattatataaccctctatttctaataaggctttttgcctggaagcctttttttttttttttttttctttttttggtctgttattcattaacaccatttacctgcatacttttgcttggtatttatttttctgaggtatctttcccaatgctgtaatttcatcctttttatatcctttgttctctttacatgtgtcccttataaacaggatataatcgaatttttaaaatatctagtttgaaatttcttgtcttttaactgatatatttatacattctcattcattgtacttcttgatatacgtagatgaatttcaattatcttattttataatttctattcgtttacctttttggctctttctttccctttattgctttcttttagattgaggttttttgttttgttttgttttttcctcttatttctttcccccctcttctactttggaagttattcactgcattctaatttttttagtggttaccatttaagtgtgacatctatacccccagaaaagaacaactcgtagtacacagctcagtgaatttaggcaacgggagcgcagccctgtgacaaacacatagctccccggaagcccctctaatgtccctctctagtcattgacacacatacccattcctgagctcacagctgtcctcacctctatcaccagagattcattttgctcgtttttaggcagcaagttcctacaatatacactcctgtgtctggctgtcttgtaatagtttaaaattaatcaatatctttactttctccatattgcatccctctttaacttactgtaactccaattacagccctcttgatttgtatgttattattgtcatgtattttaattctctgggtttagttttcatgtattttagttctctccttaaaaaataaaacccatggggcattactacaatggcttcagatagtatttcacttgacccacatagttcatttattggcaaatgatttaacaaacattcatcaagtactctgcatgcgccaggttgcagttttaggtgcttggtggctgtaggctttcctgaaaaggtggagctcaaacaaaaattttaaggtggtgagagagccatgtggcatatctccacctggacaagagcattccaggcagaatgcagccagtgagaacttgggaaggtatatggcatttttaaagactagcaaggaggccagtgtggctggagcccagtaaatgaaggggtaagaagtaggagaggctgtgcgcggtggctcacgcctgtaatccaagcactttgggaggccgaggtgggtggatcacgaggtcaggagatcgagaccatcctggctaacacagtgaaaccccgtctctactaaaaagacaaaaaattagccgggcatagtggcgggcgcctgtagtcccagctactccggaggctgaggcagaagaatggcgtgaacccgggaggtggagcttgcagtgagccgagatcacgccactgcactccagcctgggcgacagagcgagactcggaaaaaaaaaaaaaaaaaaaaaaaaaaaggaggagatgaggggtcagggatatagatggggaacagatcacatggagcattacaggccattataagactttggcttttactctgaatgtaatgggaatccattgaggagttgagcagagccgttgttaaagcattctattaaagcagattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttagtaagcaagttatattaattcttctttgtctgaaaatttttttttcaccctcattttcaaaatgcagtttttcttttctttctttctttttttttttttttgaagacagggtctcactctgttgtccagaatgagtgcagtggtgagatcttggctcactgcaacctctgcctcccagcttcaagcgattctcctgcctcagcctcccaagcagctgggattacaggcgtgcatcaccacacctggctaatttttgtatttttagtagagatggggtttcaccatgttgaccaggctggtcttgaacttctgacctcagatgatccatctgcctcagcctcctgaagtgctgggattacaggtgtgagccaccatgcccggcctcaaattgtagtttttctagactgatagttttctctcagcatactgactttgggcttttattgttgctgctgagaagtcagtttactgtactctgtcactctcttgaagataatctgtctttcctcttggacagcttctgagattttctctttatatttgacgctgtatagtttctctgtgatgaatctaagtgtgactttcttttcgtttatcccgcttgggtagttttggaacttgtggcttggtatcttttttcactagtcctaaaaagtttatgccattatgtcttcaaatatttgtttctattagataatttgttagaccttctgattctagccttcacagctcgtaatctctttttctctgtgcagcattctgattgccttgaaatatgttcttcaattgttgctttctctttagtagctataaattctaagattaaaacctttccattgaattattaaattatatttttcattctataagttcacattagcagttcgaattttactcagccatttttaaattctcttgctttttccttatgtatacatgttcttcttttatttctttaaacatactagagatacttctgttatatatctttatttgatcatttcagtatgcagagtctttctttgtctcattctgccttttgttgtttctgtgacctcttgttcatgatgtcttgtttctgcgtgtgtgttgtgattttgactgagctgaatttcttggaactttttgttgttgttgttgttgtcattgttcttagagacagggtttcactctgtcgcccaggctgagtgcagtggtgcagtcctggctcactgcagcctcaacctcccgggctcaagtgattctcctgccacagcctcctgaggagctgggactacaggcatgtgccaccatgcctagctaatttattttttattttttttttgtagagccagggtctcactatgttgcctaggctggtattgaactcctgggctcactcatggaacttttatctttaggaattatttgagatttggggtgaatgtgggttcttccagagagaattagcatttgcttctggcaggtaccagggaacattacgccttaaattaaaatcttaaattgagggattttttttgtactacagaagcagtgtgaattttagctacaaaatatatcagagggctgactgtgcatatgaattttcaaaggagatttattttctccctacctattgccatgtaacaaagtacccctaaacctagtagctcaacataacaaatatttattatatcacagtttctgagggtaaaggatctaggaacagcttagatagatgttatgtctaagctactcctagggctatttttttatttctatcagtttatgcagtcttaaaaatcagcattttcaaaataccattccatatttgtatgtatgacctccatcatttcttttgaaaaatcacctgtcactggttttcctttgatggtataggtctttttttctctagtgcttttaagatttccttttcatctttgatttttaggaattttcctatggtatgcctatgcatagttttctttatatacatcttgtttgagggtgtttgaacttcctaaatctatggcattatttcttttgtggattttagaacattcttggctgttatctcatccaatgttatgtttacttcgttctcccaccttgcctttcagaacaccagtgatatgtgtgttagacgttttttcctgtgttctgtgtatctcctaagcgcttccattgtttctatcctttcccccgaacatattttagtttagattttattctgacctatcttctagtttattaatcctcttttcaactgtctgagtgaaacccatattatagactcaatttcaatgattgcatttgtcagttctagagcttccattagattttaaaaattgtttccagttctctgctgaaattcctcatcttgttttgttgtatgtttattggcataattttaagctttcttcagattattccaataccatgatgtcttatgggtctgtttcaatggcttttttttccttttttttttttttttttgagacagagtcttgctctgttgcccaggctggagtgcagtggtgtgatctcagctcaccgcaacctccacctcctgggtttaagtgattctcctgcctcagcctcctgagtagctgggattacagctgtgcaccaccacacctggctaattttcatatttttagtagagatggggattcaccatgttggtcaggctggtcttgaactcctgacctcatgatctgcccacttcggcctcccaaagtgctgggcttagaggtatgagccactacgcccggccctggcttttttttctattcgttttttatcagatagtgttgtctcctatatgttgggttttttctcatctagaggtcaataaaacaaaaaagaaagagataatttgggttatatatgttttttcttccaaaagagatttacttttacttctaccaggcagttagagtagacagagatcatcttcatgcaatcagggattaagctaatttgaaagtgggcttctgtcttcttgagggttggtccgcttctggttcactttcttaggggtctcaactgagagcttgaagtatttaccagggttctttctccattctgatctctgaagtccaatttttatcttctcagccctagaagactcccagaagttgtgttcggcttctagcctctcagttggcccttgtgaattgacaaataccttgatgggaaaactagtaacaaatatcagacttgcatcatgacattttccatttttttggaattgtaaccacttaattcctttctgctttggtagctttctgatgctttcaaaaagatattttaaaacatcttgtacaattgttctagatgttttccacagcaagatttgtcaacaaaaacctagtttcagagatttacttactccctaagagattctccagaatttgctatacacaaaggtgttaaccttcagagcacagggcaaacctttcacaaattatttttctgagatctgtcgatcatccacttaatcattatacaaacattcaacaccagtcttacaatttccgtgttaaatgctagaggtgagtgataagtctaccatggtcctgtgttggaggggctcacagaagagataaatttgaatttttctctttaagcatccctcttactccagagtttctccaaatagaatgaaatcatctttaagcaagttttaaagatatggcagatatgcaatttgttacctctctcaccaatctgagccctttttttttttttttttttttttgaagagtcgcccagtattgtgtgagaggtagagtcacagattggagaagctttggagagagacagaacaaaacttgagtgttgactccagtactcagtgggcaaggtaccctccttccacatctgtgcaatacggttagcatgtcttctcagagaataatacatagcagttatttttattactgtttttcttcacttatgtcattgtaaaatttcaaactagagttaaatattcccctggaaacttgtgcccacttatgctcaaagcctctgttgacagtgccctttagtagctgcagtaatcaccattgctcaattgctcccaagaaaatcaaggaggaagtattattctgccattctattagtttttatgtggtgtccagacccaaagggtatcctgttacagagagtgtgacatgagcactgtagttttttctaggtaagagttactgttccatgtttagtttgggtgtcttctatcagccaggactactgatttacttgatttgattataatgcctgtggacttgtttcttttatagactattgcttcatttcacaatccacttcaggtttatttattttctaaacagatttgttgaggtataattcacatacatttctcccattcaaagtacaccattcaatgttttttgttatattattaattttttaggccaggtgtggtggctcatacctgtaatcccagcactttgggaggccgaggcaggcagatcatctaaggtcaggagttcgagaccagcctggccaaaatggtgaaatcccatctccactaaaaatacaaaaattaggctggcatggtggcgcacacctgtaattccagctactcgggagactggggcaggagaatcgcttgaatatgggagtcagaggttgcagtgacctgagatcacaccactgcactccagcgtgggtgacagagcaagactctgtctcaaaaaaaaaaaaaattaattgtggtaaaatatatataaaacaaaatttgccattttaaccatatttaaatgtaaattcagtgccattagttatattcacaatgttatacagccatcaccattatctattttcaaaactttttcttccttccagacagaaactctgtaaccatgaagcaatagctccccagtcaccctctcctcagcttctagtagctcctagtctactttctgtctctgtgaatttgcctattctagatatttcatataagtggcatcataaaatattggtccttttgtatctggcttatttcacttagcacaatgttttcaaggtttgtgttgtaacgtgtcagaatttcatttctttttatggcttaatattccattgcatgcgtatatgatattttaattacctattcattttgttcatctggtgatgaccatttcagttgtttccatcttttggctatttgaataatgctgcattgaacatcagagtacaaatatcaatatggataagtctctgcttgtcattcctctagggacatacctagaagtggagttgctggtaggcttatttttagaattattttctttctgaaatagtgaactttcctaatgtggaaaaaatcaaatcaagttttaaaacacatatttacataagctttattgcataaaatatcactttacttttggcctcattataacagcacatttttattctctcatacttctagctacttcttcctgccatcccctatccctgaaactccacacacttttcttgaccttcccttgctcttctgatcgatggctgggataatcttacaccatcaccctcaatccttctgtatgcagctgtttaagaggccctgctctatgaaccactgctgggaccattctgactgtcacactctggaaccagagccaggcagaagaattttaaacttcagtattgactggccaggaagggatcttacttccaatctgatttggatctttcatgatctctagttctctttttgccctttgtcattccttcttctcactgtatggtataaaccatcacccttacactttatcctaatgtacaggtgacactgtctcctacttcaccaagaaaataaatgctattgaatacaccaagttaaggagcttgaattataggtaatggtgcctttgaagtagtttaaagaagaaaatgatataatcggctatgcatttcaaaatggctattggatgaggcaacaaaaaggaatgtgtagttagaatgaatcaagaaatcattacaaattccaagtgtcttagtcagtttgagctacaataacaaagtaccatagactgggtggtacttatggttctgagggtgaaaatgccggcatggttaggttctggcgagggtcctcttccacattgcagagcactgacttctaattgtatccttaattacaaaaagggggctaaagagctctctgggatctcatttaaggcactaaccccatctcaaagtccttaccacataataccatcaccttaagaattagaatttcaacatatgagttttgggaggacacaaatgttcagtccataacaaaaagattaaatgattaatcacaaatatcaccttttttttttgagacagtgtcttgttctgttgcccagggtggagtgcagtggtgcaatcatagctcactgcagcttcaaacccctggactcaagcggtcctcctgcctcagcctcctgagcagttagaactacaggtgtgcgccaccacacctgtctaatttttaatttttttgtagcgatggagtctccctatgttgcccgggctgctctcgaactcctgacctcaagcaatcctcccaccttggcctcccagagtgctggcattacaggcatgggcaactgcgcccagcctacaacatttttttaaaaacatcatttggttttattaactgcttgaaacttctaccattcttcattccttaccttttgtttatttttttaataagcaatatgactttatttagtgactttggaaacaaaacctcccaaataatgcctgaacccaaagttacctaaaaatggctaaaaatattttaaaataatagatttgaacatcatttgtagtttctgcctcataacatgaatgctttcagctggacagtagattacaaaccatctctgatcatgttaaggcagattagatgatcagtcagtcctggagctggcaggtgggaggctctgcctgtcttgtcactgcttgttatgctggccctctatgactgaagctgacacagagccctggcccttgttgacatcactgatacacacccactgcccatcaaccaactgcttcctcagggtcaccttattgtctccaccagagatggccaatatgttggctgtgatggacctgcccgcatgctacatgacatcattgaacttgtgcagcaatttgggagaccatatatttcccaaggcatcatcacaggtccagatgaacacacgaccatcccaggagcagctggcaatggtgctggtgggcaggctgatggagggggcccaggccacatctcaaacccagtcactgtgcttccagcttctgctctccttccactggccatccttgaagaggttgtcacagccacctgatggaaacttcttgatgtaattgggtttctgcctgaacagctggtctatgaggcttccaggtacaacagcaggggcctagctgatggcattgcagccaatggtgtaagcgttgttgatctttttcacttcccattggccttcccctgtataagtcagcaggaagatggccccatctgagctcctacaggccaggatcaggccgtagtcacgggggacctagcatacagagttcacggaggagtcatatcctgaggggtcgtgggtcttctcccaggtgccgttttcctctttccagataatgactttccaatcataggagcacaatgccaggatattgccatatgtggggtgagcccaggccacttgccacataggactctcatgacttctgaggttggcaatgaggatctgccctctgttgtgcactttgaagattttgacggatttttctgatgagcaggttgccaggcgggtgccatagtagtccatctgggcatcatgaatcatatccttatgggaggtatccacagtgttaattactgacaccatgataccagcgtgactgctctagggacgtggcagctcctggtggtgcctccccattccttaccacctttttttttttttttttttgagacagtctcgctctgtcacccaggctggagtgcagtggcacgatattggctcactgcaacctctgcctcccaggttcaagcgattctcctgcctcagcctcctgagtgactgggattacaggtgcacgccaccacacctagctaattttgtattttagtagagacggggtttcaccatgttgaccaggctggtctcgaactcttgacctcaagtgatccacctgcctgggcctcccaaagtgttgggattacaggcgtgagccaccccgcctagcctcttatcaccttttttagcaacaatgtttgcctcttcagatggccacaatgtttgtaatcttttcctctagagagaatagaaatctttctttttagcctggctgattgaaatttgtttagtattgatagtttagaaaaacaaaagcttcacattttattactgataatattatataaatgtttaagattgtaatcaaaattggggaactatctctccagtttgttcatatatgagctgtaatttttggaagaaattttcacagacaggttctggccccatacatttcaaaccttgcttctccacaacccatgtacttccggggctgggtgcctttaggcataattgtattgcactatgatgctaagtgagtcagcacattgggtgaagggatgatccattattcataacttacctactcacggaagtaaccaggaatcatatcagtatatcctactgtacccatgtaaagtaaatccctactttaactgatttttacttgggtccccaaaatgcctatagcaacctgtaaaacctcccaaaggaagaggacatttgacacagggaagctggaacagaaagagacaaggatcttagcttgttatggtcaaattatattacttttgcaagttttacaaaaacatatgacactatgaacatgctggtgggattcctcccttggggcacttctggatgcagctgccatggtagcctaggaatgagatgacggcaggggcatcagggagtggagaggaagaaatcaatttgaaaaacatttagggctgggcacagtggctcttgcctgtaaccccagcactttgggaggccaaggtgggaggttcacttgaggccaggaaatcaaggccagcttgggcaacatagtgagactgtctccacaagaaaatttaaaaatttaaattaggaaagaaaagtgttcaggaggtaaaattgataggatttggtgattgactgaacacagatgtgagaaagaatgaggagttgttgatttttccaggttaaaaccttagttagataactaggtgggtactgggatcggcacctgagatagaggattgcagaggaggccctggcagggacaggggaagcaagttcaattctgggcttattcagctcaatatttccaggaacatccaggtagacagatttctccataagcaccaacacttaatagtaagacactccagggagaagtcggaaaggttggcgcagattctggggcgatcagtgcaaatggaagccgaagtccagggagaggttgagactgcacatggggagctgactgaggagggcaatgggccaagcaaaagacaaacccaggggatcccaagctttaacaactgggcagagtaagagaacccacaaaggagacagagtctttagaaattgccaggctcagtggctcacgtgtgtaatcccagcactttgggaggccgaggtgggtggatcacctgaggtcaggagttcgagaccagcctggccaacatggtgatactccatctctactaaaaattaaaaaattaggtgggcatgatggcgtatgcctgtagtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccattagctgatttgttaaatgatcttcaaaatatttgcttgcatcaagtaaaggaaattggatggtagatatcccctgtatatagctctacctgcctccttccttcatcaaagactcaaaaagcggaatatgtctcctctgtaatccatttcaagaacacattaggtggtgatgggcaatatatttcactgacatggactcctggggataatctcccagcaggctgcataagcctgtgctcagtggtgaaggcccccaggcggttgtcttcatatgaatcttcaaggcatggcaaagctcatgacatttgcattttaaaaggtatttgctttggtgtgggtaaaactcaaccaaacatggttaacactttgacctcgaggatgaaccataaaaatatagggcagcgacctcctcttccctactgattcctgagaggggcagtggtgagtttatttttgtatgctgtcaaatcaacttaagacccattttaagagttttgtttctgttctttatagggattccatcaacgtaagagttccgctgatgttttggaaatgggtcactgtagaaattaatcaagtggtagtgaggaccttgataattggagtggattctgggattcccaaaggtagtaactgggctgagtggtgaagaggggatgggagaacagccacagtgattttttctgtacttcaaaagcttaatgaagtttgaaatttgatccaggatttgtctacactggctgattgatcatcctgcactgtttatgactggaatgacattggcttgatacgcagacacagctgtctcttgctgatgtatagtgctggtgaaaaccagtgttttatgtctgatggttacagatgagaaaggcaatattacttagcaactgttaaatagtcttttaaagtgtcacctgctctcttgtagtactggtctcttcgtttcctgtagagttggcttttctagtccctctcccagagtgatttctctaaaacactgatgtgatcgcttctcagtcttttggctaagatcaagtgtagtatctaaaacactgatgtggtcaggataccttccatgacttggcccctatatttttccagcctcatctttcaattctcccttcttagatgtgacttcctggccttaagttggagctatatacaattccatgaatgaaacagcactgttcatacctcctggtctctgcaccctctgcctttattcacctggaaatgaagacacacctcagttaccttatctgcagagtcttctttgacccacttgtcagccaagttagtcacattttgttttctatcacttatgttgtagaaatcttttaaacattacttttcttttttttttttttttcttaacttttaggttcatgggtacatgtgcaagattgttgtgtaggttaactgtgtgtcacaggggtttggtatacagattattttgtcacccaggtaataagcatagtacctgataggtcattctttgatcctctgcctcctcctacctaccaccctcaagtaggccctgatgtctgttcccctctttgtgtccatgtgttctcatcatttagctcccacttataagtgagaatgtgcagtatttggttttctgttcctgcattagtttgcttaggataatggcctccagctccatccatgttgctgcaaaggacatgatcttgtttcttttttatggctgcatagtattccatggtgtatatatgccacattttctttatccagtctaccattgattgtcatttaggttgattccgtgtctttactagtgaaaatactactttttgtggtgtattaatataactgatttatacacatttctcactctctggaataggtttataagtctagtaccaagcataggacctgacacagagtactttcttaataagagtttgttggatgaatgtatgaaaacattagaggtcttggtgaaggaaaagctggtcaccattgaatctagtggattccacagggaaaagagcagcttcccgtgttgaatgtgtccggttaagtatgagaagcaacatttctgattgctctgaaaagtatgattaaagcacaaattattatggaaaaataatggtttagaagtatagcattttggtatatttgttcatttcttttctgaaacattaattagctaaggtaaagatgaggattttgctatatgataatcaaactagtatcaatgaaaatcatcaatattaaaatgaaaagttagaaaattgtagtaaatgggatagacagatgaaagcttaatatctgtattataatgagctaatatcactgatcagaatatcaagatctacatagaaaattgggtaaatgatgaccaggcgcagtggctcacgcctgtaatcccagcacttaggccgaggcgggcggatcacctgaggtcaggagtttgagaccagcctgaccaacatggagaaaacccgtttctactaaaaatacaaaaaattagccaggcgtggtggtgcatgcctgtaatcccagctactcgggaggctgaggcaggagaatcgctggaacctgggaggtggaggttgcagtgagccgagattgtgccattgcactccagcctgggcaacaagagcgaaactccgtatcaaaaaaaaaaaaaaaatttttgggtaaatgacataagcaagtatggatacttgatgaaaatgtgagtatacactattttaagagtcttatactcatatcctttgacctagtcaccccacactcagagtgttacttttaaaaaataaaaatttaaaaggataatgctatagacatgaagtttgagactccatctcaaaaaaacaaaacgagaaaaaagaggcgacatagggtaatatgctaattgatggaactaataaataaagatataaggatattattttaaaggtacaaagataactaggagagaagctgaaaatggtgatataaccataatagcaagaaaggaagataaactttctttatcttctgggctgtactctcatgtgttaaagaaatcaatgataagaaaaagcagtacacatatattacttagagaccagaagaagcaaaaataggaacaattaaataatcttaaaatgtgctgggcgtggtagctcacacctgtaattccagcactttggtaggccaaggtgggaggatcgcttgagttcaggagttcgagaccaggctaggcaacatagtgagaccccatttctacaaaaataaaaataaaaattagcaggtcatggtggtgcatgcctatagtcccagctactcaggaggctgagacaggaggatcactggaactcaggaggttgaggctgcagtgagccgtgattgtgccactgtacttcagcctgggcaacagcctatctcaaaacaaaataataaaaaatgataatttttaaatggcttcctctgaaagaactaagagaaaagtgaggcaggggactgttgcttttcactataacagtcttttgtcctcctctttttatttattttattttatattttattttttgagatagaatctcactctgtcacccaggctggagtgcagtggtgcaatctcagctcactgcaacctccgcctctcaggttcaagcgattttcatgtctcagcctcccaagtagctgagactacaggcatgtgccaccatgcctggctaattttgtatttttagtagagatggggtttcaccatgttggccaggctggtcttgaactcctgacctcaagtgatctgcctgcctcggcctcccaaagtgctgggaatataggcgtgagccgggtgtcacttttctggctggaaacctctgtggcctgtggcgcctttgcccgagttttgctcgggcccactgggttcgttctgcccactcggcctggcaggctgcactcggttcatgcttcctgcctggatcccatacctgccaagggcaagtcaggcataaagcggcaaggggtgtgtgagcaagcgtggggttgagccactgtgcacggtcagacacgctggctgctgctgctgcagggtgagcagctccaggttgcccgcacaggcgccagccctctgcaaggctgcagctggaccaggtgcactgcagacagcttctctggctggcatcagggtatgcaatagtgcccagaagcttggagatgccaggaaccacagggccccaaagagagagtcacagccccagctcgggtagctcccaggtctgggctccccaaaggaccatagctcttctctccttttcccccacaacgtggtgagcaaggggcatgtttcagccctatttgtgttacagctcttttagcctcaccattcagcggatcttgagttcttgtcctacatccaggaagaatgaggtatacagacaagtggagggtgagcaagatgaagagtagctttattgagcgatagaacagctcagaggaggcccacagtggatagcttgtctccatagccagggtgtcccagcgagtgttcagctctcagcagagagggtagtgcctctctgtgggtagattgtcccatcctccctccatcctctcagcagagaggatagtttctctctgcagctgattgtctccccttgtctctccatcttctggtcttgctgagccagcagttgttatgggcttcagtggggaggaggtgctgcttggaccatggcggccattggcaggcccagggaaaagcaccacaagttacccctctggtccatgagactagtggcccgaaccccaggcttcgggccctccccagcttgaaggtggggcttcaccagggactcgcccccttccacccaggagcctgtctaccttctgccaccattcatggcgcccgggctgtttgtgccaagggacgcctacaggccagtgctgagctgccctcagcaccccctcggcctccctcctgtgctcatcggtgcccaaagtccagagggggctgaggtggcagggggctggcatgtcagtgctaccctgaacgtttgcacacccagccagcgtgcgacagcacgtgggctcagccccatccttgctccgaggtcggagtggcgctgggagaagagagaggctaggcagcgggagcagacacctcttagccttttgggggagggggaccttcctggatccccaagagtgcagagatgtttccgtctgcagctgcagcttggtagctgcagccacgcccagctcctgcttggctccatggatcgtggcactgccccgggcacagctctacctcggggcccttctctgtccgcccctccgtgcccaaccacgctgctcccccaccagcgggtgactcggcccagtcccatcgtggcgggcttcagggactgaccacctccttcctgctgcaccctttccacagcagcagcaaggcaagagcagtgacgcggggccagggtcaacagcggcagaggctccgggcctgggagtgggtcctgcctggccccgtgaggctggggacggcacagtcagctgcctcggggacatggggcacaggggtcctctccgccgccactactggccctgcagctgctcccaccgccacggcccacgacctccttccgccacagccagcgtgatggcagcagctgctcccaccgccacggcccacgacctccttccgccacagccagcgtgatggcagcagctgctcccaccgccacggcccacgacctccttccgccacagccagcgtgatggcagcagctgctccgggctacaaagaggcgatgctgccagcattgtgacttttagaaagggaaaccaaaaaaaaaagaaggaaagaaagaaatggaaggatcttgagaactcacagtacactctacttgaaaagccggatggctacagacatttctaagacgtgggactttctcccagatcttcttactccataattgtatacatacatgcacatatatgtgtgtgcatgtgtatatgtccagatataatatttaacatttaataaggatttattttgaaaaatagtttcagactttcaaaaaagttacaagaataaaagtagtttaaaaaaagaggatttgtggccaggcgcgctggctcacgcctgtaatccgagcactttgggaggctgaggcaggcggatcacctgagatcaggagttcgagaccagcctgaccaacatggagaaaccccatctctactaaaaatacaaaattagccaggtgtggtggtgcatgcttgtagtcccagctactcgggaggctgaagcaggagaatcacttgaacccgggaggcagaggttgcggtgagctgagatcgtgccattgcactccagcctgggcaacaagaccaagacttcgtctcaaaaaaaaaaaaaagaggatttgtatattctccacccggacttatctgtgtcaacattttactctacatgcttcatcactcgtgcatagacttgtttcttctctctctctgtctgtgtgtgtgttttctaaatcattggaggattgcatacatcacggcctttacctttaaatacttcgttatatgtttcataacaatatggagaagtattctctcttgtaaccacagtaaatttaacattgatacagaactttagcaataagattaatatttttcctatgataggctgtctcccttcagagtctgtcacgtacctgtttccttttttcctcccactcccctagccttctgctgtttaccctcattctctctacttgtttttgctcttttgttttgaggtctttcggtttataattatttggatattcctgaagcttaaaacacagacatacacttagaggtaaaaaatttaccagatcctgctttggaagaagtctctagttcctttgattttccaaaaaagcagtggcactgttgagtctttgaccttgctttcaaataataaattttatgaatatgtttctgaaggtttaccaactttttttcttttctctctttttctactctggtttatagtttgaaaaagtaccagaaggtcctatccctccatctacaccaaagtttgcatatggaaaggtcactttggaaaaggtaagaaaaaaaaataacagaaactttgaaagtgagagatgggagtgagaaagtggaatttagtagcagtgagtgaaagtgctgtgctggaggaattggttcgttatttttctgcgaatttgttttctgcaagcctaatggggtaaatgatgtttctgggaaaatggggagagagaggtgagaagatactcatgcctgttgacaggatgagcagatgagacatgggtgggagtagtaggcattcttggatcatttgggtcatcttggttcctttatcagtggtttaaacagtgtcaagtgcctttgtggaaataacatgccacctcattgttatggctgccaaggctctttgtcgtatttaccttttttaggagttccccaaaatcacaggcattttgatagacctctgccctaaattatatacttacctccatctcaaagtcatgtcctaatttttatggtctgtggtttatacgttaaatggggacactgggggaaaagctagaaatcaatcataaataggagttaagggcaatgtattctaggaaaagcgaaaaagaagagaggttttacttaatagtcagaggagtgacatagccaaagtcaatttgttttgaccatctgtgtcttcaggttttccccttttataatccctaactcctacatgtattaactcacaagaaaaaaaaaaaagaaccgttacctatttcttaagaatctcgatatcctaaaatagtatcgtaagtttttatcttcaagcaaaatgccaaacatgattatgtaatttttccatccaagaagccctttgacatggttggttggttgagttcttataacattttccacctagtgtcagatacctgtgctacattctacaaagaatgtggtctttctgtctgataaggatctttctttagattaatcagacttcagtcactcttgtaaagggagcaccttctacttgttcattgctacagctacttaaggaaaactttggtttgtttgtttcagagccatgacaaatctatttttatgcaacagaaaatagctccaaatgttcaaaacaacaacattgctaaaaccaagctagcttattaccaaaagcacattctgtttaccgtgaaggaaaattgtgtgagcagaaatgactttttatttttaaataaatatatacagttgaagatagcaaatcagcatataactgaattaagtttatgtagaacacagttatatagaaaataagtttttaccgtgagttgaatttcttagtgttcaggtgggaaaacacccatatgagtagctggcttgatgaaattgtaaatgagatttttttccttgatgctgcacatcagcaaggtaaccatgggaagtgtttatgaaattcctaactgggctgggcatggtggctcacgcctgtaatcccagtactttgggaggccgaggcgggaggatcacctgaggtcaggagttcaagaccagcctggccaacatggtgaaaccccgtctctactaaaaatacaaaaattagccaggcatggtgacacatgcctgctcaggaggttgaggcaggagaatcacttgaacctgggaggaggaggttacagtgagccaagattacgccactgcactccagcctaccagcctgggtgacagagtgagactctctcaaaaaaaaaaaaaaaaaaaaaaaaaaaaaaaaaaaatcctaaccagtattatagtcatggaaaatcctggggtttggagccaaatctaactacaaatcctggctctgtcattactcaagtggacttctgtgagtctccacaacacagggacagtagtacctgcctcacagggtagctgtgagtattcaatgagctagtgcatgtaaaacgctgtatctcatctggagtgtgtagacaggcaatgactggtagctgttattattattgttgttattgcatcagaataagtatcctgggttgcaagaatacacaatcctttgtattgaatataataaatacttaccaggcatttactatgttctgggcattggggctgagaatggaacatatcttatccttaaggagctgacagtctggtgaggaagacaaagatgagcaactgaaaagtgatacaggcatggaagatatgccacacacaagttcagaggagggtgaagtaactaggaagtattaaatattaaggtgatataataatagcatgtctaatcttagttgaatgtaattggcctctggttactacttttacttcttagttgttttactcaggggtgttcagagagggtttataaggaggcagcatctgagccttcgttttcattcattttaagaatcttttataggtctctgagcaggttggacttccgaataggtatgtttgaaacctttttaagactactatcattcatagttttcatcaggagttagggagtagatggagaggactgaaggagactgggaagcaatactgagtggaatttgaatgatttaggtttatttaggggtttggtcaaacccactgatgtctttgataattagggaatgactctgtaacctgatgaccagtgaggggtgcagtgtgtgaatgctgcttttgtttcttttcagttaaagacagtgggagcagctctggacattctgtgtccctctgggcccatcaaaagcctttatcccttgacatttatccaggtgaaacaggtaggccctcaaaggtaatgcctcgccttttttctacttgcaaaagtgtgctttctgcactgccttgcagtgcccattctgaattcaggggccaaaatggtaagcaaatgcatcagatcccaggtaaatgaaccatgaatttccaggctctctttagcttgaagtgctgcgtgttgggctgatcatgcctatattttttgccccacttcttctcactcatacaggaggtagcccaacctgcttcaacataattctgtacaagttataaattgagttcactgaccaatctaattaatctttattactaggcatcagtggaagatcactgttttaatactcaaaacagacagtttaattatttgttcttagttcaatggcataaggactgtgttttttggtagactaggttctttgagattctttttcctgcttttgaagagaacagagcacatctttttttttttttttcagtgtttgtatatgtgtatgtgtttgatctccagacactgcctcatctttatttttttaaagtttttcccagcattttgttttggaaaattttaaatccaaaaaaagttgcaagaatagtacaataaacacccatatgctttttacctagattcaccaattgttaacagtgttttaattgcctttttctctctgtgtatgtagtcaactgcttttctttttctaaccatttgagttatcagcaccatgtcactccacagcatacatcttttaagaaaaagaacattatcctgcagaaccacaatacaatgatcacacatgagaaatttaatattgatgcaatcctattatctaatataaattctatagtcaagtgtccctggtcattgcaataacgtcctttacagcttaatcttttctcaatccagtttccaatccataatcacacattaattatattctccttagtcttcttccgtctgaaactgttcctaagtctctctctcatgacatggacatttttgaaaaggtcggggtgtttgtagactttgcctcactaattagattcagtaagacattttggacatgaacacaacaaaggtgatatgtccttctcagggaatgatagcaggatgcccgtgagaccagcttgtcccttaactgcaatgttaagcttcatcacttaggatctcagccccatgttttgaaatggaaggttatccacgtcctcctttctgattttctgtggcaaccaccttctggaaggagtctgaacagtaaggcaaaataataacagcatatctaatcttagtttagtgaagtttgctgtcagttcctgtttttacacctgtgattttattccaacaattctattttgcaataaaatgaataattaagtccccccaccacacacacattcactgtttcatgaacgttgtatagggtactctgcagtcctagcacccacatctataaatggaacttacctgcacttagcagagctgttgagcacttcagacaatgatcccagagcacgtgtagcctggggagggagttccaggttactatatgaacacgtgcagccattgttctttctcagaccccttctgctttctgatctttggccaaggtagtgctctcagattgggtggggcttcctgggccctggctctttcagatctggggcaagtccacagaatatctatttccagcaaaaaaccccaaagggcacagacttcagggagtggggctcagcctactgtctctgcagggatcccctgagcctcagccacacctgcctggggagcatcacagcttctacccctccttctggaagcccttgacaaagctttcctcagcccttgaggaaacttaccactttagctagttttcaaaataagtaaataaatgaaccagaaggagatggagatgtggagtctgggcgggaggtgttcttgcgctagaaggtttgtgtggtcttagtagcatttcttgtgctcagctcattcctgcaacacaggaaggtggattagtgctctcctcagctcctcccagtcacctttccacttgcctgaagtttactttctttctttctgggccctagaagtagggaaacttttctctgttccatgctggatctctatttgcattctgttccataactggatttatgtcccagctcagccctgctaataatgtccacagcaggaagtaaataagcaaagtcaataactataattctgtggattattatgtcaataactataatctgtgaataattccgttactgctgaggctgattgtttgaggctttccttttggaccagggatgtcagcatctaaaaatattttctgacttagtggttggttacaatctagtctcttaactgtttctttcccccgttcctccacttaaaacagttctgatggactttgttgttattattattattattagagatgaggtcttgctatgttgcccggactagcctcaaactcctgggctcaagagatcctccccaagtaactgagactacaggtgcatgccactgcacccagctcattgccttttgttttgtatgttaaagcagatttagcccatgaacttggagacagttttgctgagcagaacttcatctcttggctttgctgtttgtttgccttgtttttttgttggttttacttagttttgtttttggagctaacatccataacttttgctatgtatgatataatcccctgtatgaccctgggcaagtaacttaacccattcagggtccaggttcctcttatgggaaagggatgcttgataagacactgttcatggttccttgcagtttactattatgatagatattcgatgacctaaaaattaaaccagtttcctttttcaaatttaattttttcgggaggtggaggaagattttcattccttatggtttgagaaacatcgctttcatacatgtctagggtaaccaagttctctaaatgaatggcaatagtgatgtatttttcttaaatccttttctaaccagcattatgggtttgtgctgtaccggacaacacttcctcaagattgcagcaacccagcacctctctcttcacccctcaatggagtccacgatcgagcatatgttgctgtggatggggtaagaatcgtctctgaactgtgcgttttgtcccagtgagggtggggatgagcagcctgcacttgttaacacagcatttggggtctttgctcaccttttcagcctcaggctctacccatcatctttttttttttttttttttttttttgagacagggttttgctctgttgcccagcctggagtgcagtggtgcaatcacagctcactgcagcctcaacctcccaggctcaagtgatcctgctacctcggcctcccaagtagctgagactacaggggtgcaccaccatgcctggctaatgttttgattttttttgtagagacagggtcccactatgttgcccaggctggtcttgaactccggagctcaagtgatcctcctgcctcaggctcccaaattgctgggattacaggcatgagccaccacggtgggctccacccctcttcttggtgacccttagctgtgcctcttgcttgctgtgaggcctcatgcatgtgccatttgctgaaatccaccctacccaccatcttaacccagagggctgtgcttgatgcgccaccctctcagaagccttcggggtctccccagccaaggccgcccttctgtgactgatgttgcctgtgctttctttgctccttaagggtggggtccatttccaattcaattttgtacctgccactgtacaaagtttgttgaacttcgtgcctttatcctacatgagaaattatattctgaaggactgctcgtgacaactattactgaaatgcacaaagaaccgtgtttcataacaaaagcagatgcatttcaggacttccagtcctctcaccgaaatggtcacaggaaggaacacaggaaaagattttcttcaccaagaaaatttgttcagaagattttaaaatatttcccattctcttgtaatcaacagctttcatttcagtgggagcagattactaagacattctgctctattgatggtgactgtttcttcgcttctaacttgggtgttgtcttagtgaattatgatcattgtaaggtcaatttttaaagtctaaccttttaaaaagttaggaatatgttgttgataaaatacctgttgtttttcctcattctgttgtatgattttcgtggttaatgcatcatgtcaagtattttgaggtgagaatactccacctaacttctctgattttatctcttttgtctgattttgtcttatctctccatgttgttcagaagcaattttttgtgagtgacttttgtgctgtcagaacacgaagcagctactctagtaagaatcctcccctggaattttccactaaaagtagttggcagtaaaacattccagggcaaaggaaaccagcttagaccgttccatgctctgagctgtgtctggcagttttcctgtttaggaagcagtgattgggggatctttccgacctggccggtaacttgggctaagatgctatcaaagcatttctttccaagtctggtgacacttcaaggcaagaaaatgagtgctaaattaactgagcatgctgcctctccttgctgaccttcttaccctcaattcaattgtcatttggtcttgaaccccacagatcccccagggagtccttgagcgaaacaatgtgatcactctgaacataacagggaaagctggagccactctggaccttctggtagagaacatgggacgtgtgaactatggtgcatatatcaacgattttaaggtaggacaaaccacactgtcaagactaaggtttaaggggtgacaacttagaagttgaagcccagtacagtggctcacacctgtaatctcagcactttgggaagccaaggcaggaggatcacttgaggccaggagttcaagaccagcctgggtaaaatagtgagacctctacaaagaattaaaaacttagccaggtgtggtgacatgcacctgtggtctcagctactcaggaggctgaggcaggagaattgcttgagtccagaagttggagattaaaatgacctatgatcatgccactgcactctagtctgggtgacaaagtgagaccttgtctcaaaaaaaagaagtagttgagctattttgaagagctgttttcctctgtaggtgatgagaaagttgagctttgcaaacagaacctttcccctgtgtttgagtttggtcatcctatagaaagaaacagaaggaggaagcccctccaccatgcttttcctctgctttaaaagaccaccaagctcactgaaggcactcctttgccagtaaagccagctgagcctctgttctgccctgttttatgggtttggatggttagcctgtggcaaactcttcgcttgtaggaagcctcttctcttggggcactggctctcacctctgttgattactcctgtgtccagatgtgtagcccaaataagtttttctaacacatatttttagagcattattcagcaagcatttgttaagctcccactccgcgagatgccccaccaggtgctttggggaatgcaaaggtgtcaagagacaggcttctctcagggagctcaacctccgcgagaggagagaatgccttatcaagggaacaatggcaccacccaggctagggcaggacaggtgtctggggctatttcctgaccctcttgagatcaggcaattacatcttagggaacttagggaatagctgtgtgcaggccacctttgcctccagtataaatgtctctctcatagttcttgtgctcagggtggacttcatggcctcctgcctggctctcacaggccacattgacccatgggagtgactcgactctgttgtgtagtctctgggtctccagtacctgtcaaagagcctgacatacagccacctggttaatatttatcaaattattaaatgggcaatcgagacttggtatctgggattccactgggaatggggaagttccctacatacaagccagggaaggggaagttagctgagccttgacagcccagccctggcctgtgtggaacaaatagagcagcttctgaattcaggtctgaggtttgccatcgtcatcattaccttcctatcctcttaaggtatcacagtattctcatgtatgttatctcacttggccctcataacaggtgagtgactcgggtgtggtcctccctgtgatgatggctgaggtgctcaaggccaatatttgctcctggctgcatccgtcgtacctgctccatccgcagtgggatgactattcctttgtatcccacactcactcattccttctgtccccagattccatcttgagacaggatcttgctgtcacccagcctggagcgcagtggcacaatctcggcttactgcaacctctgtctcctgggctcaagcaatcctcccttctcagcctcccaagtagttgggactatacgtgcatgcccccacactaggccaatttctgtatgttttgtagagactggatccctttttgttttgagatggagtgtcgctctgacacccaggctggagtacagtggcgcgatctcagctcactgcaacctccacctgtcaggttcaagcgattctcatgcctcagcctcctgagtatctgggattacaggcacctgccaccacacccagctaacttttgtatttttagtaaagatggggtttcatcatgttggccaggttggtcttgaactcctaacctcaagtgatctgtctgccttggcctctcaaagtgctgggattacag

SEQ ID NO: 15734 - DNA, 17593 bp, Human; identical to SEQ ID NO: 12145
  misc_feature (1)...(17593): n = A,T,C or G

SEQ ID NO: 15735 - DNA, 7943 bp, Human
tcttttgacgcttcaccgggcaccaggaccgccccgacccaggctggagcctatccagatagggactccccaggctgctctcccctgcacctctatacccggctgcgccttcatggggacccttacccagccgaattggtgatggggaatcggagactgctgcgcagcatctggcgatgccaggaaccagcagggaggggaaagggggagagaaggggcccaaggagaggcggcgcttccctcctcaactccaggcctgggaggtgactcatagagtctgccccctctcgcccttctgccctgggaggtcgggggtgaggatggtggaggggaagcgtgcgaagggggtgccagggttagaatgaggtgcccaccgaggagagagacgtctgaagtctggcgtcttttccttcaaggctgctgtgtagattgtgaggtgggagggctgaagatcaagttccctcgagggaggttaaagaagggctaagtggacccggaaactctgctcttcggggtggtctccgctctgggaggcggggactcccctctggtatgggtgttcattgttctggccccattggaatctatcccccagggacaactcctttgtgcaaagtcctgcaggatagaagagggggcagtgcacaatcaatttcaccgtcaaaggggacatgtctggttttatgaagggagagggaagaagaaaggatcaagtggggatgggttaggcacacaccttaggagaagcgaacctgagtgttaagaaacctttctctgtgtctggagctgaatttgaggatgtaaagatgaccaggacacggaagggaagactagtttagggcaggggattgtgagtgaagttactaaccggaaaaactagcgaatcttggagaaatgtgtggaattttcatagaacttcaaatgcattatcaggaaacgcagtaaaacttgacagtatcagtgtcgcaggtaaagaggggcaggtgtggccgccttgtacttcctctgacacttccccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccggggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccagagggcgccgctctgcaaattacccaatcagctctaagtacaaagcatcgcgagtctttagtgctctttggcgctataagcccgtgggaacgagcattggagacccttttcacaagatggcgccgaaagcgaagaaggaaggtgtgtgttggtgatggggccgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaaactctgtctcaaaaaaaaaaaaaccctgagtctctcaaaatttgttaggttaattattgcttcacatgtggtcacggtttgaaaacttattttggggggagtataaagtagaatacagagattccttgctcatagctcctactgctatcgggaacaatccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgagtatttgagctatcggtaataactgactttttagggagcacagatttgagtagagccatggtagtagttagtaccaatgggtttttgctgcttctactctttcttaacagaaaaagtggattgtgttcatataggaaagcagttcacagactgtcttcctgcccctcccgccaccaagctggacctagaatcaagtgtgactttaaatggggaaagctgtgttacagttgtgcttaagccactgctgtggcttaacctcacctatgcataagaatttgctcgtggctggccgggcgcggtggctcgagcctgtaatcccagcactttgggaggctgaggcgggcggatcacgaggtcaggagattgagaccatcgtggctaacacggtgaaaccccgtctctactaaaaatacaaaaaaaattagccgggcgtggtggcaggcgccgctagtcccactactgagtcccaggctgaagcaggagaatggtgtgaacccaggaggcggagcttgcagcgagccgagatcctgtcactgcactccagcctgggcgaagcgagactctgtctcaaaaaaaaaaaaaaaaggaatttgcccctggcccgattctcctgcctcagcctcttgagtagctcggactacaggcgtgcaccaccatgaccagctaatttttgtatttttagttgagagggagtttcaccatgttggccaggatggtcacgatctcttgacctcgtgatcagcctgcctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctcccaggcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaaaaaaaaaaaaaaaaaaaatcccctggacctttcagcaggggaaaaaggttccttgacttaaacttggtgtaggtttagcagtgtgtgtgagccttgaggcaggaattacaggctgctttagttacagacctttgtgtggacctgaggctttctaggacttgattgggggttggtcctcattttctgggtccctacttctattgggaaaggcaactagagtgcgacacgtggcagattaccttggtttaagtcttaatgtggcctgtggtgtttcccataagagaattggctttgtggcttcatggtgtcctctgggctaatgatggaaaaatcattattggaaaagaatgacatgaacaaaggaaccactgaagtgccggaggactggaggaggaagggggagggtgtgggggcagtgagggtggcagggactaaggcttccttctctaccctaggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttctaaaaataacattccagcttaatcttcatatttcaactccagtaacgaggctcccttttgtttttcagattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggagtactttcattagtgttttcaatagtgtgggcgcaggctcagaaggtggagaggctggcctcagaggacacccaggcttggggctaagtcccagtgtccatatgaagctgtttctggccttgtccgtttttgttgtcccaggctctgtgcccctcactcagtcaagaacttgtctttgtgttgcttcttggggacatgctcagggcagaagtcagagcggaggaggcgggaaaagtagattatgatcatcacgtccagcatgagcaggatacccagcaggaaggtgcccagggtcctctggttcacataacgcaagaagaaatgggtgaggtaggcctgaggggccaggcggaagagaaagtacatgaccaggttcacatacttgttaacccggtagaggagatgatcctgggcattactgattttcatcatcatgcgaatggtgaggaagatgttgctgacttccaccagtagtgttaagacacccccaccgacaaagctgctccaaaagatgccggagaagaaggcacccatggcctagagggaagaaagaataggagttagggaacccagatgcagacgctttcctggaagtttggggggtgtggctatcagattgagggctggaaaatcccaaatttccccctggaataatagtttatagtgggtaagatgctttgttttgttagttcaacattactagattttgattgctgctcacagctggctgtgggtgatgttcagtctaaagaggcagtgaaaccatgggttgctggcctcagtgaacaagtacagactgccaacctccagcatcctagcataagaagtagcacacaggtcgggggtgggtggtaagaaaacacggccttctcccagattcagaaagacggagctgagactagattactgacaccaggcctataccacatagtctgcttctctcttaccatgacgtgatggacaaggtattcccaagaggctcgcgtctgtccgctagccacgatgtccaccgtatcgtggatgaaataccctagtggagggatggggcaagagatcatgaactgaacaagcagcttccttctccctgtccccaatttgcctcccgcttcctgggcaagacctacccgcagagaagcaaacgagcaaatagccagaaagtgaccacgccgtctcaatctccactaacatgtcaggagtctgccatacactggaaaggagggaagaggaggctctgcatttcggcaccctcaaggaccatcaacttctcggttacccttcgcagccccgggggatcctgggctcgcgctagtggctgactgggaagctaagagtggctgggcaaaacccaagagcctccagtttcccaggggcgatccccctcccctggggccactgcggcttttggttggataggataccaaacgggatcaggtgagactgcgtggcctcagcccgccagtgagcgatgggggtagtaacacaagagccggccccggctccccgctcaggatcccctggccacctcatttccacagtcgctcactcaccacagcagtgcccagatccccgacacaatggagtga

SEQ ID NO: 15736 - DNA, 17328 bp, Human
caggtggcagtgagctatgatggggccactgcactccaacctgggcaacagagcaagaccctgtctccacaaaaaaaaaaaaaaaaatggagtgggcagaagagaagccagattggtataaaatgaagagtgaatgaaagttgagaaagctgagttggtacaggtagaaatctatgaatggaaatttaaaaaattggcatggtaattggagagggatgtgaaggataccagaacataatttgtatgctgatgggaacagtttcagggagagacaggatttggtgactgattttattgggaaatagtggacaggaaggaagacaaggattacaggcaggactgatggtagtgccatttattaaggtcaagaatatagaatcagggcaaacgtatttgcctacaaagatcatgtttccaccacactaggtaggctttcagaggaagaactgtaaaatttgactaagcctctccagacggtaccactttctgatgtaattaatctcctgatgaagttaaaacctcctagagttgcaaggctatgctaatccaatctagcagccacacaagccaagtgaataaaaatgtacttgtactggtgaaagggacattactcgtaaaaaagggctctaaattcacagctgatggaagagcagttatgtttctgtaatcaaaacactgaagacttacaaactggtaacttccagataaacagtggaaccagacatttttccgaagaaattaatcaaattcaatattgtttacactccctaatgctcattaatgatgtagcttcatacacccttgttacttttgatattacagtgaatttccacggaagtattttcagagatcttagccctctgaaataagtatcagttcttgcaacaacccaggaaaattaacttctccagctggttcaaaggagtgcctgaggagaaaggtagaaactagaagatggagttttgacttaataactaattttgatgttcatgataggcctctggcaaacgtttgaggaaatgaatctatagagaatggacgggctttaggacttctacaagaccttcgatctttagaaagggatgaaggatgcaaccatctacaaaaagttctatttgtattattcagcaatatgtaaagagctggaatttggcatcgccctctagcctgatggccgagctgctgaaagctccacaggattcatatccccagaacaaacaactcgatcacctgatcctggctcagaagccccaggtcccttccatccccaatccttttgcgtggcccagttttaaaaacctgcggagagaaggacgggatgccaggaagcctgttgattcaacgtgccacccgattcacgggttccgggtgtcactgggctgggaaaagctttcggactctgagcaactacagcgctttcctcccccttccccccatagagcagggaaggccaggctcccccttcttcccgcatacggctccccactgcctcttcccttacgtgaccaggccctaggagcccggttccccacctgactcctgcgagaaacacgctctccagtcggaactttacctgtctgaagcccgccgctcctccagtgcgctaagcccccaccgaggaaaatggagtcgtcgaaccgagactgggaaaagatagtacggacccaccgcacggcccctccgccgccaccgccgccgctgctgcgtcaacgtgctacgtcatttccggctccctgtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtaatgctggggaccgggctcgggtgggctagggaggactcggaggctctggaggggcggggcctatagaatatctgacagtgtggtctgggaaagttaggggttccctgggaaggttcctcaggtctagagagtcggagaactgaattgttctaaggcatcttaatcgcaacaccacctaatatttggtgagctacaggccaggcacgttacctatgtcctttttccgattattaacattgttgtaaggtggacagtattgttatcctcatttcacagatgaggaaacagacgcagagaaattaaatcgtttattcaaagccttgcagttagcaaatgacaaagtcggggttctatccaaatctatccaggttcaaagcctgctttagagacaagaaaattacagtaagtgctgtgtctgaaattttaaagttacagtaagtactgtctgtgaaactttaaactccaagagctcactcgttgactacaaccctttgtcttccagctcttctgcatcttacacttgctcctcagtttccatctttggcccccttctacccaaaccttaacctccttcttgtaagaaacttggagcagtgacaggaattgcagagaaaactgcttttttttttttttttttttagcgtttgaaattaaaatgtttagtaataaattatttgtggattcattcagcataggtcttaatgagttcctactacatggctagaattgtactacatacaggagattcggtggtgataatcagtcaagaaaattacaatataataaaaacagactaaaaaaagaaagtcttatctgcctgaaaaaaaaagataaagttaaaaaaaaagaatgaaggtcagctagtgagatgtgagaggcatctaagatagctggtagatttttgtcttgaatgactgatgatgctgtttgctgagggaggaaagagttctgtcaggtgggctagtctggttcatgattcccaaaacccatctgatcagtcagactaggcaaggacatgagttatcatcactgcgatgtcttaataattctagcacccattcagtgaacacctaccatgttgtcaggcttattttttactttgttttggtttcctactttggatctactgaattagagtggaggtggacagaggcttggcagtagcaatctgtaggtttaaaaagctcttcaggtggttctgatggacagccagatttgggaaccaggttcagtccggagctcagaaaagggatctgtgctgagcctgagatacaacattaaatataacatcttgtacagactgtggttgaagatgtcagggttgtagatgaaattgcccagaatgaactgtgattctctatctgggattaatttgaataactggagaaacttgttaaaaatacaaatgcttttgtcctgaccctcaacaattgtttaagaactacaggtagccctctccgtctccctctcttgtctcttctctctttccacggtctccctctgttgccgaggctggactgtactgccgtgatctcggctcgctgcaacctccctgcctggggctcccgtgattctcctgccacggcctgccgagtgcctgggattgcaggcacacgccgccatgcctgactggttttcgtatttttggtggagacggggtttcgccgtgttggctgggctggtctccagctcctgacctcgagtgatctgcctgcctcagcctcccgaggtgctgggattgcagatggagtcttgctcactcagtgctcagtgttgcccaggctggagtgcagtggtgtgatcttggctcactacaacttccacctcccagccgcctgccttggcctcccaaagtgctaagagtacagcctctgcccggccgccaccccgtctaggaagtgaggagcgtctctgcctggccgcccatcgtctgggatgtgaggagcgcctctgcctggccgccccgtctgggatatgaggagggcctctgcccggccgccaccccgtctgggaagtgaggagcacctctgcccggccatcaccctgtctgggatgtgaggagcgtctctgcctggccgccctgtctaggaagtgaggagcgcctctgcctggccgccccgtctgggaagtgaggagcgcctctgcccggccgcgccatctgggatgtgaggagtgcctttgcccggctgccaccccatctgggaagtgggctgcccattatctgggaggtgaggagcacctctgcccggccaccccatctgggaagtggggagcacctggccgccctgtctgggatgtgaggagcgcctctgcccggccgccaccccatctgggaagtggggagcgcctctgcccggctgccccgtctgggaagtggggagcgcctctgcccggccgccctgtctgggaagtggggagcgcctctgcccggctgccccgtctgggaagtggggagcgcctctgcccagccgccccgtctgggaagtggggagcgcctctgcctggccgccaccccgtctgggatgtgaggagcgcctctgcccggccgccaccctgtctgggaagtgaggagcgcctctgcccggccgcccattgtctgggatgtgaggagcgcctctgcccggccgcccttcgtctgggagttgaggagcacctctgcctggctgtcccatctaggaagtgaggagcgcctctgcacggccgccccgtctgggaggggaggagcgcctctgtccggcctcccatcgtctgggatgtgaggagcgcctctgcccggccacccagtctgttaagtgaggagctcctctgcccggccaccctgtctgggaagtgaggagtgcctctgcccggccgccccgtctgggaagtgaggagcgcctctgcctggccgctgtgcagtcttccaagtgtgaagtgacagcctttctgcaggtgtacccaacagcaccgaagagacagcgaccatcgagaatgggccatgatgacgatggcggttttgtcgaaaagaaaagggggaaatgtggggaaaagaaagagagatcagattgttactgtgtctgtgtagaaagaagtagacataggagactccattttgttctgtactaagaaaaattcttcagctttgggatgctgttaatctataaccttacccccaaccccgtgctctctgaaacgtgtgctgtgtcaactcagggttaaatggattaagggtggtgcaagatgtgctttgttaaacagatacttgaaggcagcatgctcgttaagagtcatcaccactccctaatctcaagtacccagggacacaaacactgcggaaggccgcagggacctctgcctaggaaaaccagagacctttgttcacatgtttatctgctgaccttctctccactattatcctgtgaccctgccacatccccctctccgagaaacacccaagaatgaacaataaatactaaaaaaaaaaaaaaaaactacaggtagaaacagatgaaggccaggcatagaactttggataatcccaaggtataaggatttggaggaagaagtgaacggttgaatagaaagcagaaaatgtaggagacaaaatgtagaccatggtttagtgaagcgtggctgtgaggacccagagagctgtaaggcagtaaccagaagtaggaagggagacttggtttgccttttctgaaaaaagatataataaagtcatgaaaggagctgatagttggctacatttacccgtgtaactggcagtgacacaattacgactcattgcagccttgacctcctgggctcaagcaatcctcacatctcagcgtcctgagtagctgggactacaagtgcaccccaccacacctgattaattttttgcatcttttgtagagatggagttttgtcagttgcttaggcttggtcttgaattcctgggctcaagcgatctgcccaccttgacctcccaaagtgctgggattgacggtgagccactgtgcccagcttcttttttttcttttaaatataaaaatttttttttaggctgggtgtggtggctcacatctgtaatcctagcactttgggaggctgaggcagttggattgcttgagcccaggaattcgagagtagcctgggcaacatggcaaaaacccatctctacaaaaaatagaaaaattagccaggtgtggtggcaggcgcctgaaatcccagctacttgggaggctgaggtaggaggatcacccgagcctgggaggtcaaggctgtggcgagctgtgatcgtgccactgcactccagcctgagtgacaagagggatcctgtatcaaaaaaaaaaaatacatatatatatatgtacgtttagagactgcattttgctatgttgctgaggctagtctcgaactcctggactcaagggatcctcccctcaccttcccaaagcgcttggattacaggcatgagccactgtgccagacctccaaggatacattttttgttttgtttttgtttttgttttgagacagagtcttgccctgccacctaggctggagtgcggtggtgtgatctcggctcactgcaacctccgcctcccggatgcaagcaattcttctgcctcagcctcccaagtagctgggattacaggcacatgcgaccacgcccagctaatttttatatttttagtagagacggggtttcaccatattggccaggctggtctcgaactcatgactttgtgttctgcctgcctcagcctcccaaagtgctgggattacaggcgtgagccaccgtgccttgcttaaataatacgtttataataattgaccacttatgggagttgggagctgtaatggctgcttaaagttggcaacatagtctcattttaattgtgaaatacaaaaatttttatcataatagttaatgaacatgaataatattacaaacatgttaaaattatgtgattagacacattaggggctatccaggctagtgtgtataggttaccactgcctgtgcctcaaaaaactcacatagatttgtgccttggatatcctttgatgcaaattcttagaattttctgatatgacatacccttaagtatactttatcatatagtaactagtattacgtggacacagtttatttatttattttttttgagacggagtctggctctgtcatccaggctggagggcagtggcgcgatcttggctcattgcaacctccacctcccgggttcaagcgattctcccacctcagcctcccagatagctgggattacaggctgccaccaccacacccagctaatttttgtatttttagtaaagatgggtttttgccatgttgcccaggctggtcttgaattcctgggctcaagcaatccaactgcctcagcctcccaaaaagtgctaggattacaggtgtgagccaccacacccagcctaaaaaattttttttttatttaaaagaagaaaaaggctgggcacagtggctcaccatcaatcccagcactttgggaggtcaagtttcactcccagagtgctgggattacaagcgtgagccaccacgcccagtatgatttgtattttttataaatattttaatgttgtagaagaaaaaatattgccaagcatagcatttttctccccaccccttcttacctgtttaatgacacggcacaatattggccataggcaagaagggtgaggctgagctcacttgctgtttttttttttgaggaatgggtaccaaatttatttgttaatttcttgcatttgaagtacacagtcacatccttggcctgaaattctttgctgtagcccttcactgtgacacaactgcaaccaaccactttacaaagttttccttgtctatcagttttacaaaggcttagccatgtctctggtttcttaaggtcatcaaccttaattgggttgatttggtgttcggcacaaagggccacccctagcttgacatacataggctcttcacatttggatgcaagcacgcaaagatgggcttggcccttgtctaaggctttggcagctttgcaggttccacctgctaggccatcatggctgagggcggtcttcagtctcttgtagagcagtattaatatccattacacctccagcagcgtgtcttccttggtcatggtggtgggttacaggtgaaggtgaatcttgagcgcactcaagcttctgtctctgagcatgttgtccatggcagagaaagagagttgcctttcttttcttaactgcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggtgaggtggctttcgatggattgttgctgctctgcattactcagtgggtgcttgtttgatctcttggttcttaaatgtttcttttctaggtgtagatgttctcttttgtgcagacctggggaaatggctctatttttgtgtgggtttttgttgtttttgagacgcagtctcactctgtcacccaggctgcagtgcagtggcatgatcttggctcactgcaacctccgcctctgggttcaagcaagtctcctgcctcagtctcccaagtagctgggattacaggcgcatgccaccatgcctggctaatttttgtttttatttttatttttttgagatggagtctcactctgtcacccaggctggagtgcaatggcatggtctcagctcattgcaacctctgcctcctgcgttcaagcggttctcccacctcagctgcccgagtggctgggactacaggcgtgtgccaccacacctggctaatttttttttttgtatttttagtagagatggggtttcactgtgttggccaggctggtctcgaactcctgaccttgtgatctgcccacttcggcctcccaaagtgctgggattacaagtgcaagtcaccgcgcctggcctgatttttgtatttttagtagagatgggttttcaccatattggtcaggctggtctcgaactcctgacctcaggtgatccacccgcctctgcctcctggaagtgttgggattataggcatgagccactgcacccagccggctttgttttataagtgtgaagaaaattgtttctggtcaaagtggagacaacaactaaaccaaatcaagaaatgggaaggacagacagactgggtatacatcagcatatcataagttctgatattctgcaataaagaaacccaatgttttccaacttgcagtgttttttttttttttaatgatgctaactagttacattaggaaaatagatttgcttttgtgtcactgttttttgtttttaaacagggtcttgctctgtcacccaggttgtagtgtgatcttgctcactgcagcctcagcctcctgggctcaagcaattctcccacctcagccctcactacaggctcacgccaccatgcctggctaatttttgtattttttttggtagatacggggttttgccatgttgcctaggctggtctcaaactcctgagctcaagctatctgcctgcctcagcctcccaaagtgctgggattacaagcataagccagtacacccagccttgtgccactgttttaagccttgagttgtcaggggatgtggacaccttaatgactccttccctgtccccagcccctgtatgcagttttccctattaatatcttaccttcgaagggtaaatttgctatatttaatgaagcaatattgatacagttttattaactaaagaccatagtttttttctgattcccttgttttgttttgttttgttttgttttttgagacagagtctcgctctgtcccaggctggagtgctatggcgcgatctcagctcactgcaacctccgcctcccaggttcaagctattctcttgccacagcctcctgagtagctgggattacaggtgcctgccaccacgcccggctgatttttgtattttcagtagagacggggtttcaccatgttgtccaggttggtctcgagctcctgaccttgtgatccacccaccttggcctcccaaactgctgggattacaggcgtgaggcctccgtgcccggtcccttagtttttacctaatgttctttttccattccaaaataccacattacatatacttgccatgtctcattaggctgttcttggctgtgacagtttttcaggcttccctagtttttgatgaccttgacagctttgaggagtgctggtcaggtgtattgtagattgcccctctgttggaatttgtttttcttgtgattagaccggacttataaagggtttgggaggaagatcacagaggtaaagtgccatttgtatcccatcatatcaggggtacatactatctttatgatttatgactgttgatgtggaccttgattacctggctgaagtagtgtttgttcgttaggtttctcctgtaaagttattcttttcattttccccctttccatgcactttttggaagaaagtcactatgtgcatttcactcttacagactggagagttatactctgtctacattagggtggaatatctacatattttatttgggatttttccatattggggatttgtctcttttccccaatttatttatttattcagttatttacattagtataaacttatggatagtttatacttcgttataatctaatgctactatattttgttgctcaaattgttccaactttggccattgggaattctttcagctggctttgtgtccattggcagtatcccattgtgtttttgtgtatatgtgcctgcactttaaagcacttctttcctttctggcaccaaaagatgctccaggctcatcttgtttatttcttgctccagtactagaatcagctgtttctccaaggagctctgcttccttttattggagaatgatattaaaaccaagttctaggccttatgtaagcttgttgctactggagtgtttcttttaggccctctcacttgacagaataaataactgtaagccaggcgcagtggctcacacctataatcccggcactttgtgaggcagaggtgggtggatcacaaggtcaggagttcgagaccagcctggctaacatggtgaaaccccgtatctactaaagtacaaaaattagctgggcatggtggcgggagcctgtgatcccagctacttgggaggccgaggtaggagaatcgtttgaacctgggaggcggaggttgcagtgagccgagattgcaccattgcattccagcctgggtgacagggcgagactctgtctcaaaaaaaaattaaaaaaataaagaattgttacctgtgtgtgcttactcgtgtatatattacatatctataaatttttatttgcatagccatctgtatctacatatattaagttaaatgagctttctttttctttttcttttttttttaagatgggttcttgctgtgttattcaggctggagtgcagtggctactcacaggtgtgatgatagtgcactagagcctcgaactccttggctcaagcagtcctcttgcgtcagccttccaagtagctggggatacaggcatgccccactgtgcctggctagtgttcttattgatgtctttagctgtaatccattaccacatagatcgtcctagcctcctccctgtgctaatttgtaaattcccactccaacagtaagataccttgttcctaccatctgccatccatgtattgaacttcagttcagttccagtatacaaatatagcagtatcagaattacatactggtaccctcctgggaacaattttatcaagtagagtgtacacacacacacacacacacacttctgaaataatcagtaattttttaattgccatcgtatagaaactgaatatttggccttaaggaagatgggatttagatgaggagtagaatatagagaacttgctttctctctcactgccttattagaaagaaagaaaagaatgtagaaaacttgctatgttttgctcagttaatatttgctatctcatttaattctcacagttgctctgtaaggtgatattgtgatcattttatagaggagaaaacaaaggctcaaaggatttacagaagaagggatcaagttgagattcaaggtcagcctgactcccagagtccattcccttttgaacttgtcatcaggtcatttaaaatctagttaagagaatgaagcagtaatatttaaagtcaaataacaagagatataaagtattttaagggcagaatgtggtggctcatgcctgtactcccagcactttactacgctgaggtaggtggatcacttgaggctgggagtttgagaccagcctggtcaacatggtgaaacccccatctctattaaaaaataccaaaattagctgggtgtggtagcacatgcctgtaatcccagctattctggaggctgaggcatgagaacccaagaggtggaggttgcagagagccgagattgtgccattgcactccagcctgggcgacagagcgagatgctgtctcaaaaaagtaaagtattttaaagccagcacggtggctcacacctgtaatcccagcaccctaaaagaccaagtggggagaatcgtttaagtccaggagttagaggccagccaaggcaacacagttgcctaccaaaaaacttttaattacctgggtgtggtggtatatgcctgttgtcttagctactcaggaggtgaggccataagaccacttgaggcactgcactccagcctgggcaacagagcaagataccctaactgttttttttttttttttttttttttttttgagacaaagtctcactcttgtcatccaggctggagtccagtggtgcaatctcggctcactgcaaccttcggctcacggcaacctccgcctcccaggttcaagcgattctcctgcttcagcctcccgaatagctgggattacaggcgcctgccaccacacctggctaatttttgtatttttagtagagatggggttttaccatgttggccaggctggtcttgaactcctgacctcaggcgatctgcccgcctcgccctcccaaattactgggattacaggcatgagctaccgtacctggccacaatcccaactcttaaaaagaaaaaaaaaagaaattctgttttaacactgtaatagaaaatataaggcaattatagtattaattgcaaaataagtgtttggaccataatcttttttttttcctttctttttgatgccatgactcagataagaaccatggaccataatcttatagcaatgaatttttttcctcctatgtcctttatgtctttcgtctttttccatggttcatggtttaaacaacactggagtggccgggcacggtggctcatgcctgtaatcccagcactttgggaggctgaggcgggaggatcacctgaggttgggaattcgaaaccagcctgaccaacatggagaaaccctgtctctactaaaaatacaaaattagccgggcatggtggcacatgcctgtaatcccagctactagggaggctgaggcaggaaaatcacttgaacctgggaggcggaggttgtggtgagccgagattgcgccattgcactccagcctgggcaacaagagcgatactctgtctcaaaataaataaataaataaataaataaaataacaacactggaaagcagctgaattttttttttttttttgagatggggtcttgctctgtaatccaagctggagtgcagtggtatgatcacagctcattgcagccttgatcccctggacttaggtgatagctgtagtagctgggtaccataggcatgtgccaccatgcccagctaatttcttttttttttttctttttttttttttgagacagagttttgctcttgttgcccaggctggagtgcaatggtgtgatctcggctcaccgcaacctccgcctcccgggttcaagcgattctcctgcctcagcctcccgagtagctgggattacaggcatgtgccaccacacccagctaattttgtatttttagtagagacagggtttctccatgtcggtcaggctggtcttgaactcctgacctcagctaatttcttttgtattttttttagggatagcgtttcaccatgttgcccaggctggtctcaaactcttgggctcaagtgatctgccctgctcagcttcccaaagtggtaggattacaggcataagcctggcccctctgattttttacttcaaggtggccttctttttcttcccattgcctcccaccccttttcaagcccttgtcagccatgctgatgttactaccttctgtattttctaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgagtcactgtgttgttatttattaggtgtgctatttcattagctgcttaatcctttgagtcctaagactctttggagacgctatgaagctccaatgtgggcccttttaagagcttttcttgcatacaaaccttttctccctctactttgacttctctccaggcatctcatctttaatagatctttgactaattatagctaaaaactctcagagaatacagcataataaatagccagtgaaatgtttgctttgtatctgttactgcagatgagaaaaaggtgtaggggtagaaagaacgaaccagtatttattcactgctaaatactaggtaccatattatagatctttttttttatttattgttttttagacagagtctcggtctgtcgcccaggctggagtgcagtggcgcgatctcggctcactgcaagttccacctcctgggttcacaaccatcctcctgcctcagcctcccaagtagccggtgctacaggcacccgccaccacgccagggtaatttttttgtatttttagtagagacagggtttcactgtattaactaggatggtctcgatctcctgacctcatgatccgcccgcctcagcctcccaaagtgctgagattacaggcgtgagccaccgcacccggcctatagatcttacctcatttaatcttcacagaattcatatagggtaatactgcatttttatcagtgcagcagttgagtaactgcctgaattcttttttttttttttttttgagacaagttctttgctctgtcacctaggtgggaggggcacaatcatggcttattacagccttgacctcctgggctcaagttgatcctcctgtgtcagtttttgatttatcgtagagatgaggtctcactatgttacccaggctggtctggaactcctgggctcaagtgatccttatgctgtgtcttcccaaagtgctggggattacaggagtgagccaccatgcctggcctactgcctgaattcttttttttttttttttaagatggagtctcactctgtcgcccagactggagtgcagtggtgcaatctcggctcactgcaacctccgcctcccaggttcaagtgattcccctgcctcagcctcctgagtagctgggactacaggcacccgccaccacacctgactaatttttgtatttttagtagagatggggtttcaccatattggccaggctggtcttgaactcctgaccttttgtgatccgcccaccttggcctcccaaagtgctgggaaaacaggtgtgagccaccgtgcccggcctgaattcttaaaactaataaatcattttggaataggaatccagctgtttctgactcaggtttttttaagtgcactacgattgtgtttagcttttggaaaacaaatcctgttttttggacaaacgtagatatatctctctaaaaaggtggatagaaaactacttttgtcctctgcctacctgatttcctcctttcctgtgtcaattgcagaaaatttgctcctgtagcttccaatcatggtattggtgaacggagatggctgccatctgctggaatttcagtgactagcaggctttttttatttttagaaacttccgggttttgttctttttttttctatttgttttgttaatgttgaacatttagagacaccatttctgtgccaaacatggcccgtgacgttaaaagacttggtctcttttacaagggcttgtggtctcaataaatggaggccatgaattagttgagccccactgttgcctcaaccaccccccacccccgactccctgcctttattccacttcacttgtgttgatcccttaagatctctccagaaagaaatagacaaatcataaaatcaacattttaggctatgagatggctgggagtagggccggtaatagtcaagggagaaggaaggaagtgacaggaatcttggttcaataaacagattggataagatgaaccagagtagggatacgt

SEQ ID NO: 15737 - DNA, 27727 bp, Human
aagctgggcctggtttttttttttttttttttttttgtggctccttaaaagcctcaggccatgggagaggcttccaccaaggtgagatagaatcggggcattgtcctgagtgtctgaaaccctttgtctctccctgtccttcctggctcttgcttactttgccctgggcaggtggcaggccactgtgtgggagtgaaggagccatgcctgaaggggggctggggtggctagcctgtactctgttactgtagcatcccaccagcctggcctcgctccaggagccctcgaactggatccctctgacctctaggaccgccctgcagaaagcaccaggggcctttctctaaaagatccactggctccaggagtgtctcggtggcataacagcccaggccatgctatggtacacctaaaactatagttatcagctcttaatcctgtcccccgcaaatccacattccaaccacgcagaaccttctgttctctaaacgtccccacgcttctgcatctcttcccagactgtcttcgctgcctgaaacattctccctgataccccgcctccttatcctagcacacacggatcatcatactctgataacctcagaaacatgcattgaccttcaactgcgtgcagtcagggtgaggaggggtgagggcgccaggagactgagggtctggccagagataagacccacaatttcttccaaactacaacttgctccgttcaacatacatacacacacacacgcatgcacttgccaccctccaggccttcgttcactcttccctctccttgtgccccttcccctatcacctcgtgccaagtaagactgagctctcaagccttcgctcagatgccatctcttccaggagcccttgcctggtgcctttcacccagagcttctgccctggtttggacctccctcaggatacccataatgcatgtgtgaattctggctggctccatgtcctttggcctcagttcccccatctgttaaatggaatagtaacacctaacccatggtgtagttaccgagttgatgaagtacagtaactgacttgtactaagtgctgagcaaatgtcagtctttaccaccagcagcagcagcagcattttaatctctgtatctttagcactgagcacagggctgaatacataattggtactaaatacttgcttggtggagggatggatggatggatggttggatggatggatggatggatggatggatgatggataaatgagagatctagtatgtttccaaaataagagacaatctttgctggggggcgagggggctaggaagagcctgaaagaaactaaccttcatcgtacacctgccatgcatcaaagctcaacatatataagttgtctaatttgagcctcacaatagcaagatattactgcagaataaggaagtggctaattctgagaggttaagtcggtggatcagtgtcacacaagatgtagtcaggaccagggactttgatggtcctcgatacctggaaggaggaggaggaggacttgctccaggccttagctactgtcaatcttagactgaaaattcctagggcatctctgtgggcagggcagggccaccccacccaggctgtcacataaagtgctcagctgagaacctagctttggagaacagcagaaaggaaaggccgggccagcggaggtggcttgggggctgcctgtggagggtggctgggggactctccttccttctccagctcctccagcaccaccctcagcagcctccaagaacagaaggagttaacgctgggattaacttcttgaaggaacctgaagttttttaatccttgttctttcctccttccttctccctctcccttcctgatctttactccgcctgtgggtccctcctccttactctcacctccccaactccaaaaacactctgattgccagactgggtcaatggttaacactcaactggctttatataagcctgccacctgcctgcttggctgcatctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggtaaggacttggtgttctgagcacagataactccagggggcagaggagggactgtctgggccggggttgggcatccttaggatccagcataacttcctcactgcccctgccctggaagtgaggctatcgccccctgctcctcctgaggactgagggctaggaggtcaaaggggcttttgcttggcacccagttgtaggagcccagcgtgaattacttaggtgggtttgcaacctactgccctaggaaacaggaaaccagttccatcaacaagatgcaaggggggcagatggagctgatctacctactgtgtgcccacctagccctggactgggctccatggcggctgagatgggctggctgtggggaggggacggctgggtaagcagcagcagagtgaagagggttggaaggagaataggagaaagctggctgcaggcggtctgcatctttaagagcataaacaggaagagaaagagttcacctgtggattcaagggctaagtctgtggaggaggaggggtgggagttggaagaggggaccgctgcaggtagacagcacaaaaactgtgccctggatggagggggagctgggcacaaccaggcgtcactgcctcctcctccgcccccagcagaagtcataacttcatctctcattaaatcaagccgccaatgcctgccctgccctaggcacccagtaaccttttccaccatcttaagaggtcaggcctgactgtcccatttgacaaatggggaaggtgaggttaagtcacttagtcaaagtcccagggcagatccaagtttcatggaacttggatattatacacttttgggccccactctgtaagaaaaaggacacaaaagtattaatctgaaattagtttggggctttgggaagggtccagggggaaggccttgaagttcaatcttcagtcagtcggcctctggcaaatcacacagctgggaggttcagagctgggggtgtgatctggtgccaaagcatgtcttctctccaccctgctgcctcctgccccaccccacacccccagaactgcccatcaagccattttcttccttttgtcatagatagagaaattgagtcagacttttttgttcatggtatcccaaaggggtgagagactgggggtgatagtggcacagcccctgggcccctgacacctggtcagtaacaaggcccagctgacctttgagatgaccttcatctcaggccaaagccggtggcatctcagtgctagggacccatcagatgggttttccgacaggctggggcaagtgtgttaaccccaggagggaagccagacagggattttgatttcttcccaattcccctcgacctggggaagcacagcacagaaagattcagtaacttgcccaggtcacacaggaaatcctgagtcagtgctagaagccatgcctgttggtgagactgggatgtgttaggagcccctgtcttctgtgcaccgtatctggccctgctacctgcctctggctcacagatgctgccagccccatcctgactctggtcctgtctaggagaggccagcccctctcaaggactttgctcctgcaattgtcctctcactctcctacaagataaatatttcctctctgcctgatctcccccatccacatacggaggtgctgtaatatctctcatcttaaacaaacaagagctctctttcaaggccacgctccttccaggatagtgcctctttctctgctctctctcataacaggaagtctcaagacactgtctacaccacaagcgcactttctcttttgtcagctcccatctccaagactcagatcccatcaacttccttgtgaccaaaccctgggccaccctcacattcctcagtccctcggcagcatttgtcacagctgtcaccccgtctttgccgtgctgtcttctcttggctttggtgacaccttctcctggttcctgcccagccctgccccttcccacctttcctgactctgaggttccttctccatctgactctgaggttttccagggtccccacttcccctagctgatcttatgccatctcgtgctttaaaaagcatctctatgccaatgagttatcaatctgtaaccccagccctaaactctaaactggtattatccaatgaacaccagccatctccctaattgaatattttctttgtaagcaggataagcaggttacacttttccacgtccaaaccaaaacccttcctgcccttctccagttggcttaggcatcaagaaatgcttcaaccatctaccttgctgcaacagccaaaaactcgggggcattcttgattcttctccttccctcctttccacgtgcagcagaaggtcctgctcatttgataccccaaaatactctgaatggagtcactccccgccctcggatccactgtctccccggtcatttcccatgtgtcccactctgctcaaaaccctacattggccaggcgcagtggctcacacctataatcccagcactttgtgaggacgaggcgggagaattgcttgagcccaggagtttgagaccagcctgggcaacataatgagaccccaccttaatttgaaaaaacaaacaaacaaaaaaaccctacactggcttcctgtcaaacttaggataaaacctcttcaagcagccagaagtcaccaaggctcagccctggactccccaggctccctccccctgtgacccacctctcgctcactctcccccaccctcaccagctttctttctgctcctcacattgctctggactgctctcccagatacctccttcctgtttttaggtttcagcttaaatccacctccttagaaaagccttctctgaccaaccccagtcattcttggggaaaagccctgttcttttgtttatagggtgtttactctctgaaatcatctatttgcttattttttacttcctctctggcttcctgcactagaatgtcggctccgtgaggacagggactttgtcttgtcccatgcagaatccccagtgcctggcacaaagtagatgttcaaaaaatacttgttaggcctggcgcagtggctcacgcctataattctagcactttgggaggccaaggcaggtggatcacttgaggtcaggagtttgagaccagcctggccaacatgatgaaaccccgtctctataaaaaaaaacacaaaaattagccaagcatggtggtgcacacctgtaatcccagctactcgggaggctgaagcaggagaaacgcttgaacccaggaggaggaggttgcagtgagctgagatcacgccattgcactccagtctgggtgacagagcaagactctatctcaaaaaaaacaaataaaaaacacccaagttttttttttttttttttttttttgagactgagtctcactctgtcacccaggctggagtgcagtggcacaatcttggctcactgcaagctccgcctcccaggttcatgccattctcctgccttagcctcccgagtagctgggactacagtcacctgccaccacgcccggctaatttttttgtatttttagtagagacggggtttcaccgtgttagccaggatggtcttgatctcctgacctcgtgatccgcccgccttggcctcccaaagtgctgggattacaggcgtgagccaccatgcccggccacccccaactttttgaatgaagaaaggaaggaatgtgcacacagtggatcctgacctgcatccctgttgaatctctactctctgtaatgagtccccaagcttagccccatggccctggcctccaaagggggaagaaggagccccagcctaggctcaaatttgtgcccataataataatattgacatttgttgagtatattttatgtgcttgacattatgccatgcacttcaaagcattgttagatcatttattcctttcaaaagcctatgtgtcgggctgggcatggtggctcatgcctgtaatcccagcactttgggaggcgggcgcccaaggtgggcagatcacctgaggtcaggagttcgagaccagcctggccaacatggtgaaactccatctctactaaaaatacaaaaattagccaggtgtggtggcgcatgcctgtaatcccagctactcgggaggctggggcaggagaatcgcttgaacccgggaggcggaggttgcagtgagctgagattgtgccactgcactccagcctaggagacagagcaaggctcagtctcaaaaaataaaaaaaaaaagcctatgtgttacatgaggttactactactatctccattttacagacatgtaaactgagggccagtgtggggaagcaatttgcttaaagtcccagctaggaaaaaagtttgaactggaacctggtgttggagtctctgcctgaggctccctgggaggccggtggtgcccccgctgtgacccacctctcaggccatcctttctcatgtccgtccagctgtcagtcagtcctcccaccatacttcagtccagcatatctgttgagctcttgctctgtgtcaggggttaccaaaaggaatacagatgttccattctcaagttgcttatagtctataggaggagacaggtgtttacaccacacaaaggttcagccagaaggctgcagagctcagaggagggagcaaattcttccaactgagtcaagggagaatctgaaggaggcaacatttgagttgggccttgaaggttggtggagttttaacagtcagaggcatcagcagaacaggtgaatggaaccacaggaggaaagatgtaggggccaggaatagtagggtgtgtttgaggggtggcaacagaaccttgaaatgctagtcactctctggtggtcccagcagatggggaacaggagggcctggggtcttcctgctctcccaaccctgcagccagacatggaaaccttacatccattcaaatgtattcatccaaccatgcattttgttagtgaacatagaactcagtactgtgtgacaagtactgtttgggtgtgttgggaagagaaagtgggaggagtggggagacatacaaaaagcagaaacaatgcagcaggctatgaccacagcctggggagggctgctctagatggggtcagggaaggcctcctgaggagggtgttccaacactctgggaggtcaaggtgggtggatcgcttgagttcaggagttcaagaccagcctgggcaacatggcaagaccctgtctcctcactaaaaaaattagccaggtgtggtggtgtgtgcctgtggccccacctacttgggaggctgaggcaggaggatcacttgagcccaggaggttgaggctgcagtgagccatatggtgccactgcactccagcctgggcaacagagcaagactcctatctcaaaaataaattctctatagtcagccaagcacagctctgggtaaagagccatccaggcagaacaagcagtaagtgcaaaggcctgcagatggggagagcttagcaaattgaagggattaagcaaggccagtgtggctttgggggctcgagtgaggccttaagaggcctcactagattgcttaagtcaagtttagagaagagggttgaggtcagccaatgtcagccctacaaggctacagggaggagtagggattttgtgctgtgagcattaaggggtgaataacttacgactcaggggttgttcagctagtaagttacagtcacaacacaaacacctcccaggacccaaaggcatctgtaaaaacagtctcctagtggctcaacattggccaggacagaattcagctgaagtcaatattgcatttattgtaaggccagaaggcagaatttcttaatctgaatcactggcccttttagaatgcataaacattacatgtgtttgaattttaaaatctgtgtaattaaggctgggagtggtggctcacacctgtaactcttgcactttgggaggccagtgcaggagggtggctcgagttcaggagttcaagacaaacttgggcaacgtagagagacttgtctccactaaagatcaaaaaagttggctgggcgcaatggctcatgcctgcaatcccagcactttgggaggccgaggcaggtggatcacctggagtcaggagttcgagaccagcctggccaagatggcgaaaccccatctctactaaaaatacaaaattagctgggcgtggtggcacatgcctgtaatcccagctactcgggaggctgaggcaggagattctcttgaacccaggaggcagagactgcaatgagccaagatcacgccactgcactccagcctgggcagcagagtgagactctgtctcaaaaaaaaaaaaaagggggggtcaaaaaaattagctgggcatggtggcgcgtgcctgtggtccctgttacttaggagaaccaaggtgggagaatcacttgagccagggaggtcaaggctgaagtgagcagtgatcatgccactgcactccagcatgggtgacagaacaaggccttgtcaaaaaaaaaatctgtgtagttaaaatactcttagtgcaagctgttcctgaacctcaaaggcagggacttggatgattcacttcgggcatgaaaactatacaaggaatttggacctctgttctgggccccacctctaccttttgagatttcttggccctcagctgagatagcagagtccagtgaacaaaacatggattttggagccaaacaggtgtgggttcaaatccattcagcagcgtgtactgccgtgtgacctgaccgagcctcttcaaaccctgccatctctaaggggtgttgtgaagatgagctgagatagcacacatatacgtagagtacctggcacctggggcttgataaacacttgctcccttcgccctctgcctcttatctgaattcctgggcccctggaaaacacagactggtctggagccctgtgtggatacctcacttcttctccattgctctgttcaaatgggctcttgtgcttaggagggcctcagatgttcccacctatagaacaggaaggaatgtctggtcacccaccagattggtgagctgtgtccctaggaatacctgcagctgtgtggaggtagtttttctagcctctgggatgcctggaaataggataagaagaaggacccagcctcaaaggccagggggatccctggcgtagagtccccaacttggattttgcccagattactaaatcgtgtccctgtttatcggcacctgctaggtgaaggccaggaatgggaaagtaagtcaccctcttcgacagtaaagtttcctggatgtaatccagcagcgaggctcagggctgtcacaaggatcaaattcgtagaggagcttgcattttgctctttagtgcatacaggcagggctggccctggcccaggctgtgatatcaggactcttctccccacttttgttttctccagcactcaaaaattcattgttccctttggcctcttaaaacagaagctgatgcaacaaagtcattcacatcaaggtgtgcaaatcaatgaaggacacttgaatgagaacaagcaaagggtaggaagagtcaccgccatcacgtgcaacttgaggcaggcatggggtgggaaagctttagaatggtcaaaagggaaggcttccagtgcatgctgttgggcacagggaagccataggcggctaactagaagcagcaccccaggtgactggttaggggagcacatttcgctttctgggcttggtcctgagttggaagtaggagtaaagagtttggggcaaaaatcaggggaattggcaatcatcgagcaaatcctgagtgtttagggcttactgctgtagaggttgtcgtttgacttctcggctggttattacagaagttgtgaaacatatttttacatatgaactggccattgtcccctttgtatattcagtcctcaaagaattaggcatttggcatctgcctattcttcctggaagagacttccatccctccacactctttcatgtttttgtttgtttgtgagatggagtctcactgtgttgccaggctggcctcaaattcctgggctcgagcaatcctcctgcctcagccttccatgtagccacacaccactggacccagcaccttttcatattttaatagctgtgtttatttatttgtttaggttttaaaagttaagggtttgtttgtttgtttgtttgtttgttttgagacagggtctcactctgtcacccaggctggagtgcaatggtgcaatctcagctcactgcaacctctgcctcccgggtggttccggtgattcccccacttcagcctcccaagtagctgggattacaggcacatgccaccatgcccagctaagtttttttgtttgtttgtttgtttgtttgtttgttttagtacttttagtagagacagtgtttcgccatgttgcccaggctggtttgaactcctgggctcaagaaatcctcctgcctcagcctcccaaagtgctgggattacaggtgtgagccaccgcacccagcctattacctgtatttcaataaaattggtttcctttgtagtcttatgtattttattggtgcatttaaaaacattattctaagacactggaatgcttcatcaggctgccaaggggatcctggtaccaaaaaaagtgtacaaacccctacatcagaaatttccctgaatgcatacaaacacttgcacacaaattttttaaaccgcgtgtggtagtatctgtgtaatattttattaaaccacaagtctgaccatgccactctctctctgcttaaaactctttgaggccttctctctttttctcccgtcttccagacaaattcctagatcctctcagggcagacaaggctctttccaagaatgcatcttgatcttttatgtctcattctgttctacatttactccctcaccccaaccccctttgcccactaactgaactcctactcacccctcagtacccgctcaaggttccctctctggaagccttcctcaacccaaacaaaaggaggctcagggacggggccccttctcctctgagcgccattcttctggactctgctttacaggtgcttggcaggctgccacccagtgcctcgccttgctcctgagacccgggagtgctcctgccggcagcatgtccacttgctaggggcagaggggcagtgggagtgtcccccatgtgccagcctgtccccacccttgggttaaccttcagtcaccaggaggaataaggtgtgacacctctgagactgtgggcacatgtgctgctgcctgacagtcacaggctgtactgtgccagtgacagaggccatgatgcccacaggtcccacacctgccacacaccccgggtccggagtctgccctggactccttggcaccttcacttccatttgtgcctcatgtaacctctctggttctccagaagcccaggagcacatttctctcccagcaccaaccctgctatgggctcacaggctacaatgctttaaaacttattcctggctgggcacggtggctcacacctataatcccagtgttctggaaggctgaggagagaggattgcttgagcccaggagttcaaggccagcctggacaatatagcgagaccctcatctctacaaaaaaaaaaaaattgttttaattagctgggtgtggtggcacatgcctatagtcccagatactcaggaggctgaggcaggaggattacttgaggccaggagatcgaggctgcagtgagctgtgatcacatcactgcactccagtctgggcaacagagtgagaccctgtctcttaaaaaaaattttttttaaaaaaaccttattcctacatttgttagctctcttcgtccttacagtagcccagttaggtggatgtttctgttatccccatttccagatgaggaaactgcataatggagataaatgtgtttacagcagcgaatgcttgatgtttcttaccagaaaagctgagagaggttaagtaacttgcccaaggacacacagcagtaaagcggggactcagcactcagcatgtgccctggacatgtgctttcccactacagaagaagcaagctgcctggcttagggtttggaagcccctctgggggtttctgtcttcagtctgcccttcaggccagcccacacaggcactcagactccccgagggccagcgctgggcctgactgatgcctgtacccctagggcccacgttcattcacccactcattcagtgtcaactctgctaaatagatgccaggcacctcgctggggtgagcagaaacagacttgcaccctgctccctggagggtagagtctgacaacaaagattgatactcatcttttagtccctaaaactaaatgtttaattgcagactatgatgagtgctatgcagaagaggtacagggacttagagtgtgaaaaatgggaactatatcccctcctggaagccagcctgaaaaatcaatatttgagctgagatctcaagaaccagtagatatcaactacgcaaagtagggagggaagagaggtccagagagaggaaatcgtgtgcagaggccctgtggccagagggaggatgcagtatttgaggaacccacagagggctggtatggccagagcagagagagtaagggggagagtgttaagacatgaggcacagaccaactctaaacttaggttcctgaaagcactaggaagccactgaagagatgtgagctgttttgagatgagtgtgtgtgtgtgctgggggaggggaggtgcaaattaaacagatttgtgccttgagatcactctggctgcagcaaggagaaaggatttcagggtcaagagaggaagctgggagatgaataaggaggcttttgcagaggtcttgctgagacttggaccaggctagtggtccagagctacagagaaataaatgggagcactcaaggggcagaaccagcaggactgggtgcatggcccagagagggtatttgtggaatgagtggctgatgaacaggcaggagacccagggtctgcctgaagtgggcttccagtcacaaggattgactgctgggtggagaagagtgaggatctgaacagggtgacttccttgggggtgggggtgacaccagtgggaaaggaggctttacagaccaggccagcacctgaaaaagagagacaggctagatcatagaggagaaagaggctacgcccccgtcctcaggagcccataaacagatcttgagaggagagtagctgctacagtcaaggaacagagctggggaacaaccaccctgctggcctggggaaggaggaggcagggccagaggtagaaagaagagcattcgccaccaggagaaaactcttccctgctggtttctgagctccaggaggggccaccagggactgtggtgcaggccatgccttgcacaactccatatgagaatggcgacctggacttgtgcagtgcagcagtcctggggagcagccagtggccagcgtgtaaaccagctgagtccaatgccataggctgtcagttgaacttggctggcctaggttccatagagctgggttgcaaggcagagagcactagagtgacctggaaggataaggctgatccccaaatccccacttctagagctgggaatactgaccttgtaattggatatactgtgtgcctaagaagaaaagacccctagggctctgccctcagggagtgcccgagagtacctgacccagggggcctctcagaacactgacagctcctcagtctcaaacccaaaccctctaagcatcaacaactgtcaacaaggcaaagctagacctctctgagtcttggttctgcccttttcagaaaattactttgaaatgcacaggccaggcacagtggctcacacctgtaatcccagcattttaggaggctgaggtgggaggatcacttgaaaccagcaattcgagaccagcctgggcaacaaagcaagaaccatctctacaaaagatacaaaaaaaaaaaaaattagctgggcgttgtgacacatgcctgtagtcccagctatttgggagtctgaggcaagagaattgcctgtgcccagcactggaggctgcagtcagccttgatcacatcatgaactccagtctgggcaacaaagcaaaaccctgtctttaaaaaaaattttttttaattagaaaaaataagaaataaaatatacaaaataaaatgcatgggattacaaataaaccaattattttgaaatacaggtatcaaaatatggaaaaataaattgcagctcagaaatagatgtacttccttgctagtacattaggtaagatctaaagttggtataataactaccaaaatttcaaaataatgatggaggtaaacagaatgtcgagagctattctgaaacaactgcaacaacttatctggatcggtgtctaatagctgatagccacagtcaaatatctgtgaccaagtcaccaataatgccattaatagcactatgattttatgttcataaccttagttcgatgttcttgaatagataaaatagttttcccatttatcttcatggattctcagaactccatgccccagttaagaatctcatgatgcaggaagaacaaatcagcgaattgtgctccagcttgacaggctgcctaggaggtgggatggggaggcagggccaaagccacccggggttaatgaaggcttctggatggaacttcggaacaggtcttgtgttttgatctgagactgaggacaccctcaaatgcaagatgtttaaagggtttgagactgaggagctgtcagtgttctgagaggccccctgggtcaggtactctcgggcactccctgagggcagagccctagggagatagagaggaacccatcacagacataggcagcagggagcagggagccatgcatcaaacacactggaacacatggaggcgagtctgacttttttttttttttttttttgatacaaggtctcactccagttgcccagactggagtagtgcagtggcgtgatctcagctcactccagcctcaacctcctgggctcaggtgattttgccacctcagcctcccaagtagctgggactacaggtgctcaccaccacaaccagctaattcttgtatttttagtagagactgggttttgccatgttgcccaggctggtctcaaactcctttactcaagtgatcagccccccacggcctcccagagtgctgggattacaggcgtgagccgccatgcccagcctggtccgattattaacaactccctttggagtatggaaacagggtctcaaagtgacatgcttaacagagcccagccacaggaagtggcaggccctggggaagatagctctggattcagagccccagctcattctccctacactccactggtcacagggagcctgaggctgaggacaccctcaaatgcaagtgatcatgctcagggtagcaggtgaaagctggggcccgggaagcagatgtcctggcttctccacttactatatgtgtgactttgaggcatttttgaaatgtatttactcctttcttttttcagctgtgaaatgtgaacaatagttattacctctgagagcaaataaatgcaacttgtaaaagcatttgaagcacatagaatatgacgcctggcacaaagtcatcctccaatacttatacagaaacttcttcctgaatcagcagagtgagcgcaaccccagccctgctccttgtctctggccagagagttctgggtggacagggtggaggacaccagggtccaggagggctggcccacccttagtccaaggggagggtaactggccattcagtcattgcgggtgaggaaacactggcatcagcagaatcctgctgggggaggagggggctgggtttctctgtctgagggtcaaagtggccccaatcctggggctgatgagtttgtctccaggatgaagagaggtagtagaggtttggtggaaagagagcttggcttcggacagatttggtggggctatgtgcagttgggcaggctacacactgcacaattactggggcaccattcacacagactacaaggggagtgctcttaggtagtgcttgaaagttacccaatcccaatcctttatctgagttccatccaggctctgccacttttttttaatagttctgtgaccctgagcaagctgtttaccctctgagctcatctataaggtgggacccccacacccactttaatggctgttatgttttcatgtaaacacaaaaatgacaatactaagttcctaagagttgctgaataaatagcagctgcctcttcccccaggccaccgcctactcccacctcagggacccttcccaagctttagggtactaagagtgtgagcttagcctgtacgaggtggagaggacaaggacagggcaactgggatgggcaagggaggagggggtccccagccccattgtccaacaaaccccagcatgcggccccttcccttggcaaataaagagtgggcaggtgcccggcccctggagaggggatacgggtgccctctcctggctaatgattccccagccctgggaagcctcctggctaatgattccccagccctgggagaggctctataaggggggtgggcctccattcttgccccaggtccccttccaggcctgaggtcaggcttctctagacttgggggcttcatgcaggaaagagggacttctggtactcaaagactcacaagactcagcattgccccacaattccctgcacaacacaagcatcttgggggaaacttcacatagcctataaatgtaaattgctcctctggagttgtgtaatgcagcagccagaccaggattgctagaaaggatgccacaaaaccgactctgtctgatggagagctcactcctagcaaagggaacaaacactaaatatccaacaaacaaacatactcttgcagcttgtgataaaagccagggaacgccagggtgccaggcaaaggtccacattgcccaggtcctgctccttcttctggcagcccccatctcatcttgggatcctcagctgggcccctgcaatcccactgggctggatggggactggtaaccaactccagactctccgaagtggctggcttgtaatgtctgggctccccagggtcaaagacaaggtgatattgagtgccttgctttgctttttatttgcattttgaaatgagaccttgggcttgggaatcaatgactgtgggtttcacaggctctccccaggcagtcacaaatggcctggtttgtctgacagacaggaggtggcatagctctgggacacaggccctctgacagctctgccgcttctctcccacctgcaggaggcctactgcgcgtatgccatcatcctcatggcgctcttctggtgcactgaggccctgcccctggccgtcactgccctcttccccttaatcctgttccctatgatgggcatcgtggatgcctctgaggtgagccccatccataggagaaagcgttctgggcagtgcgggaggccagggggtgggttccctcagcccttgttgacaaaggaagcctcaccataggcagggcacatggattaggggttcctgactctgcatgaggaagaagtcagctagaaggctgcgggctggggtggggaggggtgcagaattagtgctgcgagttcattcaaggtgagagtgattagccagccgtaggtgggaggtggaaggcctagtgacacagaaaaggggccttgagggccagctaacacactcatatacttctagttcagtggctcttgaacttgaacagcatcggagtcacctggagggctggttaaaacacaaatggctgggtccagagtttctgattcggtagatctggggtagggcctaagcattttatttctaacaagttccagttggtggtgatgatgctggcccagggatcatactttgagaaccactgtctagtttttagaaaccgcactaaagtatctatctcccagtccatggcttgaaacatgaatggaatcacggtagattatctcccaactaattattcctgaggggagataaagtgagtttgacaagaagaggggaacctggttgatattaaatgatagataatccaggccgggtgtggtggctcatgcctgtaatcctagcactttagggggccaaggcgggtggatcacttgagctcaggagttcgagaccagcctggccagcgaggtgaaacctcatctctacaaaaaatacaaaaattagccaggcatggtggtgcgtgcctgtagtcccagctacttgggaggctgaggtgggaggatggtttgagccaaggaggtggaggttgcagtgagctgtgattgtgccactgcattccagcctgggcaacagagccagaccctgtctccaaaaagttaaatttattttttttaaatggcagatcattcagagaccatttccatccagtttcgagagcccaggggaatgccagtctgtgggaatgtcagtgactgcatcccataacctcgggggcaccgtgggagactccagggtcttcccgccgctcagccatgtctccacctgccaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgtgagttcctcctgcaaaccagcacgggagaacctgacgaggagatattctgggcacccagtccctgaagggaagctggaacagcagtgtgtctgtctgcccatccctaggctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttggtgagaaaaatgaggctagactctgccccaaccccttggttcttggagagagtctgagggtctgtccgtttcgagggctggtcatcttggagcctttggggagagaagaaagagatgcaagaaggacagtgaccaatttgtttttccttttttaaaaaatgtcaagtaccctgttttgggaatcccctcatccctgggcaaaccaagatgcttggtcaccatagcaagaagagagctggagtctaggtgaacagtccaaggtctaggctccattcttcctgagtggtttgggtaatcctcgtttccctctctcaagagagaggtcagatcatagagtgtccaagggtgctcccagcctgagactctggggaatgctgggcccctcaggcctggagacatcctctgtcctccttccagccccggtctgggctgttcacagacaaggtaccctggagggccttgcagccctggccccgttccccagagctggccctgtacctgcccccacctgggctctcccttgttcccagataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgtgagtgacaaggggtgggccaccttgggggatctgcacactcactgggaggtgaatggggctgggcagttctcggggcaatgtcacacggcagcccatgttcctccttcaggctcttcccccaaaacggcaacgtggtgaacttcgcctcctggttcagcttcgccttccccaccatggtcatcttgctgctgctggcctggttgtggctgcagatcctcttcctgggcttcaagtaagtggcaaagttggtgagagaagcccaggtccctgcccttagccctgggagcttccagttgggtgcagatgtggaaaatgatattatcaccatcccaatgagaaggcttctccctcccaaagcccctctgtgcacttggacccccatttgaggaaattactgggtagagagtattatcccatttcacagatgcgcaaattgaggcttcaggagtggttcgcaactagatttgtcagtgctggggctgcaaaccaggtcacttgatgccccttcccataatggtccaccgtcctttgataggtgcttaaggggcacacactgagcatggttagttacagaagcacctgctgtgttcctactgtatactgggttgtgtgtaaggcactgagaatactagaaggcactgggcacagtccctgtccttgtagcccatcaggtggatgatgatatggtggggtcacgacagagggaagcccagatgctgcaagagcacagagaacacagtgtctagttcagcccaggtgagtgaagattccagaacaccatggaggagatcatgcctgggctgaatcttgcaggactagaagtcagccaggtagagaatgggtgaagaaattccaggcagcaggagcagattgcacaaagcacagaggcaagacaagacgtgttcgagggaactctagttctgcaggactaaaacacaaacagcaaaaaggagcatcaggtcatgaagctggagaagtaggcaggggaaggttctggaagctcttgtgtgccacctaatgaagccaagagtaataaatagatttcattcctacttccaccaggttcctggtagtcactgtttggagctctgagttggaaaatcataggagaccctgctaaggctcagttagtatcaagtctgtgattgattagtgatgtctgccatgaatacgggataagagtggtggtatgagtgttactgtggtattaattataatttgcccttcctgcccaggcagtggagagcccttgaaagtttttaagcattgctgctgcactttggaaaaatcacttgggcaaatgtaaggaagctggattaaggttgggagctggtacaaggcaaggtggtagtagaagaggtcagcacagtgccaggcaccacaggggagtcaaagatgtgtgaagtgtggtctttgcccttgaggaactcacagtccagcagggaggttgagatttacccaagtggaaagttaaatgtcaacacaagttaagtcagcagcagaaggaagtgggctgcagcctactgtgcctctgaggacaatgcaggtggggctcaggctggcaggggataagcagagaaggcagaggagggaagggaggacttcccgaaggctgttggaggagaagagctgtgagccagggcaggaagaagtcccagggtctgagctgctaggtcctcctcaccctgggcaagggagggttcagcaccatagaacccctggaggaaaaggggctcaatggggcagggccaagcatggagaataagcaagaactatggcctctaaaagtcttctgctcctcctccagaacctcaggcggagctggggcctgagtgtagtgaccctgagatgccctctgtgggcctcagcctttagatggtaggcactcagagccccttgctccctgctggagcaggccccccacgagctgccccgtccctctgcctgcagcttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagaggtgagagttgcaggggttgggaggaggacacatctggggctcacatgctcgggaaggagggaagggtatagggcccccattgcagaacaggaggtaacacttggtgggggatgaaggttccccaggcttgtctatgggagaggctcatctccaccaccctccaccctgtggccctgagcaaccccaagcggctaacccagccctccccgcgccccctccaccaacagcatggtgtccgatgggacagtggccatcttcatcggcataattatgttcatcataccctccaagttcccagggctgacccaggacccaggtaagcacctggactggggcagggaagggtctccgggcagcccctgccttcaagtatgtaatgtaccttccaccacacttggcaggagtaggcaaagcccagaaaggctggagcgacttgccaagggcacagggactcggagacaaagttgagatgttgcagaactgagggtcccctcctgcacgcgttaagctccaaaagggacccacacagggagcccgcaaatggagaggggaaaggcctgtttgttctttggtgacccatccttctctgcttgggaagtagaaaacccagggaagctgaaggcccctcttggcctcctcgactggaagacggtgaaccagaagatgccgtggaatatcgtgttattgctgggtggtggctatgccctggccaagggcagtgaggtgagaggcccccagccccctcctcagcctgtgtgagggtgtctctgtggcagggagagagggggccctgcttctgtcccacagaggggagacctggtccccacgtaggagcctctcgggtaggcagagcctttgcagcagctgggaagacttaggttagagccctcatgtgggaggaagaaacacaagccctagggacctctttgttcagttctcaaagtccaagggaaggcaggattctctggtgggcagagcctgttctcagagacaaatgccatcccaccccagccctttgcccgctgccagagcacacagtagcatcagcaccaaagtaattgggggttgtgttgacgcggtctgccctccgcagccaccagggggcaccatgatcacacccacccaggctctggggaccagaacatctttccccagagcctccatccaaaagagggaaatccctgacacggcatccctgggcctccgtgttctggctcaaacagaaggtggctgcccaggtcagggatcggtgcaggggactcctgggtctgtggcatgttcatccactgactgtgcccagtcctgtgctaggcgctggccccactgagcgagattaagtcccaccttacagcctggcattccagacgtgggaaggcaagacctcggagctcttctgaccctgtggactgtccctgtcctcccattagcctcttgcagcctctgtcagggtcctcccccaactttccctccctgccaggagcaaggttccctctgccccaagccactggactggaaggggcaggaagagggctaaggttgtccagggacctcctgagagaggtcaggaaggcaggagtcagtgcggtcaaagatttttgctcccaccaagccccaaatttcccaagaaggccctttggccccctcctaatttctcatctgccccttcttcccacacccagctgttcttcaagagcaggaaagggcaccccttggtcttagctgggtcctatcatccctttagagctgtctttgactctgaataccagggagatgttagcaggagcaggagcctcatagagcctcggcagaagacttgggggcccaggcagccttgcctctcacatgccatcctcctctgcccacagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggtgagctggccctcagaaacacctcctccaggcagcccgcctgcctgccccaccaggggttctgcctgctgggcagagtatcctgtctttgcacctcctcttttccttttcctgaagaggacccctgagtttccatccttctccaggctcttgagccaccttgggccccaaggcgctttggcccctgactcaccccgtccctcatgatgtcacccctggagtatcctgatggggatcctggtggcctcacccacctccccaccccagtccctgttctggtcattcctgaggtgacggggtgaaattgctccccgaagcgtcccaagccccttcctccccaggcgtgttcctgcagcctttgatgacacccccggagcccctttgagatcagttttatgggcccctcccctcaccacaccccacaaggcagggcagcacactcattccctccagagaggtcaagaggcccttccaggtcacccagtgccttctgggagaagaggtgggctcatgaccagagagtgtattagggtacaggggttgttccccagagaagcaggagaattgggggccatgcccctccctctggcttggggaccaagttcagctctgcgccactgcctcccactccaggcccaggccatctgcctccaccctctctacgtcatgctcccctgcactctggccacctccctggccttcatgttgcctgtggccaccccgcccaatgccatcgtcttctctttcggggacctcaaagtgttggatatggtaagtggcagggaggcctgaatgcctcatccctccttcctgctctgacttttcatcttagtgaaccacaaagcagcttaaagccactgagagtctcagagttgagcgggtcctcatctggaatgaaggtgcagttggggaggttgggacatgacctctcagtggtggcatcttcaggccctgccagccccaggctatgtgagagggagggaagtgggtggggaacatggggaaggctccaaggtgccaggcacccacactcagggagatgagctcagagagaacaagcccagggccctggaagctcaggaggagcgcccctttcccctgttagcacagggagtaaagcaaggggcaaaggcattggctatgctgcaggttagaccaacgggaggacttcccagagagaattttgctggtaggagggctcctgtgcacccccaaacacctggggacttgggggcagtccagcccagtccctgcttagccaaatggactctcctcacaccaggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagtaaagtctgggatggtttttcatggcactctccagggctagtccccaatgtggttcagaccccaggttgggggagtccagaaggagggggcctggcctttgtcctatatgcagcccccttggcacccctcccacccaggggggaaggtaatggccgggcatccctgccaaggcccatcagagtgggcgcagccacctaggagagcagcactgacatcactgggcctggctaattgggagctgccagtccctgcgtgtctttgggaaaaccagcttccccgttcccagagcactccctgggtatttacataaaaccctctgcccctgccaattcctcatcgacccttcctccagctggaaaaaccggtcccaccaggccagagaaggcaggctgacctgtgctgggtgcccagaggaccgaccctcatcctgcagcacagcaacaggctggaaactggcatggccttcagagtccaggaccagaaaactttggatgattccgcctcccccaccccacctccacccggcctccccacactcccccaccccacatcctcatggactccagagttttcatttatctagcaaggtgggggtggggatggggaagaatgacaccgtatccatcgttccatctgcgagccaaacagcccttccctgctggaagttcatctttgtgttgatgctaagtctcgcccactgtggacagtggcgtgtcagccttgagttcatccagaaggaagcttcctagagtctcaccccatcccctcctcctccagtgggacagaaaagagatatttctcatcaccttcatgcccaaatgaaaaagggggctgggctgtgaagagagaaaaccagaaaggatttccttctggatccccctgggccgggctttcactgggtcctcccagagctgggggttggaagtgcagttaggagggggcactgcgtgggggagtacgtggctgtccccaggggacagggggtcctgacaggacacgccaggcatcccagagagccaggagtgtcaggcgggtggctccagccccaccctggtcccccaggctggcattcctcactcatgaagcacagccataaatcacagctcccactcagacccacaggaggaccccctcccacccaccaaagccccaggcaacagtcccctgcattggaaacggctggccccagaatgttggggctcccccagtggcctacccacaatgcagtggctccctaaggagcagcccagctccatctgcaaggaggaccctctgctgccacttccttctggaccctggctggggaaaaggagagtgtgcttctcagggtgcacatgccctgcccactgttctcggcacacttccccctcagtccggctcagagagggtcaggtgtggactgagatcacacagcagtcccagaaagtgagcacccggttggccctgcattctccaggaaggaggtggacgccagccagcctgagggtcgacagtttggctgcggtggatgccctggcagagctctggggccaagcctcccctaggtgctcagaaaacaccctctttagcaggcaggagggtggacaggcagca

SEQ ID NO: 15738 - DNA, 6983 bp, Human
cgcggacaaggcctgctgcagctccggcagcgcgcgctccagggcgtcctgcacctcggtgcctgcccccggcgacactttcgcgggcccgggccacccgcagcccaccatgggcccgtgccaccgcccccatctggcccaggcaccgccagccgctcggcgcccggccgtgggcccgacatggcgaagaagcgacacagcttgtaggcggagagaagcagcgtcaggaccatgggcgcggggccgcgggggacatccccggcctggaggcggggccacgcggagagacccgggttttgggaaaagagggacccgagaggggtcggggaaagaagatggagggggaggaatggagagaagggtaccaggcaagggtgccggtcagaagtttgggggaggagtgtcggcaggatcgggggagcggttggcaaaggtgatgcaggcccagatgcagggagtgggcgaaaggagagagcgagcaggcgagggatggctccggacgccgtagggtagaggaggcggcggctggaacaaagcgtggcctgggcacgggctcggctgagctgggagatgctcggcagcagccacgccccggaggagcagcggtccccgggccgacgccccgcctctgggtcccgcggggctcctccagcctcctgcagccacgccccggaggagcagcggtccccgggccgacgccccgcctctgggtcccgcggggctcctccagcctcctgcgcagccccacccccaagccgtccccagccacgcccacgcccctggccagccttccctagcccctcagtcagtcgcagccacctccccctgcgctggacttggaggaagggggtggagaatgagaggacgctctccgttctccgccccgcctccccgccccacgtgacatcggtacgtgggagcaacaccgctggatgccccctccctactaaatggttaaaacaatcatcataactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataccccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaacgcagcctgcaagtagtgaccacagaaagccaggccagaagtccttagctgcatcatggatgttcactttcccttctgggagagaccctagacttctcaagggaagagtgggcagggccaggctgggcctcacgcatcctctgctttcctctcttccagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccggtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtcttggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctatctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaagagaatactgtacacataaacatctttatcatctttcttagaacccctcaactgcacctgtggaacctcctctggttccaggttccgaaccccaggaagtccatctggctcttgaggggccagagagagaaagggttagatgaggcaaagctctaaagcagacctgagggcaatctggtggtgacatctgttccccagtcctgctgacagcggctggctcccattcatcccgttgacaccctaccatccttctcatcctgtcccacttcaccagcccagtccccagttgtgggagaggactccactccctctcccctgaaggtagccaggttcagagcactaagggctccagaaggggcagccagtgcctgggagcactggagagatggttttctttggctgcctggaaggacccctgggaggattttcatgaagtataggatttcaggcacagactgccagtttgaggtttgagaagggatgctgggtccagcttcctttgcgaggccttggaggggcagggggtatacaatttgccccacccataccctcataagcccaacccggcctccagcctcccttcttccccaccgagacttctctgccttgcttgagctggactctaa

SEQ ID NO: 15739 - DNA, 9386 bp, Human
gactgtcctccaccggcggctccctccaggggggcttcccttgcccccgccgagctctgaaggtgcctctcctggaagatggcctccaggccctgacgccacccgaaactcctcagtgatcactcccttgcagtgccacgaccccacactgtccccagtaggcacatgggcgggacctctaatgcctgggcaggcagggggttcccggggcaggtcagctcagtgatgagaggggcccgtttccaccgccccccgcccccacccccaccccacacgcccgcctgacctgctgagcggccggggcctgcagcgaggccgcgaggattgcgggcggacgcctgggggaagcctgacacctccccacctccatgtcccccaccctaggggcgagaacggagccgcccagtccacggggaggcgcaggggcggggccggtcgccatgggaacccgactcccgccccgcccggccgcggcgcagacaaaggccgctcccctcccccggcggccgcggccgcggttcccacagctccggggctgcgctccggcctcctcctcctttagctgaagctccattaactctgcacaaaacctcggcccgcctcggccgggcccagtgaaaggcgctcccgggcgggggccctcggggaggctgcccgtgtcctcgccccaacccagcccgagcgaggagaggggccatccccgggcccgcgccaggcccccagccggatgccggcttccaatggggaaactgaggcacggggcttggtcatgcaaaaggggccggagcggctgggactgagacccgttccttcgccgcggtccgcatgggtccggtggccagcaccgtgctggctgttttaatttggttgccgatatataaaaatcagatttgacattaaaactcggattttagtgttttaaaaaaggagtgttttgggccactgggatcctgatttctcacttcgctggagggggtcgcccagccgcgaagcctcccaccacggctctaccagggcggaggtcggtggccggtgttccagggagcaatgctccgccgagccccggtcgctttcaagtgggaataaaagtagctgtgcggccccgagcgcggcagagacgccgagtggggcgctgcccccgtcaccgccaaggcagccccccgcgcctgcccgcccgcggggctgacttcaaggaccctgcacccaaaggcggctcctcggacctgggatagtcagggtgggcttcctagaagaggtggccgctaaggaggaggaaaggttctgggcagcaaaaaggatccgtttggggccgctgcttgtgggtaggaaggccccggggtgacgccgctgtccctggtcctgacagtccagcggtcgcgcctctctcagaggggaggtcagggcgagccggggcaggaggcctggaaggttcccggggcgcaccgcggaccaaggcctgcaggtcctgcgcaagaaagccaggccggccctgtcccaacgcctttcggcttattttcctatccagtgccgagtctttagaaggtgctattcatatttctgtcttgaaaaatacttcccatggtttacccctggcttcttcgcttttgacggttctccctcgttggggagggcgccgccggggtagggaagcccgggccgagcccagacgcgggcgcaagtctggagaagcgcgcggcccccaagaggtgagagccggagggaggtgtccgccctcggcgccccccccgggaaggggagggctggtttccgctctgccaccgcctccgaggcgcaggaagcagcgcatttgtctccgggaacccccccacgccccggccacccagcccgggaaatccgcccgggcctcccggccccgccccggagccccgccccgcccgccgccgccgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctggtaggggcggggcagaaggggtgctgggtgggggccgggccgggccggagagcgcgtcccctcctcgcccgcgcgaggttctcggcgtggggaggggcctcgccctgcctccgcccccgggcgccaagcggatctgaggaatgaatgggggggcgggggtggcggcgtaaagaaactttccaagcagacgccgttaccgggagggaggggggtcctccggcctctcccgattcggactgctccccaccaggcctgaggcctgggaggtcacagctggcgtgagggtgggtctcacgcgaccgagccccgagccaccctgatgtccgggcccctaaacgtctgagcacccacctgagattcactgagtcgggtcaggcagccccccggggtctagcggatgaccctcccccgcccgggctgggggctattgtctgaaaagggaagccccgctcccggaagccaagatctctccccctgggatggcctcagactccccctcagaccacaaaccccacttaggccctggggccagaggacctggcctggggcccaggaagacgacagagtctgggtgggggaggggggtcaactgggccaaggtctctgttagacccgggtagccagggctggaggggcttagggtgaggtagttaccgggagtcctaagtttcagcctccatgttgactgggaggctgatcatgggtacaggctttgagaggtgcagctgagtcctcaccatggccaatgccgcttagctgctgcccactggggggtcctggtggggcgcaaaggcagaggcagccagggcagagctctgccccaggcacttgcaggttggaagtgggacctctaggcccaccagatttggagctcaggagccggcatcaggggccgggggtcccagggcaggctgtcttctggtgtggtccctagccttccatcagaagctgtaggtgggtcattctagccatcatgccagcacagatctgtcttcctctttgagacctgaagggcaggaagagggtctgggacggtgtgggagtggccataggggactagggtgggtcatggctggactcgccgtctgggagttgctgagaggtgtccggttctctgagtgaggcctggtctccccccttgcacccctggcccattttcttagttccactgccaaggctgcgggccaggtgccaattccctgtcacctgaccgcacagatgcaattggccaaaagaacttgctgccccacgtgcagggccactcccctcaccacctcaggagcacctttccctggtcataggctgggagcatggctgccccaggcacctcgacctgcgcccatgagcatcccagacccagcaggagccgctcctgctccccttgtgtgggcatggggggtggcctcagcctccacttgctctgagacaggatcccaagagacagaagtgggagggagagaagaagcaagtatcagccagagggaacaggctgtgcaaaggcctttcctttagcagggctgagggcagtgggacatgggagggtgggatgagggtcacctgcaaagggagggtgggctcaggaagctggtgcagggtagagggtctggacctctgggaagtggggctgggcgaagggctgttctgtgggtccagctgacgccctcagctgtacatcaccttctgtcccggttttgttccaaataatgatgcaataaacacctctgaccaactttccctccgtattttgaacattcggaggcaccaggggtccaggggctttgaggtggctctagaatccccctctgtgagcctcctgggcccatggggtctatggggcagagggaggcccgtctgctgcaggtgaatgccagtgactgttttcctgctgtgtttttccacgctggatggggcacctctcccccagccttgctttgaatgggggcccctggttgagcgtgggaatcagtggggccaggggacagagaaggtccaggaccttgtggggtgaacacacgcatggtggtccagccccaggggctccttcccagcaagcgcggagtgggtaggcccgagggtgggaggccgagctggggcggcggggccggggcagaaaagccccacggccccatccccacggagaagcggcgagagggacgccgcccgggtccacgcgcgtgcggccgccctcggacccctcccggcgccgcctcactcgcccgccttccagttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtgagccgggggagggccgtggggggagggcgcgtgcgggggcggggccgcggcgcagccaataggcgggcgagccctggcgatgggggcggggacacagggggcgcggcctggcactgggggcgtggcccggggggagctgaacgacagccgggggttcgtcgcccggccctgacgccccccgccacctaggtcatcgggcttctggacgtcttcacgccggccacgtccatcgaggacttcagcgaagtgtgagcggcggggcgggcgaggcagcggggagcgcgttcgcggtggggcggtggggccctgtcctgaccccctgaccccgccccaggtacttggtgaccaccctgatgggcgccgacctgaacaacatcgtcaagtgccaggcgctgagcgacgagcacgttcaattcctggtttaccagctgctgcgcgggctgaaggtggggcgccctgggcttcgcgggtcctctcgcaggggggcgggcgggccgggcccggcgctcaccacaatccccctcccgcagtacatccactcggccgggatcatccaccgggtaggtgcgaccgcagggtgagggtcgggtccagcagggctccgtcccagcctcctgtgctcacgctccgcgtgacctgcaggacctgaagcccagcaacgtggctgtgaacgaggactgtgagctcagggtgaggcccgtgggcaggggtgggcagggcggcggcggagcccgtgcggagcttgagaacaccacgtggtcgccccagatcctggatttcgggctggcgcgccaggcggacgaggagatgaccggctatgtggccacgcgctggtaccgggcacctgagatcatgctcaactggatgcattacaaccaaacaggtgcagggggaaggccttggggggacgaaggccaagggcctcgtctggccctcgactgactctgcatgccaggtcttagggggcaggcaaggtccccaagaatgtgggacccacattcaaaagtagcccttcagaggccgctagagcatgatgggtgctggcctcctctggctgtgcagctatggacctccccctgcctaggggggttgggtatggcagaggagggggtctgcccatcttggggtctggatgtgactgtgggtctcctggaggagggacgtggggtgggcacactgatggaggtcccctcgccctcgcacagtggatatctggtccgtgggctgcatcatggctgagctgctccagggcaaggccctcttcccgggaagcgactgtatccttggcccaggttggggagcagggtcaaacagggcccctcctgtagggtagggaccagcgctggccccttctggcgggtcttgcctcctctgccccccatgctatgctactttgggctggccatcctcacctataggagagcgggctctgggcagcgccccaaagttttgggtctgggggcccaggaggggtctgtggctggcccgtgggtgtttcctgagtgacacagacattgaccagctgaagcgcatcatggaagtggtgggcacacccagccctgaggttctggcaaaaatctcctcagaacacgtgagttggtgcccgccagccagcagctccctctcctggctgagcccccaggctctctgggggagagggtggtgtggaaatgcggggaccatatggggaacatgggatgtggtgggatagagcctagggcaggtgcccaatccctgcaggggaaacaggagaagggggaagacattcctgacaccagggacagtgagtgcaaagccatgaccccagcaagcagtgcctggccagggcagtgggggtgggctgggggaccccagcaagcagtgcctggccagggcagtgggggtgggctgagggcccagcaagcagtgcctggccagggcagtgggggtgggctgggtggagggagtgtacttggacccagctcctgcaggcattaggggccaactgaggagctagaaccaccagatcctatatggagggggtcactggtctgcctgtgcccttgtcctggcctgttggagtgaatgagtctgggggcttgccaagagaagccccagtttggggccagggaggcagagagtgagcagcctccccaggtgttcttgtgtgcccccaggcccggacatatatccagtccctgccccccatgccccagaaggacctgagcagcatcttccgtggagccaaccccctgggtgaggactgccctgggctagactgggctccatatctggccctggatgtacagctgacccccctccccaccactggcttccctgcagccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaagggtgagcatggcagtggctgggggtgggtccaggggcctgcgggctccatttccccagaggcaggaaatgccccagttcctctccagactggtcaggtgtggaagggcgttcaggtgtccagcacaggctgggagcggggcggaggagtgacacagggcaggttctggctcccagactctgtgctgaggctgctgtcacagggtggtgggcctgggctgggtggcaggtgccagacaagcaggtgaggggccgggctgtgggaggcacaagctcaccctttcccttcacctcctagagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggaggacgcgctggggccgggaccccgggagactcaaagggagaggtctcagtggttagagctgctcagcctggaggtagggggctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggctccagtgggccaaagggcaaccacatgagcatgggcaggggctttctccttggatgtgggacccacagcagcttcctgaggctgggggtgggtgggtgggtggtttggccttgaggacgctagggcaggcagcacacctggatgtggacttggactcggacacttctgccctgcaccctggcccgctctctacctctgcccaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctcacttggcttgtatccaaaggctactccaggcccgggtgcccccaccatccctgctgctgggcgtggggggagtgtctgggtcatcctgcatcactcacctccagctggccagatccctcaggcccccagtcagaccagcggccatcttctggcaccctccctgctccctggagggtctgagagcccagggggaccaggggaagacatggctgatgggcagactttgagggcacagggtgtgacagccacccagatggtgaccccagctgccctgtggggatgtactgggcaggcttggctttgggccaagatccagacaccacccccgcctacccctcagtgttcagggaagctggctggggagaagttgggtgtctcaaggagcaagggtctgcccatccctgggtgggggctgggcagggtagggaaaatagctttcctttccctcctggtgaaggaaaaagaggccactttaacccagggaatgtgcacgctggtcccgttcccactacgcgctgcagcttatgtgtgggggagggtccaggccatttggggtcaggcagtgtctctaaggaccagggacagtctgtgcccttgcttgggtcttgggtaggggtggaaaccgtctgggagttgggggcctcctggggcctggtcagtgtagtggtcaatcccgggggaagtccagtgttggcggttgggggtgggaggagaatggtgacacagccccacctcagaagcctggtccgtgcagggcctgctggacccctgagccccaccacggggagtaagggggaca

SEQ ID NO: 15740 - DNA, 29433 bp, Human
ttctcactgaggcctgccctggcccctgcaaacagcagcccctcatttctctcccctgacttcttttccctcatagaggaaatcatgtgtgtcactggatgcattagtctgttctcacgctgctataaggacatacccaagactgggtaattttagagtcaagtccttataaaggaaagagctttaattgactcacagttccacagggctgaggaggcctcaggaaacttacaatcatggtggaaggggaagcaaacatgtccttcttcacaaggtggcaggaaggagaagtcttgagcaaaagcggggaaagccccttataaaagaccatcagatctcataagaactcactcattgtcaggagaacagcagcgtgggggtaaccacccccatgattcaattacctcccaccgggccccttccacgacatgtaggaattatgggaattacaattcaagatgagatttgagtggggacacagccaaaccatatcactgtataacacactaatttgtttatcctgtgcactcctgtgcccccaatgaatgtaaacagcctataggaaggacgtcacttctttgtccaccccataaatgtttgttgaatgttgaatgatgatgggacatcagcaggcagagggatgaagggcattttaggagcaagaatttgttggaagattgtatgaaagaacagggcctgttctagaaactagtgttgccaacagaaacttgggagcatttctcaagtgatgacttatgatctgggaagctgaaggatttgctctgcaacctctggttcagggcagcttgtttgtatttctaagtggagaacaacttttgaaagaaaaaaatgttgaaatccgattaacatttttttccaaacaaaaagaaacacaggaggattcgatccagttggacccactcccactaatcccgtttatcgctttaaaagatagtgaagtttgggaggtttctcaatccattaaaatgagttcttgacttcacagattatagtttttgaaaattatttctcatccttgcttgattgaaatgaagacaacagaacattggctgtggtggctggcacaaaattaactaaccctaaaatactagtatagcttaaactttcgtttattgctaaaaatttatcactgctgtttcctgtgggggtgaggttgagcaaagtgttttgagctgcatttatgcgtacttgacacttacgcattttgatcgaggtgatttagtgggcattttcactgggacagggatgcttgtatgtgtaatcttactaaaagctaataaaaacttactaaaagctaataaaagcttactaaaagcttcttgcttgattgaaacgaagacaacagaacatcccatggtctggaacctgatgactttgctcaagttttaatgtgggttcatggtttaaggagctggtttttcagaaactttagtttgagcctttttacaatgtgcacaaagaacccgttgctgtagttgtcagggtgccagtgtctctgggcgacacacattactgtggtttttctctgcttggtgagcagagataaagggggcagcaggaccgggcccaccagccatccgggctgcccacacaaaccacagggccgaatccggagccgcccaagggccacacagctaagccgagtgcgtgaatgcttatgtgaccgtgtgaaggaggttcccaccgtgtggctgtgggggatggaaaaaggctacttggaaagatgtagaagaccttcgagtaaacagttacgtttcagaaacagagcctgctcagaatgtgtacttggtgggattctattcttagggacgcttctttcttctgagagacccgagctctgtggcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggaggtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcaggtccgtttttctaggaaagttatttctttttcacttttagattcaagtgctcattttcttcttcaaatttagagcacttcagtatgaacaatatttcttttgttaaaaaatatttcttggaaacaacttattgaagtttcctcagagtggccaaagccgatgataattttattccagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatgggggtgagtagctccacactaagcccttggagggccacgagcatctggtccctctggtgacggactgcagcgccctggagccccaggtgggacagagagagcaactctcagactaaccctgctgctgcagaactcttggatgccgacgagcttgttttgcttgtgttttcacaattatttttattaatttatgggtgtctgttgtgccagccttgagctgctccaggttgtggcttagtcccaccagggtagggacagtcccagggccatgaatgggccccaggagtctccatgaccctcggctctgggggcccagggtcctctgaggggtcacctgcaaaggtgggaggaggcgtctcaggccttcaggtcggccctcacagagagaacctcagggacctcctcctcctagggagggcctcaggggccggctgggagggagctggggaacaaaggaacaggtctggggtggacgggcagcgccagatgtccgagggatttccctggggtcctggccattccctgcacagtcgtgggcacagagatgattggaggagccacttgggcctgagtgtgtgcagctgctcagagccatgctgcaggacaggcctctatgcagggacccccggttccgtgtagcttgggctgagaatgagatccaggctgtgatttctcccctccctgtgccctggcctccgccggcagcccctgcagcacccacagtggtcctgcccacctcccgtggcctgagcatgccccaccaagacaggcgtctgcctcggagctggggacagaggcggctcccgggtggtggtggccatctccgggctctgccctcctccgcctggtgccctggacttggtcgcagcccctcccccgcccaggccagatcccctctgccccagacctcgcttcctctgccaggaccctgggtcccagtgacctttgatactgactcccctcagactcaccccgggggtgctgtgcgtgagagagagccccctccccaccgcacccctgcagtgctgtgcgtgagagagagcaccctccctgcctcctgctagggtcttccctgctcaggagcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggggtccatgctccgacatggctgggggaggctggtccatgtcctgggctgcggcggggctgcgtctgtcctacaggaggagtccaggatgggcgggtcccaggtgcgggtgtggttgatgctgggggacgtgggtgagtcaccaatacacagacagtgaagcagaagttgaagggtcagggtccagcctggggacggggcgcgttgtaacctgggattctgtcgctgtcttgcagagctgcctcctggtgacctcggggttttcgctgtacctggggaacgtgttcccggctgagatggattacttgcgctgtgctgcaggctctgtaagcagcttcctccacgcctctgccagtgcccaagctcgccggcacgtgctctggtttctttgttctgagatgtgcaggtttctgtcacctgtacctcattcaaacctcttcatatgggccgggcacagtggctcatggctgtcatgccagcactttgaggggtggaggtgggtggatcacctgaggtcaggtgtttgagaccagtctgaccaacatggacaaaccccatctctactaaaaatacaaaaattagctgggcgcggtggtgggtgcctgtactcccagctactcaggaggctgaggcaggagaatcgcttgaacctgggaggcggaggttgcagtgagcccagatcgtgccactgcactccagcctgggcaacgagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgttgtgtttttagaaacttacacagtgccaaggccggtggaggcacccactgatcctcagagcaagggaggacagacaaccgctgtcccctggtcctctgtgaaccccggccactgcctccccagcgtcccggcagctagagcaccatgctggctgacccctgggctctggcccgcaagccatggaccccatgcccctctggcccgcaagccgcgcaccccatgcccctctggcccgcaagccgcggaccccatgcccctctggcccgcaagccgcggaccccacgcccctcctgcttcagctggtcccgagctctcccctcctctcgcttccacatgcctgctgggtctctggcccctgccctttctctagggacactgttggtgactgtccccagcagcgcccccgaaatgtcttaaaaacaaagtggatgccccgccccgtgctgtcctgggtctctgctcccttagaacaaagccctttggggcaggtgacccgtcccactctgctgccctctctggaagcttctccgtggcctttatcctcaccatgggagccgcccttgtcccagtggagctgtgagctgtgccccttcagcctcagcggctgccggatatgggcaagtgcccacccccgcccagccttggccccactcggccctgcccccggcctttcttctctaccctgggccctcgtggcacctgagtgggtgctgagctgagcctggctgtcctggccctagctctgcccctcgctcaggccccgacggggcttcttctgcctcctcacccagcactgctgtgctcagcccctcagggcctgcacccccgactcagggcccggggtcccatggctgcaggagcaaggccctgcacggcaagggccacaggcctgggctggcccgactccatccacctccctgtccctgacgtcccaacctccctccctggccctggactcctagccttggtgtggccctgtggggacaagaaggctgaggacaagaaggctgtgggactcctttctgcctccctcacatgcagagtcttgctacttcctttgctccttccttcctctttctttctttctttttttctttctttctttctttgacggagtcttgctctgtcacacaggctggagtgcaatggcgccgtctctgctcactgcaacctccacctcctgggttcaagcaattctcctgcctcagcctcctgagtagctgggactacaggcacccgccaccacgcccagctaattttttttgtatttttagtagagatggggtttcactatgttggccaggctggtctcaaactcctgactctgatccacccgcctcagcctcccaaagtactgggattacaggtgtgagccactgcaccagacctcctctttctttctttctttctttctttctttctttctttctttctttctttttttgagacaaggtctcactctatcaccgagtattcacagctcactgcagcctcgaactcctgggctcaagagatcctcccagctcagcctccggagtagttgggactagaggtgtgagccactgcacccggctgatactttttccttttttgggtaattttcagcaaagaccaggtcttgtgcctgcgtgagttacattctaggcttcaaagcttatccagctagaagagccttcattaacaaatatctttttagcacatcagaaaaataaaaacttctttcagaataaattattttgaagtacctgggggttgggcgcagcggctcatgcctgtaatcgcagggctttgggaagctgaggtgaacagatcatttgagcccaaagttaagatcagcttgggcaacagagtgagaccccatctcaagaaaaaattaaaactgagaagtacctgggggccttctagtcaagccaacccactgtgttgcatggactggcaacactgttttgtgaatatgattcagatccttctggaagcgcaaatgttagagtatttcagagtctcagttgctcaggtgagcggcaggctcatgggattccggtttcattccagtgcatcccctcggcaattgtgagcttcaccgtctccaggaggaacgccaatgtggtgagtctagcttgcaggcagcctctgccagggagaaagccggaggggccgacagacagtgtgcccatgtgtgcttgtgtgtgtgcccacgcacagacgttgtggcaccgagaggggcccccgaggttgccccccagacagtaaagctcctgcccagcccagcctttgccgcacagaggggagagcgggctgagcacgcaggactccccaccattatgtcctaatcaggataatttttagtgaatggcctgaagtgtggtttatctgttaccttttttcttttattattcaaagaaggaaaacccctcctgccttgtttttcagattcccaactttcagatattgtttgtttccacgtttgctgtgaccactacgtgtttaatttggtttggatgcaaactagtcctgaacccatcagcaataaacgtgagttcacacgagcttcgcgcagacgcctgacacccacagccccactcccacgaatggtgtcagcaaatgtttgttgagctggaaataggtggtaaatgttattcacagctcgtgagtttgactaaagttgagagatttatgcatccaaagaaaataattgtctttattgaagtctcgtgattctgcgggacagatttattggtaaacaatgtcttttccaacagtccttaaaaattaacagtgacataatactatgtttcatccaatctgtgtaagacagttgttcaatgcacctctaaacaaaaatgtgaaattgtagggggcagaggttgtgggagccgagatggcgccactgcactccagcctggaagacagagcaagactccgtctcaaaaaaaaaaaaaaaaaaaaaaagacaaaaatcccaaaggaaaccaggacctcatccgagatactgcaaggagggcctcctgctttgtgtgacatgtggaatgcacttgatgattggggaaagctggaggaggcttgagtatgtcctggccactctcgttgggcaggaaaaatgagcagacacaggaggacccagtgggaacacccacactgcctttttgttttgttttgttttgtttttgagaaggaatctcgctctgtcgcccaggctggagtgtagtggcgccatctcggctcactgcaacctctacctcccgggttcaagcaattctcctgcctcagcctctggagtagctgggattacaggcgtgtgccaccacactcggctaatttttgtatttttagtacagacaaggtttcaccatgttggccaggctggccttgtactcctgacctcaggtgatccatccacctcggcctcccatagtgctgggattacaggtatgagccaccgcgcccggcctgtgacgcttctttattaagacggagagcagatggggtgtggtccctgggtcagtggcttgtatctgaactgctcagaggcaagttactcactgtagctgtcggctggccctgggaggagctgtctcttcaggatcaggaaggagccagaggtcaaagcaccagaaatacagaaaataaaagacaaggttaatgtcacacttttctgaattttagagttctccttatgcttttgtctttttgatctgtcatttttttttttttttgagacagtctcgctctgtcgcccagactggagtgcagtggctccatctcggctcacggcaacctccgcctctcgggttcaagcaattctcctgtctcagcctcccgagtagctgggattacaggcgtgcgccaccgtacccagctgatttttgtatttttagtagacaaggggtttcaccatgttggtcaggctggtctggaactcctgacctcaggtgatccaaccgcctcggtcccccaaagtgctgggatcacaggcgtgagccgcctccctctgcctgatctgtcagtttctaagaaaagtgtttcaagtccttccccacctctactgatatatctacatcttcctgtggctctgttatgacatcatatatttcgaggctctgtttttagttgaatgtggttctgcactctttcttttttaaatgtattttaaaaattgtcaggccgggcgcggtggctcacgcctgtaatctcagcactttgggaggccgaggtgggcggaacacctgaggtcaggagttcgagaccagcctgaccaacatggagaaacccctctctactaaaaatacaaaattagccgggcgtgctggtaggtgcctgtaaccccagcttactcgggaggctgaggcaggacaatcatttgaacccaggaggcagaggttgcggtgagccgagattgcgccatttgctctccagcctgggcaacaagagcgaacctccgtctcaaaaaaaaaaaaaaaaaattgtcagacagctacactgactttttaaaatgtatgcttctatgaatattaacacacatataaattcatgtcactgccaatacggtcagggcctgcagtcgtttcattaccctccaaaaaaccttatgttctcagtgcttgacaatcatgcatgaagctactctaaacattccgtgaaggcttttgtgggaacaaggagcgttcagaatggggtcggtagaccagagcccaaggccaaatccagccctggcctgtgtttgtacagcctttgcactaagaatggttttaaaaactaaaagaccccaaaggcccatgtgaggcaggagagtgtgcagcccacagtgcctcacagctggccctggatgggaaaagtggggaccgtggctgagagtcctgcgcagcctgcccgtgaggtggtccggtggacgctgaagcgcggtggcgtgagaaaggcgggcccggtgctgaagcgtgtgtgccccttggcagatcaacttcaacctcatcctgctgctcctgctggagctgctcatggcggccacggtgatcatcgctgcacggtccagcgaggaggactgcaagaaaaagaaggtgggtgcagcttctgaccccgcagggcagggggtgcagaggcatcaccccagggtgagcgaggtgggtctcagcgtcaccctcggagggccgatctgggctgctccagggcattcccatgagacccctctctcctgggtctcagaaaccccggccaggaggggctctggagctgggtgaggggttggcggccgctggctacagggaggtgaagacagatgctgtaccctcccctccccctaagcctgactcagtccagtgctcgtccccaggggatcaccaggagacaccacatctgctaattttcatatgcaaggacaatgtgtgtgaacatttcctcaagcccaaagatccacgggcgcctccaaggtggtctcgcatctacacggcaggctgacctgacccactgcccacggcggccggatgccagcggcagtgctgagtccctgtgcccgtgcacccggggtgacagttctgtttcttcgtagggctccatgtctgacagcgccaacattctggacgaagtgccatttcctgctcgggtcctgaaatcttactcagtaagaaaacttcccttctttctcttttctctcatactctgtcgggggtgactgaggctggattaaacgtcacgtttcgattccgagttggcgaagagttggctgtctacaccgcatggcggcgtgcgcctcatctgtggagactctagtctgttattggtatcattggtaataaccttccttatcgcgaaaggtgctgctggtgtcctgtaatttttagggggagtttgttactgccgtaggtgagttgacactgttgtccccgaggaattttttttttttttttgagacggagtctcactccatcagccaggctggggtgcagtggtgctatctcagctcaccgccacctctgcctcccaggttcaagcaattctcctgcctcagcctcctgaggagctgggactacaggcacatgccaccacgcccggctaattattttatttttagtagaggcagggtttcggcatgttggccaggctggtctcgaactcctgacctcaagtgatccacccacccaggccttccaaagtgctgggattacaggtgtgagccaccgcacctggcctctttctccttcttactttcaacttttcttgccttgtactttggtataattgttataagcagcacgtaactgtattttgttctttatcttgtcattctctctccctagctttttgaatgtagcccatttcctctgagagttattactgataaatttctacttatttttaccatcttttgagttttccattttccctgattttgcctttttccctccttccctgccttcttttgaattggcagaggctccgtccttccttttccctctaattttggatgggaaatttttcagtattcttttgggggttgcccttcatattctaatacgctccttgataaacagaccatgcggggtctgtcccccttccctccgccttggccttgttgtctagcttgtgacatttagtgacattttgcctttttactccaacaatgggacagcctcctgtgtgcttgactgtgtctgtgtgtgtttcccagtgccttcacttccccttatttagcatttcagtcctctcttaggttccatttccgttctgcttcttttttttttttcctttttttttgagatggagtcctgctctgttgcccaggctagagtgcagtggtgtgatcttggttcactgcaacctctgcctcctgagttgaagcgattctcccgcctcagcctcccgagtagctgggattacaggtgcccgccaccacgcccagctaatttttgttatttttagtagagacggggtttaccatgttggccaggctgtactcaaactcctgacctcacgatccgtctgcctcggcctcccaaagtgctaggattacaggcatgagccgccgtgcctggctgggaattcagctttatttgtgcatctggagttttgtgccttctggacgcaaggcctggctgcccaggtcccttccggcccccaagcccttgctggcccactccttatgcctggctttcctgctggccacagctctgtgtttgcgactcacagagatccttcacgggagcaggttttcgggcgtgtgtttcttccccagccctccctgagtctggcggtgctggttgcggcccctccctgagtctggcggtgctggttgcggcccctccctgagtctggcggtgctggttgcggcccctccctgagtctggcggtgctggttgcggccctgatggtgccgggcagatgagtccacaaccagggcttaggccagcagggttcttggctttgtccaggaaagaattcaagggcgagctggaggtgacagacagcagctttgtttgcagtggcagtatagcagggctctccaaccggcaggtgcctcgagcagcagctcagagacagctctgcctcctatttatacccacttttaagtatatgctaattaaggggcagattatgcagaaatttctagaaaaggggtgctaacgtccaggtggttggatcattgccacggaaaggggtggtgacgtccagtgttgccgtggcaatggcaaacccacatggcacgggtgggtgtgtcctatgggaagctacttctgccccaggcctgttttcccgagtcccttcgatggggtccagggtctgagcaccgccgcctgccacactgtgagacagggaagggagtctgagggtcttggttttctgccctcaccactgtcaggtcaataccctcagtttctgtggacaaaagcagcagtgggggaaacacctctttggctattttactccaggagggacgtgaaaagccgcagctgagggcagagggggtctgggccaggtgaggctgggggtccatccaggtgggctcctccacggttagatctggggccagcccactggaccctgctcctgggggtccatgtctgcacagtgcattctgggaatctgggggtgtctccacttccttatgagccgatgctgtcctgtcccctccaggtcgtcgaggtaatcgcaggcatctctgccgtcctcggggggatcattgccctgaacgtggatgactcagtttcaggcccacacctctcagtgacgttcttttggatcctagtggccgtgagtaacccctctggcccgcccgccgccgctctgggccacactgctcagatcctgcgtggctgggccccgagctcagtcttggtgcattcagacagagagtcaccacagagggtcctcgctggcccccaacttcagaagaactggggagttaaggattaaatgagtcaaagtattaactgcttttatattagtttgtgtgattattttatattatttttcctgaaaaaaataccaattatttttattattctaatctttttaacatatgaatgtcaggctgtagatgtttattattctatataattttctaatatataatgcatttatattacactatgtgtttcatacaatgcagcatatttctgttattactttacattaaatgttactgcagcagatgtgtcacacagcacctgacacatgccacatgctcaatacatgggcattgttttatttattttatttatttatttttttgagatggagtctcactctgccacccaggctggagtgcagtggctcaatatcacctcactacaacctctgcccctccccgggttcaagtaatttgcccacctcagcctcccaagtagctgggattacaggcgtggaccaccatgcccagctaatttttttgtatttttagtagagaccgggttttgccatgttggccaggctggtcttgaactcctgacctcaagtgatctgcctgcctcggcccccaaaagtgctgggattacaggtgtgttccctcagaacagtgagtctagagcaacccctccacaccccagatcccctcacagcctgtagcccacccagagccaccacccacctgcctccggacgcagaccccacgaggttctcagcaccttgccgcgtagtggcctgcacaccggtgttgacggccagcccctggtttgtctcatgctgtgtggacttttagattttgcccctgctctcttatgtacatgagcaggaatggtgagcacccagcatcagctacaggctcctcctgggcagcagtggggctcttcctgaagctgccgaggcccatgcctgcctgggagcagtatggccaggtggactgccgagaaggggcccacgcctgcccgggaatggtatggccgggtggactgcggagaaggggcccacgcctgcccgggaacggtgtggccgggtggactgccgagaaggggcccacgcctgccaggtggacacatcccattggcagcagctgtggttcagctccctgtgggggcgagtaggcacagagcaatgcccccagggcaccagtgcccgacctagtgggctgctgaggcgctcagagagggaaagagacccaggcaggaccgagctgggatagagccacacccccggaaggggtaggaccaggcccagctactgagacagagaactcacatgggtgcccacccaagcgggtctgtgacagagagaatgacgcctgcaggtgtgtacaactgaccctggggtctgaaacgcagggattacatcccgaagctgagggaggacagagaccacatacctccaaaaagttgagaatgaaaggcacttgccctacccccttccctgtccctgcagtcagccctcatcacagaggcccctcccatcccgcagacccctcctgcctcgggggtggctctgctctctccatcttcccggagagcaccccctgcccatcaggtgctgccccctgggcgcccctaaatccacccacactcccaaccctctcttcagggcaggagaccccaggaggagaggagagcgctgaggcatgcgtggtgagggacccagctccacctgcctgagtctggcctgggtgcggcagaggggcccaggccctgcaccatgggctggaggcaggtgctcggggctggagttgggggctgggctgcaggcctggacccttccagggcagggcccttgattgagctgccccagcccctatggctgagcttcctggccctctagggcaggggccggagtggccatgctgggtgaacggggaaactcccgccctcccatggctcactggggccctgaataggccaccctgaagccaccatcccttcctgtgccctcactgctgcatacagctagaaggccctttcagaagcaccaagcccaggagagacccctgtattgacacctcagcctccctggccagggccacacccacctcagcagctggcttggggcctttgcactggcagcccctcagctccccagtcttctccctgctgcccaggctcccctgctcggagcccatctctgtcctgcccaccctctcaccacagcccctggctgatgcagccccctccccagcaggccgggctggggtgctggcacctggacaccttcggggggatgaagaggatgaagagcatgcatcctccctctgcctacattgtgcggaactaaggcaggctcctcacaataagtgggaaaagggcatttcttggttataaaaaggaagaggtgcccatccaacagaggaacctacagatccccctaacccagtgagtcaagtcagcgtcatcaggaaggggcagtccacaccctggggcactgcagagtctcctccgaggctccccaaggctcatcgtgaagaaatcctgtcccacacggaggcccgactgcagctgacgggctgcaccccccagaagcgaccaggtaacggaggtgacagaggctgagggactccccaattaacagggacccacaaggagactacgagctcaatggcagaccgaatccggatcaggagcaaacaaacaaacagctctagaaataacatgaccagggccaggtgcggtggctcatgcctgtaatcccagcactttgggaggccgaggcgggcggatcacctgaggtcaggagttcgagaccagcctggccaacaaggcgaaaccccgtctctactaaaaatacaaacattagcctggtgtggtggtgggtgcctataatcccagctactcaggaggcttgaacctgggaggtggaggttgcagtgagtcaagatcgcgccaccgtactccagcctgggtgacagagcaagactccatcttaaaaaaaaaaaggagaagaagaaagaaaaattattaaaaaattaaaaagaaagaacatgatgaggacaactggaagaatctgggcatggaccacatcggccccacgtggagtctctcgagcgtggtcctgctttgggtgtgtgcaagagtgtgccctgggctcagccagcactctcaggtgttcaggcatcaggctatctgggagagctggagagagcacagatatgaatgtcaaggactctggtgattttggggcctcagatgccccctccactgctcttgcagcttttctacaggcttaaaattttaaaccaatggttgaggaacagagagcacacaaaacctctgagaggctacccctgcttccctgcggacccgtccctgccccagctgcgcctttgggcactgcaccatcccccctgccccccacagcaagccagccaggcagcctgcatggaggggtcactggtgggagggcacatgtttggaattcgacttcttcgactatttcctctaaaatctttcctttttcttttctcttagtgctttccaagtgccattgccagtcatgtggcagcagagtgtcccagcaagtgtctggtgggtgaacccctcagccctgggtgccagggacccaccgagcggggccagggcctggcctagccctcccttggtgccatgtgaccaggctccagcccaagagagcgcagtgactgggctgcagggcctgcacaatgaggaaggtggggttgtgggaggtggaggctggcccgctcagcagggactgttctcagggacaggcagacctgaacaaggtggtgtagacactggaagcgctctctgtgcctaacccttggaaggagaccagtgtctgagcatcatctgcacctcctaaggctggtcgattgtttttttttcttttttgagatgcagtctcgctcttgtcccccaggctggagtgcaatggcacgatcttggctcactgcaacctccgcctcccgggttcaagtgattctcttgcctcagcctcctgagtagctgggattataggcgcctgccaccatgcccggctaatttttgtatttttagtagagacggggtttcaccatgttggccaggctggtctcgaactcctgacctcaggtgatccactcacctcaacctcccaaagtgctgggattaccggtgtgagccaccacgcccggccgaaactgccacaaactgaccgcaaacaattgaactggtcgatcgttaatgactgctgccaaaatgtggaccctgagtgctttgcaaggtgactgcccatgcttggcatgagtgaaggctgtctctgagacttgatgggtcaaacaggaagatttggggtgggttaaaaggacagacttcagagcagtgaaggaggtgacccatgcggaagggctattttttcaagagtggagaattgcaggtaaatgttttttgtttcttggttttgtttgtttgagacagagtcttgctctgtcacccaggctggagtgcagtggtacgatctcagctcattgtaacctctgcctcccgggttcaagcgattctcctgcctcagcctcccaagtagctgggactacaggcatgcgccaccacacccgcttagtttttgtatctttagtagagatgggggtttcaccatgttggccaggctggtctcgaactcgtgacctcaggtgatccgccctcctcggcctcccaaagtgcttggattacagatgtgagccaccttgcctagatggtaagtatttcaaaacttgtggcactgtgctgtgaatgaaaaggcaggctgctcatgcctgtaatctcagcactttgggaggccaaggtgggtggatcacaaggtcaggagttgaagaccagcctgacaatatggtgaaaccctgtctctactaaaaatacaaaacaattagccaggtgtggtggcgcatgtctgtaatcccagctactcaagaggccgaggcgggagaattgcttgaacccaggaggcagaggttgcagtgatcagagattgtgccaccgcactcctgcctgggctacacagctaggctgcctctcaaaaaagaaagaaaggcaggccgggcgcggtggctcatgcctgtaatcacagcactttgggaggccgaggtgggtggatcacctgaggtcaggagttcaagaccagcctgaccaacgtggcaaaacacggtctctactaaaaatacaaaaattagctgggtgtggtggcgggcgcctgtaatcccagctactcgggaggctgaggcaggagaatcacttgaacccgggaggcggaggttacagtgagccaagatcatgccactgcattccagcctggcgacacagcgagacttgtctcaaaaaaaaaaaaaaaaaaaaagaaaaagaaaaaagaaaaggcagaggtttcagcaggagtcatgcagggaaccagcttgggactatgcccatgagtgcccggccatgcccgcccccccagccctggccacgcccgctgtcctgggctcccaggctccggccgtggtcctgcaacccgcgctttttttccaggtggaggtcctgattgccataagcagcctcacgtctccgctgctgttcacagcctctggatatctgtcattcagcatcatgagaatcgtggagatgtttaaggattacccgccagccataaaagtgagttgtattttatttcagagccccccagacatgtggtgctctgcgtgttggcctggcccttgctggctttgcctgggactctgggggcgctggctccagggacagctccaggaggcacctcctccgctgttcctgggcagcggtgaccgtgctccccaatgccagcctggccccagggcctcggggcctcaattccgccctgtatctggggccaccacctgcttcacagggacctgggacccactctgtccctgagcccattttagaatctgtcctgggtttatgagacatgcttttcggatttgcatcagaactgcattgagtttaacaggtgaatttaaggagaattcaaagtcctgttactttgagctgacccagtaggagcttatctccaacacgacttctgaggctcaggcacgtgtagctagatgtatttcttagatacctagtgtttttttgtttttttgtttttttttttccagtataagtggttttgcacccaaatcattagaagacctgtattaagctgtttgctccaggtcaacatgcgtgtgctgatggggaatggagtcactgcctgatggggggatggagtcactgtctgatgggggatggagtcactgtctgatgggggatggagtcactgtctgatgggggatggagtcactgtctgatggatggatggagtcactgtctgatggaggatggggtcactgcctgatgggggatggagtcactgtctgatgggggatggagtcactgtctgatgggggatggagtcactgatgggggatggagtcactgcctgacgggggatggagtcactgcctgacggggggatggagtcactgcctgacggggggatggagtcactgtctgacgggggatggagtcactgtctaatggggtaatggagtcactgtctgatgggggatggagtcactgtctgatgggggcatggagtcactgtctgaagggggatagcgtcctcggcctcccacaggtgctgggattacaggagtgagctacaacacccggcccagggttttttcttcacttctcttgtgtttgcttcacccactcctactccaattattttgtttcctgtgacatttaatatatctcctacttcatgttgtcttacaatatgcatataattgttcacgattacaagagacaatattaccacccaggggccatctcctgagtgagcctgaggcttcccttttatcttcagcatgcattctgctagcaggggacggccacacgccatcgaagtcggcccctttctgtgtggggttatcctctgggttcgataccccattaagtttaatggcctctggttgtattgcattttagggcttggtgctttttttcttttttaaaatggtattttttgaatatataaaatatttatgtggttcaaaagccaaactataaaagacgagctcagaaaagctgtggtctcatgcctgactgacctgctcctcttatgggcaaccagatgataatttttttttctttcttacaaaatagcttgtatactagaatcactattctgtaccttgccatttttttttttttaagatagagtctcactctgtctcccaggctggagtgcagtggcacagtcttggctcactgcaacctctgcctcctgggttcaagtgattctcctgcctcagcctccggagcatctgggattacaggcatatgccaccacacccggctaatttttgtacttttagcagagacagggtttcactatgttggccaggctggtcttgaactcctgaccttaagtgatctgcctgtctcggcctcccaaagtgctaggattacagacgtgagccaccgtgcccagccatatacctcgctttttagttatgtatttatttattttatttttcagagacagggtctcactctgttgcccgggctggtcatgagctcctgggctgaagcgatccgcccaccttggcctcccgaagtgctgggattacagacgtgagccactgtgcccagccatgtacctcgctttttaattatgtatttacttattttatttttcagagacagggtctcactctgtcgcctgagctggtcatgagctcctgggctcaagcgatccgcccaccttggcctcccaaagtgctgggatgaggaggcttctgccaccgtgcccagccccttgcttgtttttttaaacttaataatttatcctggcgttttctcgatacccaaggggatcagagctcttctgaattccttcatcgctcctgactgcccggtcaacccagccagtccctagtgatggaaactgagttatttccaaccgtctgctactataaataactcctccgtgaacaacctgcacgcatcttccttttgaatcctcagcgcatctttaggatatccagctaggagagagactgctgggtagagggtaggtgcagctgtcatgctgataaatctcggcgacctcctcaatgggggccgtccaccttccctcctgccaatggcgtgaaggtgctcacttctccacagccccccacagagggtgtcacgctggagttcggtgacacgggtgggagcacctccgtctcaatgtgggtgaggacgaggacctcttacaaagcatgaggacgtctgcattgctttttcagtggactctgctcatgtctcctgaccattttccgctaaccctggtgccgggggagaccagctccatctgtgatggaggatacaaatggtggtctcagcctggcggctatttcttgttctgcttgttgtgatttttgttatgtgaaagctatttttttaaatagttaagttgattaatattttctttaatggctctggattttttttttttgagactgaggaaagcataggctttgcaataaatggtgtctcaacaaccgaagagcaaagaccacatggggcccatgcctttaccatcctccagggtaaactccagctgggaacacaagtaccagactttctaataattacttaaaatccaggccgggcgtagtggcacatgcctgtaatcccagcagtttgggaggccgaagcaggcagatcacctgaggttaggagaccagcctggctaacatggtgaaaccccgtctctactaaaactacgaaaattagctgggcgtggtggcgggtacctgtaatcccagctactggcgaggttgaggcaggagaatcgcttgaacctgggatgtagaggttgcagcgagccgagatcgcgccactgcacgccagcctgggtgacagagggagactgtcgcaaaaaaaagttttatgttaacttgagaagagctgttctttctgtttcttctcttactttttgtagcagtgacattggatagatgtttggctcttttgtgtgttaacatttagttgctttgtttttcttgagccaacacgggaaagctatccatgggcacagagggttttgggtgctccgtggtcactctctggccccctgcatcctcggccgctccctccatcctcttccctgccgagctcaccgcgctgcctcctgccccttccttcctagcagctggtgctcaggggtgaagctgttgggggtctgtgcaccccatccccccaggacggctgccccctgtctcctccgctcaggatcctgctgacacggaacggtcagcgcttctgcctcccgcggacattctctctggctctgggactgagccttgcgcgtgttggagcaggaggggtggagcgacttgaccactagcagccagcactgtccacggggcctggcagtggctcggtcacttttattcctgtatgttgaacacaagctgatggaatttaaagcagaattgacctcattaattgagctagaatgattatcatcaggttgttgaaatagcaatgcgtttgggttactggggctccgactcgagccctggcacctgctctttgtgaaggccgtgggcacgagggagctttggtctcctgggctggagggcggctgggccactctgctcacacctccttccgcctgcagccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtgagtggcctgcagggggagggggcactggggaggtgagtggcccacgggggtgcccagccagggaggtgagaagcctgtggggtggggggaagctggggaggtgagtggcccacaggggtgcccagccggggaggtgagtggcctgcagggggagggggtgctggggaggtgagtagcccacaggggtgcccagccggggaggtgagtggcctgcggtgcaggtgctggggaggtgagtggcccatggggggcccagccagggaggtgagaagcctgtggggtgggggcactggggaggtgagtggcccacaggggtgctcagccagggaggtgagaggcctgtgggtttcaggggtgctggggaggtgagtggcccacaggagcacccgctggggaggtgagaggcctgcggtgggggctcctgtcctggtgagggcctccgagggccacacgacgtggccctcgaagattcattgtgccactttgtatttttaaaaacaccccagaaaaaccccgaagaagtaaaatgtctttcttttcttttttttttttttttttgagaaggagtctcagtctgtcacccagactggagtgcagtggcgcgatcacggctcaccacaacctccgcctcctgggttcaagcaattctcctgcctcagcctcccgagtagctgggactacaggcacccgccaccaagcccagctaatttttctatttttagtagagatggggtttcactatgttggttagactggtctcgaactcctgacctcgtgatccgcctgccttggcctcccaaagtgctggaattacaggcgtgagccaccgcgcccagccgtaaaatgtcttttaaaaatacaaacacaaagcctgggtaaacccagacccatccctgggaaatattctggacttaatgctttcagatttgctcttagagacacagaagagggctttgtgaggactcccacaggtcctgaagtttccttccctggtctctggtggggacgcggttctgcagggaaggcaatgcccacccagcctggcacatggggctccgtaaagctggggtgtcaacaacttctggctgtcactgcctgaacaatgttcccccgggccctgcctactgtcttgctgcccccacatctgaaaggcagaggctcagcgtcttccccccaccgagctacgggtcctggtggtgctcccctgggcaaacctgcccgctgaccctcaggtgcagtgaccactaggactgtcaccttgatgcccaaacacctgggcagccactcagcggggctctgagtcctgccccacctctaggccatcctgggcggaccggccgctgctcttgccctgcacaccctgccctcctgtgttcagcacaccaccggcctcagaacctcggtgcagagcctccagtgcccgctaagtcccggaggacgctctcttgcccttggctcgtttctcagctgaccccgtcgcccccaccctccaccctccctactgctgttcccttaacctgcctcctcagttgctttgctgccatttttcctggctgtggtcagtctccctgctaggacggcagtccctgggcctgaaatgagacccgcctgggtttctgttgtgaccagcaaggcccagagtcagacgcatgaggtgttctccccagatcccagaactgctggtcccaggggctcagggtgggcggctggggctcagggtgggcggctggggctcaggatggacggctggggctcaaggtgggtggcttgggctcagggtgggcggttggggctcagggtgggcggctggggctcagggtgggcggctggggctcagggtggatggctggggcttagggtggacggctggggcccaggggctcagggtgggtggctggggctcagggtggacaactggggctcagggtggacagctggggctcagggtggacaactggggctcagggtggacagctggggctggcgctgtcctcccttttgcctggaggcatctggttacctctgccttaagtgttttcttcctcagccgtcaggcacatgcccaaccttgggcggcctccccccgctccccgccccagagccagggcaaggggccgagtgaagggctgctccatcccaggctcggtagaaaccgtgtgtgcggggggggatgcaggcgtttctgggacactgaggaagtgaaggcttttatctctttccacagaggcccaggggttagtttccccacttccttcacattcgaagaaaacttctgaacgctggctgctcgctgcctgtggccgagtggcgtgtccaccttcccgccgcacaggtggccctggtgaagtaacacctttcctgtctcggttgcaggtggccaggagccccctgaaggagttcgacaaggagaaagcctggagagccgtcgtggtgcaaatggcccagtgacccccagacgcggaaaccgggtggcagcgcccagcctggccccaggcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtggctgtggctatttaatattgtgtctcagcagcgtcagctcactcaggtctaaaaacatcgggacacagggaggaggggcgggtggagggagggccagcttttcactcactgatttgtgtaacccctagaggccagtactggggtctggtgagagcccagtggcattccccggggaagagggagggagctggaagggaaccacccccgccaggggacgctcccactcccccccttcaagtcccccaccagccccttcagagtcggggcagaacctcccttttggggtgtcttgggaagttaaatgcaaaataaagttgatttaaaaccaaatgaagacatctaggctttggaaagttgccaggagtgagggtcctggtggggcaggtgtgtctttcctacccccactccgagatgccagatcagacacgagctgccctggcggggtgatccgcggggtggggggggaaacgacaggggccgtgtggacctgggtgggctcagaaccccccggggggcagcggcgtgggaccccacgagtggttctgcggataccaaggccctcccaagttccgccgcaggacggggggcgctgctacggtcaccccgtcgcccccatccgccaggacccgcagcgcgcagcccgggaggagcccagcgcccgcggcctcctcaccccgccgctccagcctcgcgtcggggaagggcccagggacagagggcggcatgagggccccggggagggcgagaaggcctggcgggcctggggggcccgagggggaggggcaggatgtgacccgcgggtctttgtgacctggtgggggatggagtgtgacctccacaggggggcgcggggccgcagcgcgtgacccggggctacactcgggccctcccccggcggacaccatggcgcgcaccgtcccgcgccgccgaccccgcagccgcgcctgctccgacagcagcccgggacccggaccccaacccgggcccagcccaagcgctgatgactgctgcccgtcggggcccgcgccccccgcacgccgcagctccccgcgcccccgcgccccccgccgcccgcgcagccccacgccccggggccgccgccgctgcacagcccgaggccacgggcccagcagccgccgcaccgggggtgcacaatgcgcgtggccgccccagcacgttgtcccaggcaaccccaggaagccgggcggcgcagcgcgagccactgacccggtccccggtgagcacgacccccgaccgcggaaccccaggcccgtccgcgcttccgatcccggacaggacccctcctccccatctgccttcggaaccccagacccgcctcccacacccggaaacccaggcctaccccctccccgccccgggcctccaaattctagaccccttaccctaggaatcccagacccgcctagctcggaaccacagaactcccccactaaacctgcccaactctacccactcgcccgccctcgaaagcccagagctgttctccccaccttcccccatcttctgggaactccacagctgtccactcccctctgccttcagaaccccatacctctcctcattaacc

SEQ ID NO: 15741 - DNA, 33753 bp, Human
caggcttagattgctgcaaaaaggctttgcaggctggacaccatgatttgtacctcaaatctggctgctatttcccacactcctaggtcccaaagaaatgtgggtgaggtcctgcggttgacacaccgtcactgtcatactactggaaaaacagcccaaactgtttgcctcaatgatattgggtcaattgtgtcatcttcgtgtgggaagaatgccctaattatcattactccctttggacaaaattagcaagtcatttataaatcatttcactttcctccctatttgcctcctcccgcttccttcaggttccatccctcaaagtcattgggaaaagccttgcaaactggatagcagttttgtgcatttccggttcaagctgccttactcactttttttttttaatttaaaaaaactttggattttttgtagagacaggatcttgctatgttgcccaggatgttcctgaactccaggcctcaagcaatcctcccacctcggtctcccaaagtgctaggattacaggcatgagccaccacacctggttcaccttactcacttctattccaggacggttcaactatgatgttttggctcctcttctcaagcagctttccacacctggttccatgatctcttctggcacagtagctggtatttggcaaacataggtttcatcctgggatctcagggattgaaatctgtcctaggtgtgcaccagaaagtggtggcaagagatgaagcttcggaggaggctgacctcggccaggattcttaagtctcaaagtttcagctttctcacccctcaacggacatgaaatctacctatttgtaactccagggaagtaaatgagataatgtttggaagatatctagtctaccagctgctcaggcggggggcgaaggttctgttccctgtcccttctctatcaaatggctttaaaatcagaagaaagtattacgggtaggaaatgggactgcgaaaaaaatggaggctgattctggcctaaaggatacttatctctatacaaagggcttctgattcaaagaggccccgggattcaaaaacacaagcagagctacaccacgtggggtttgggacgagctgaattccggataaagatgcctgtaaagaggagttgatgcgaatccagaaaagcacttgaaatgcccaggctttgcatggcacattccccaggattttttcgcaccgcatttagaggtttagacggagtgagctcgaatcaggccaaaagccttaggttactcctgggcggcagcggggcagaggtcagatcaacaggtgtggaaggctgcgaggtgagggaagaagcaggtgtcggtggaggccccagttcctccggcccagaggctccaacgctgctattggtgttccagcagcgggcggaggggtcctgcccggcatctgggcgcgctgggcccagagcccgggaggaggcagacggaggcggcgggtcagcggcgggccagccccggtgggcttccgctcccctccgccggcccggtccggcccgccgcggaggatgcctggaggttgacgtgaatggcctgtggctgggaagcccccaggcgccctgcctagcccgggggcggggccgcctagccgccggccccggtggcgtgagggctggggcgggggccggggacctcgcggggagggagcgggagggaaagcggcccccgcggcccttcaattggccgcaccgcccctcggcgcagaggcgggaggaggcggccctccattggtcgggcccggcggccaatcctcgaaggcccaggcggaggcgggggcggcctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaaggtacgcctggctcgggcgggcgcgggggcccccggggcacccttgggctggcctggcgctgggccgtgcttcgtttgctcttcgcgctgtggctcaccgttttcctggagaggggccgtcgaggcggcgcgagcgtctctgcctgtcccggtcgcgtccagtccccgggcttgcggggccggctcccgggcacccgcctggctttgttcccgcgccgtgggacaggactagtggctggcggtgggttcccgggcgcctggagtcccgcggcgccagcctttccggctgcgggggtctcgggggccgtttggtgactgcagaacgcgccctccgggaagggggcgctcctgcgtggccactcgcccttaggcggagcccgtctgcgcggccagggacccggcgagccgctgccgcagcccccgccatctgcccgggccccgggtgctggcggactccgcgcctccccacggggagagagaccgcctaatgtcccgccgaccccaggggccccgaggaacggaagccggtccgggacccatcacagtctccgatctcggtgcctgggaggcatttggaggcagattgctgctgctgcttctgctgttgcttttgcgggaaatggagacaaagcctgagcgcgccactgtgcgagtgatatctgcttaggcttgagactttttatgaaacactgagaagtttgaagtacattagactttcacgacataaaggagtatttttgtgggttgcttttgtttggggcttgtttgctgaggcggcttatagtttggagcgattgggatttggtgacgctcagctttgccactgagcccaagaatgcgttaggtttatctttaggacttttggcctgggaaagagatgagaggcgtccccctccccaaatcctctccttccttcctccctccctgcattccaagcccatgacatcaggggtttctggggggagagaccagccaatcggcgcggaactgtgcacagaacgctcattgtctcctttctgctgttctggccaaagcgccacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagaggtaatgaagcgcaccgttgtcaaaccccaagggagagttgtggctcttgtctcccgctgttagtctgcacatcatactgtctttgaagcaaggagttgattttagtctatgtatctaaagttgaaatgtttaggtcctttaccttttcaaacgtgttgcccgtattagacaacagtttgctaacaatttttttagagagcagaaaggtgaatggtttgtgtatgattgagtgcaaacctcaccaactgaaaagtttgtaacaagttactgtttccttccttccaggatttacaaaccgaactttaggaaacttcagaggaatgggcatgtccaaaatgttggatgtgatgtgatactttggcctggttgtgcacattcattgtaattccccccagtgattcttggctggcagcagttgagtctctactaccttttgcattgtaaatgaggtactgataacgttggcagcccttcaagtgacttacttttcttggatgttaataatatccatgctaatttcttttttgctgactaatgtagcagcttttgcccttttcctgcttaatactgagcagatccaaggaaatgcatacacaggctagatcactgtaattattgtaaatatttaaaaacggtaaaacctcagtttttagaacctttggaaagttagttatgaaagctgtggatttatccctttaagcaccaaacccattttttaataacccgtttcatttttgtagtcctttcagacagtattctttcataggaagtcttttgatcttaacagcagagcagtcctgtaaggtgaggaggattgctgggattatccaacatcatttacagatcagtacactgaagctcagaaagatttgctcaaggtcacagaagttggactattctaagaattttaactctaaaagcgatgtcttagttgagtgaagtacttagggatgttctacacaaactctgctgtctgtcgccttccccccatttttttttctttcttttttgagacggagtcttgctctgtcgcccaggctggagtgcagtggcgcgatctcagctcactgcaaccttcgcctcccaggttcaagtgattctcctgcctcagcgccccgagtagctgggattacaggtgcctgccaccatgcccggctaatgtttgtattatttagtagagacagggttttgccatgttggccaggctggtctccaactcctgacctcaggtgattccccctgccttggccttccaaaatgctgggattacaggcgtgagccatggcgcccagcccttcctcccatttttgctacccacctgtcacttcttgacattgtgattatttatgtcatactgtttctgatctgttctgggcctgggaatcaaatagccatgtttgctaggcctttgtatgagatgctgcattttgactgaggcctcaggactcccgggtgaaaggtgggtatatacaaaagtgacattgcgtggtttgacaccttttgattccttcctgctttttctttattgcataattgatacattgcttgaatgctagattccccccatctacccccacatctcatttaacaaagaagtatagaaacatcctggggagacagtgtggagtggacctgggagtctagcatatgtgagttctagtccccgttctgccacttcctgccttctgtgatgctgggctagctacttgacatctctctcctagcttctgttctgtagaatgggggaaaacaatagttgccacccccagacaccatgttgtggagatgtgtctggcttatactcaactcagtgactgtattgtagctattagctcttagtaacagaaaattagtttttagtattatatttctaagatttgtatgtccctgcctctttaagtatttggtttgtattaataccttttggtcttgttatataatattctagctgtaaaagcatttcatcaatgaattgaggaagtctctgattttaaatactttaatcagtaaaatttcagagaaaaatctttaagacatttgattggtaagatgataatacatggcagaacacacaagcttactttttttaataggcaagaagatgtgtgaaaacagccttaaaaaaaaaaagcctaagaattccagtctttcagcctggaatatgaacaaagtttctttaataacaaagaaaaaaatgacaccaaatgatcaataacttagagtttacaaaaactatcagagagtaaaagggccagggaaaatgcagacactggtagggatggttcggtggaggatggaaacactcataaaataatgggccctacaggtattctacaggttgaaccaggcccttgaatgcatcttgggaaccaaaatgaaaagtgaaacaactctgtgcctcgtaaaccatgaaaaaacataacaggtactcaagggaagcacagtatttcctggcaaaatgttggagttgggggtagtttcccgtaaagttggatgggaagagaggacgcagtgaagcatgtcttcatcaggtttagagcaaatgccgcaggaacctttcttacaggtctcagggaaagtggaaaaaataaattgacaaatggggagctgaaataatcttacctcggtatgtttttttgggaggaagctaactggaatattaagaagcatggaattggaatgcacattcttccagtcttctgcccccttggaatgtctgatttgagcaaagcagcttcccacgggatcttcttgattacaaaatggtatttctcaacacctaaaaaccttcttgaaaggcttattaccaaaatctttggttgttgaagttaaacaatcatacagtaataattagataggaccagtgtccgcgaagtcctcctagcttgtttgccgggtgcgctttagacgcacagctgctctgagggtacttctgatcagagtaacccagggtgacccagctataaattacactcgagggtggtttgccttgtcttgctggtagagcaccagaatcttggtaaaaatgtgttggtgggcttagcttttttctttttaaacttggaagttcagaaattggtttttaattaaaatctttttttgtttgcttattatctgtctcttcccaccagagataaagctctcttattcgcgggtgtgtctcaagatcgatattttacaatatagtttagcacatagcatatgctcaataaatatttgaatatttgttgatttaatgaatttattcatcgggaatagattttgctatctctagacataagaagttagaaattaactctgtagtctaaataagataattctgtagtgcaagtgtgatgattttgaaggatgtggttaaaaagaaaatattctaaaaaatattttattttttgatctcgctatgttgcccaggttggtcttgaacttctggcctcaagtgatcctactgccttggcctgttaaagcactgggattacaggtgtgagccaccattcctagccttgtttttcttaagtagttaaatagttaatattatgttgaaatttttcatctttgctgctgattttgggattatttcttaagatagatattttgactgggctctttcttagacttccaagttaggaatggtagaggtgtcctctgcaaggatttgtccagtgcctgcattttcctgaatactgctggagaaggggccattcagccagggactttgctcctggtaggaaccagctattgctgttggtctgctttagtttttgttttcctgtcttgaccaaaacagataaataagatacactttgctgaagtgacaagagataccatgcttcctctttaaaattctcatccttatttactctggagttttaacgaggattatcgtcaggctcactgattttttacagtctaacatttgtggaaattgttctgtctctagacagtcctttagatttcagaaacaatcttgacaatgatgacatcgctaataccaccatcaacagaggtataggctttttttttccccagtgcctgtttcccttccaggttgggacatgagggttagtgtttcctgcctcctttccctctttaacagtgtatccttaaagtcataatgaatctgatctgcggcataaaaaaagtaagcacaattggatcgttttggtttttcacccatcattagcattgtattcaggagagtgaggaaatgcattttcttctctctcttttttatttttttgagatggagtctccctctgttgcccaggctggagtgaggtcgtacgatctcggctcactgcaacctccacctcccaggttcaagcaattctcctggcttagcctcccgagtagctggaattacaggcacctgccaccacatctgactaatttttgtattcttagtagagttggagtttcaccatgttggccaggctggtctcaaacgcctgacctcaagtgataacacctgccttggcctcccaaagagctgggattacaggtgtgagcaactgtgcccagccctgcattttctttctcagtgaaactaggtggtggttggagaaagcttgtccttagaatttgttggcaagttccatttaaatctaggcattaccctcctgtagcatataccatgtgcattggctctccttaactctgaacttattttatagcccaaatgggctcttaacttatttatgtgtacttgtaccctcagatttttgttaaggattcttggaactcataggtagatccaggttgtttgtggggacgaagtttatacaatttgggggtcctcattatgaaaaatatataaatatcttttaagttttacaaaaacctatggccatgtgaacccttttgaacttgaagacttctccatacctgtcatacaaggttcttgtcagggaaagtagagcttagtggttaagaacatggactgtgggaactgggttggattcctggttctgcatcttactgtgaactttggcaagtgacttaacctgcctgtcttgtatgtaaaatgaggatatcataacactcatctttatagggttgttgggagaaatcagatagataatccatgtaaagtgtttagaataatgcctggaatcaaaagcccacattatataaattttagccatggtttcattttgctgactggttctctgctaattaggctcagtcttgtgttctgagctgctttttctcttctggatgttgatattatctctagaactttaatattcattcacgaatctgtttgtatctgcctgagatttctggtggataggggacatgacaccaagcagtactactgtgtttcatttctgtgtcaggaatgtgatctgccccagagtccttatccaggactccaccaccaggcagcgtgtgaggcatttccacagtgaaagcaccaggtctgtagatctgcaccattctgtccacattgcccttagggctgaggacttctctgtagagctagaggtcttgcttaccgggcttggttgtattctgctttttctaacaggttgattccttttaaataagatatatctttcctttcttggtttcagatagggcttgtattcctccacagctagctggttaacatattttccttcaagtgtttgaatttggcttgcttgaatctggaggctttgagtttatgtgttcttatgaagtctctacctagacctgtgtgaagcaagtccttgagtggagaagactaatgcttagttttcccccacaaggtagggagggaccaggaagcttcagggtgtgggcgtgactgttgagtgctgtgtctgcggtgggaaggccagggaattggaggcatgaatgcagagaaaagaggaggccttttgtgcttggaaggactcttctgggtcagttgtaacctaagcatttatggttatttcccctctgctggataattttccagggaactctagctgtggagtggccacactgggcgggctatggcttcattgcttcttcccgcctccactcccaaatgtttggacactgatctttctccattatctgcagcttctcacccttaatgttacccaggctctgtgaatggatagagtgtgcttcattagtgcacaatttcctggtctccttttgtttcttgtgggaggaaataggagagaaaacaatcaataccatgtgtagcaagtctctgtcctgctgttggttaattcaaacatgtgattccactttgaatgcaaaaatagcaacagcaatcatattctgcttctaattgagtgtagaaattatatgtacattaggcatcatcttgtgagcttgctgtggtctttgggccttagcagctgagctggaaccctagggctgctctttagagtccacctatggctagatgccttcccctgaatggttccattctctactctgaatactggggtggattttccttatctttcttcaaagaattggatgttgtattttttaaaaaccccatccctacctctccttgcttacatacagacgcattctttgccagccagattttcatttcaaggtttattcatctctgagcttcccccccttctttttcttctttagtgacaccctttcctgcagttggtcttacatcaccttcaaaaaacatgcatgtggcaggaggttggtcttcatatgggccagtgggagagttaaagtgtttttagtctgaaacagctctgccaaatatcttatgaactttttttttttttttttgagacagtcttgctctgtcacctgggctggagtacagtggcacgatcttggctcactgcaactctacctcctgggttcaagcaattctcacacctcagcctcctgagaagctgggattacagtcgcgcaccaccatgcccagctaatttttgtattttttgtagagatggggttttaccatgttggccaggatggttttgaactcctgaccttaagtgatccacccgtctcagcttcccaaagtgttgggattacaggtgtgagccaccgcacccagccttatgaacttttgaactgtgctggcaatgcgctttggaactaaggattcctatgggcttgtttaaatcaattcctcccaccccttgccgacttttttttttttttttttttttttttgggagacagtctcactttgtcgcccaggctggaataccgtggtgtgatctcggctcgttgtaacctctgcctctcgggttcgagtgattctcctgcctcagcctcctgaatagctgggactacaggcctatgccaccatgtctggctaattttttgtatttttagtacagtcggggtttcactatgttggccaggctggtcttgaacttctgacctcaggtgatctgtctgcctcagcctcccaaaatgctgggattacaggcatgagccactgtgcccggcccaattagtcctttctacaactgggcaatatattcatgtgcattagtctgatacgatgatattggtggtgggtacatttggatatattgtcacatctccatgagttaaaaggactttatgttaagccagagtctaagcatcttcaggcagatagcatagttgcctgtgctaagactgtgtatagtacagagagttcctgtctctcagctttgttgtagagtagggataggggagcatccaatgatggaaaagacttagacttggagtcagatctgggtccgaatccctgctgagcccacaacctttggacaagtcatctctgcatgaagacagtacatctacctcagggtgccatcttccttgcttatgagaaccacttctctttatgccaacagttccaaaatagaaaagtaaataagtgaaagtatcctgtataccttactcctaccctaagtgcttgtactgctttgaatattgttcaaccattttgaaaactgaattatagtctgttgtatggatttccactgattattcactgcttccctgctggtggatatttcctttaaaagtacttgtgtagaaaagtgtgtaacttttgacataacatttaaatgtattttgatattgccaaattgctctccaaaaaaattagttcctaccaatggtaagaaagaggaggaggatcttttgatgttaaaaaaagaaaaaagtaacttgttttagtttctttattaccaagtcatgagtcattgacatctgtaatccctactccatccctcgtccccagcagactcaggtgggaattgacagtgggctgggatgagggcgttttttccacaaattatttgataatagttttttaaacaggaagcttggccaggcacagtggctcacgcctgtaatcctaacactttttgggatgctgaggtgggcggatcaactgaggtcgggagttcgagaccagcctgaccaacatggagaaaacccatctctactaaaaatacaaaattagccaggcatggtggcgcatgcctgtaatcccagctcctcaggagactgaggcaggagaatcacttgaacctgggaggcagaggctgcggtgagccaagatcgcgccattgcaatccagcctgtgcaacaagagcgaaattccatctcaaaaacaaacaaacaaacaaaaaatccaggaagctttaggtagctttaaaatgatatcttatcaaaatggctatcaaatcatgtcaagtaagtggtttttaatgatatattgaattcaaaggaagaaatctttccagtatcttgattggaatggccagcaaagcatagatggaaggataagtgttgacatttattgagttcttacaacttatgtgaattaactcattgattcttcccagtaaccttctgatgtaagtgctgttaatgatctctggttggcagggaagaaaactgaagcagaggaaactttgtgcatggtggaaatgggcttctaattcaagcattcagtttccagagcccttgctcctaaccattttaatctgaggccagagctcagggagaattgacatctttcaagacgagagggtactgagtccagagagggcagaccagagcaagaaatcccaggataaagtcctttaacaagaagctggaggaggagagattagagggccctcctggaaaatactaggtgctacagagaggcccagaggatgactggagacaggccactggatttggctactgagaagtcactgatgacctgttttgtttgagacaggatcgtcctctgttccccactccctgcaatccccctcccctgtttccccccaggctggagtgcagtggcatgatcttggctcactgcagccttgacctcctgggctcaagcaatcctcctgcctcagcctcccgagtagctgggactacaggtgtgcaccaccatgcctggctaattttttgtatttttcgtagagacagggttttaccgtgttgcccaggctgcactggtgaccttttgagagatcgtcggtagagcaaatttccaggggttaggagagagtactaagggaggaaatgggcaggcttggcatgaaataaatgacaaacaggacagtgtatgaggctggcagcaggttcaattaaaaatttgccatttcagggaagacagggtagcctgtgcccattgatggaccaagtaaaggcaacagcccaaaacagatggtgtgtgggggcaaagcagaagggcaggagggtcagcgggaagagaaggggcccagctcagaaggggaagggaagaggaccatgaaaacgcagcactgatgtggagaagtcctcttttcatctgaaataggggtgtcactttgctcctgaccttattatgctagagccactgatgtccgatggggaagagagcaggaataggaagagatggcccaggctaagccctccctgtgagcgcactgctgattgggctgcccctttggagcttgggcactggttcactctcctctttccattggcccttgatctggaagggatgggaagttgggtttattttgttagagcctggttgtctgtagcaagcctttactgtattatctccaagagacctttgtgttggggcatagcactctgatggaagatgtaatgctttcagggtaacttattttctccctcatccatgctctcagattgcattacaattatgtaaaatatggagttcacctttactgtctatgtggagggtcccctgtgacttcatcataagatccttgcagacttcgggactggaaaggggaaaccatgttcaggctgactttcttttagaggacctctgaatcttgtagttgattatgtccctctttgtcttggtgtttaagaagcttggacttcagtttgcatccagcctatctttgggtggcatttgtgtaggatttggtggcatgcaggtgtttgagccttgcctctgacttcatctttttttcacacatcctcattaaaagcaaaatgaacctaatggctttttacttagggtctcagaaagtacaaaatacctttgtatggtatttcataaggcacagtatgaatatttttaaaaggaggaaatgggaccagcctaggcaacacagggagaccccatctctacaaaacatttttaaaaaggtagctgtagtggcacatgcctatagtcctagctactcaggaggctgaggtgggaggatcgcttgagcctgggaggttgaggcttcagtgagctatgatcatgccactgcactccagcctgggtgacagagcaagactgtcttgaaaaaaaaaagagagaaaatgggaaattctatcctactttgtaatggaaatgtcatattttctcattttcattggggaaaaaatggtgctcttttgcacagttaacatatctgtaagattccatcagcatctatcccatgtttaaaattcgatttcctctctgttcatagctggttgtgtaaagccacctttctcaaatggacagactccattgtagtaagcaaaaaagcatttgcaatctgagatctagacctggatctagactccaagaggagttccagatttactaaggctgacccaaagggctgagatcccatttctccttggcccactttcatgccttgtcccaataataaccttcagtaaaggagccgcgtggtgtttcgactcagttttggggttggcagatgggagcatggggatgcgggtggtcagtgatctgtgagatgagggttccccaggctggttgagacaagttccttcagaacaatacagcgaacttttgggacaatgacgttgaggtggatttcatgccttccttgagtcacagtagactgaggcttgtcctatggagcgggcttgctgaagagttgatgaggagtgagtgtacattctgaaactacagaaaagttgcaaacaggtcatgtgccttgtcgttatggaaagataaatgacagttcttcagtgttacccatgctcctgactcaagggttattttggaggcacctagaggtcctgctgaagagacagtgcttgacaatctggagagtggcaaagagctgatacctacaaatgcgggaatgagtttgttagactcttaaatattctagtggtgagacaaagaaaacaaaaacttgaggaacatctctattttcacctctttttacctgtggggcttcagctaagatctcctttcagcaaaatctctacagatctctaaaattcaagacccggctggccttcttcccagtgagagaatgttctccaacaagctttcttggaggtcatctcttcctgcctgtgcttcattggcactcaaaacatgatatttttccatgcctgtttgcttctagtccatctctcaggaatttctccatatatttccctggcctgtcctctgtgtgtcactcagaataaatcaactctctcttctatatgacttccatctaaatatttagatgggagctaacctgcctctcctaaacttccaggtcatatgtagccactcctggctagccagtttctcataataggctatatatggtttttctaatcccttccccacctagtttactccttctagaaactgatgtcagcttatcagtgtcccttcagaatgcatcactcagaattgatcatagtattgccacagatgtggtttaacctaccagagtacactgggattggtaactgacttcctttgattacaaagctttagctcctcctgttttaaccaacagaatcacttggccaggtagacaaggtaactctgtgtagaagaaggattctaatccttgctttgtcaaattgacttctccagtctataaagtatggtgatgatcactctgggaggttttatggctcacatgaactccatgcgcacccgtttcttataaataatgctttccttggttacctcatggggctgttttgatttaaacaaataagcaatactattttatgaagaattgtataactatgcagaccaagatagtgttggctttttaacttactcaactcactgagtaagtgttactagttctaaaactttggggcaggatttgacatatattttgaataaactgtgtattaacgtaagaaagatccttctgattcccagtttccttaataagtatgccaagtagtttccaagtcattaatgaccaaaacagaagagaacacatctaaatccaaacattgaggtacacatcaccacgagtttcctctgccatgacataatcagcacagtgggcatggtgttccttctgactgtaccctccttctagggttactaaactggacttcaggagtgccctagacataaggaacttttatcagaaagtaatgcaattatatccctagtgggccatctaagattaccagattggcagatcaaggagatgtgacgcccataaaaggcagtgacattcaaatgcagatgcctttccgaaacaagatagatctttaaatctgaggcatttccctaggctggtaatcctgtcagtgggtgaaaaatcatggattgagtgcccactatgtatcaggcatgggcatgaggattactaagatgaacaggagcctgacctcccctcaaggaggggacatgggcaggtgttcttggacatgccttgtgtgtccatgcagccttggtgatggctgcccttctccctgagtgcttgcttgcacactctctccccaagagtccactctaggagggcgcctgccgggctcttcagccagtaatagatccttgccctctgggtggggatggagtgggagcaggcttctctctaggttctagttactaccgtttgccaaggcttctctcacagtgagctgcttgatacccacttttttgttacttgttatttctgagtctagattcttctgggaatccagtgtctatacttgttcgctccttgtttagatttgaactttcaaaaatccactataaactatatgtgttctaagctttgcagtctaaaggtcattttctagacagagaagacaaaattgacattctgttagctctgcatctttctaccgtttgttatactctttgctttaggcactggaccagctcctctttaatcatatatataaaatttttttttttgagatggaatttcactcttgttgcccaagctggagtgcaatggcatgatcttggctcactgcaacctccgcctcccaggctcaagcgattctcctgcctcagtagctgggattacaggcgctacagatgtgtgccaccacgcccagctaatttttttgtagtagaaacagggtttcaccatgttagcgaagttgagctcaaactcctgacctcaggtgatccatctgcctcggcctcccaaagtgctgggattactacaggcatgagccactgtgcctggcttatttatattttttttgagacagggtctccctctgttactcaggctggagtgtagtagcacagtctctgctcactgcagccttgacctcccaggctcaagtgatcctcccacctcagcctcccaagttgctggaaccacaggtgtgtgccatcatgcccagctaatttttgtgggttttgtagagacagggtctcactatgttgcccaggctagtctcaaaggactcaagtgatcctccagtgttggcctcccaaattgctggtgtgagccactgcacccgtcctagtaatttttgaagctttaatttcttgtcagtctcacaatatttgtatattgagtcataatgtttttgtatttacctgattatagacatttggaggggaaaaatttgtgctggttggtgccatatgctgataccttgatctgaagacacagttgtacctctgagaggaggacctggctttaaaatgctcctggactttacttctgtttacctgaggcgagcatgattttccacagcttttaaatgtctagttcctccgcatcaaatctttagcacgttcgtgccatggaatgagtcttagattctgtggtgacctcaagaaaagcatgcattctatcttgacatcactgtcccaaatgtaaaatgtttttctctagaattcccactcccaccccccataagatacatgcctgattttgtaaaatagttcctttgtcctttttgtcagcaacaatctgaaaaagaataagaattcgggatgcaaacacattctaagcagagagaagagctttagcaaagacagagaggcaggaaccagcctcaggaagagtggtaaagggagtggacagtggtgaaggctggcatcccaggtgagcctgtctgcagtggggttttctttgctattgcaaacaatggattgaacaagttgcagtggggtttggttaatagaatgctctgtacctggagctgataaaattggagggcgtgcatgctgttgtgtgtcaggtattgcggtgggttccattcctattgaacaggcttcatcctcacagtggccctggaaggaaggagtctacccacaagaaatggggtgacctgggttcagttacttgccaaggtcacactggaacttgggaacacagggttttgaagtttgacttgaaagcgtgtgatcttcagtaaatgtttataggattcattgcggagagacagggtagatgaaaatgttgaaacctgttcattgtccttgcatgagataccaagaatagcaagtgatagtgagaaggaaggagaggaggaatcttgataccttgagatggaaatctatttggttcctattttgggaccatggtagcccccattgttctctctttattttaaacaccctattttatatatatttttgtgaactctttaatacaccgtatttaatatttgtctctttctgctagaatgtaagcttttaggacagagactttgcctttgaactgtgcctgatatgaactagccatttagatgaaggacagaaagaaggattaatggagaaagaagatgaaagaagaatctaaggaacacacggaacacttgaaaaacagaagctaatgttgaatacgagtttacttagagagtttggagtaatgcaggattatcctggtggctcaaaacggggagccacagctgaaattagggagactgttgtaatcactggggacaataaccaggaattgtctgcttccaggtttgaacaagctctgtgatgataatacattgtgagaaggaatccatgtgaaaaacaagcagtcttcattcttcagtagattctggaatgtcctgggtgtaatgggggcatcagacagttcttgtacatgaatgtcatcactctacctcatggcagatgtgcccccatctttttttcaaatggtacttgagctgaatgctctcggcgtacaccgagaagtaccattcaacagcgcaggaatcgagcttttgggtcagctgtggaggtgctttttgaagctaggtctccctttactctttctccctttctgagggttcttagggggaagcttctcaaatttcagagccagggaggggcatggctgtttcccagcagctggtaggcttgtatctgctctagtgtctgccttcactgttaggacacataggccctcggggttgtgtttctgaaggtggtcttagtccagagctcttggatatatgattaatagtgatatgtgatatgtgtgcctgtgggctggaagaataattggctgaaggataggcccttccctctgggaatggagtgtgatttgtggggggagagacttgtacattttagtgttatctcagtgtttcttaaccttgttttcatgatcaccttctccaagagttgttttagacattgttcctagttacctcctatcccttgctagatttagtacaaaggaataagattttgttgggtagagttgagctttggagggtcccaagtttttgtattgtcttaagatttttttcaccattggtagaaaccaccacaagaaacacttttcacctctttgggacaccaccacccctgttgagaatgcatgcgctacatacttgtatatcatttatttgtttatttttgttttaaagacagagtctcactttgccacccaggctgtagtgcagtgacatgattatcagtcactgcaacctggaactcctggcttcaagcaatcctcctgccttggcctcccaaagtgctaggattacaggcatgagccacccacctggcctatttttttttttttttttttaaagagacgggctccctatattgccctggctggtctcgaactcctgggctcaaggattcctcctgcctcagcctcccaaagttgcaggattacaggcctgagccaccatgcctggcccagcctaatttttttaaaaaaattattattttggaattggctgggcgtaatcccagcactttgggaggctgaggtgggcggatcacctgaagtcaggagttcaagaccagcctgaccaacatggcgaaaccccatctctactaaaaatacaaaaattagctgggtgtggtggtgggcacctgtaatcccaactactcaggaggttgaggcaggagaatcgcttgaacccgggaggtggaggttgcagtgggccaagatcacgctatggcactccagcttgggtgacagagcgagactccgtctcaaaaaaacaaacaaacaacaacaaaaaaccaattattattttagaattacaaaagaaagtgagggctaaagaaaggtcatgaaacaagaaaggactgatctgcatttgaactgaagggtgactccacactggtgctcttagctgtcctgaggagagagccaagggaagctctaagggctgaagccgccaccacgaccacaacaggatgagccctggacccaggcacaggaacatgaagaggagcaggtgaagctgtcggaggagcgagagcagagcaggccaatcgctgaatgtagggaggaggatcagctgtatcctatgccctaggaggcttttttcttggtcttcattatcttcacatgttgattgtatctggcaagagggatgttggagagtttcggggaggagtctccagcaggtgtgcctagacagtattctcctcggtctctggatcatttgtaagtgctccttgatgcaaagaaggctgtcaggcactgcttggagaatgtgtgcgtgtttaagaaaggaaggtgggcatataaagagaggggctgctgtggatttgaaagagccaggcagaaagtctgcgaaagcagcttgggaaggccaagaaaataaatcttgaagaagaataaagaaaaggatgtttatcaacaacttggaagagtaatttttattttatttttatttcttatttttgagacggagtcttgctctgttgcccaggctgcagtgcagtggcaccatctcagctcactgcaagccccgcctcccgggttcacaccattctcctgcctcagcctcccaagtagctgggactacaggcgcccgccaccacacccgtctaattttttgtatttttagcagagacagggtttcaccgtgttagccaggatggtcttgatctcctgacctcacgatctgcccaccttggcctcccagaatgctgggattacaggcgtgagccactgcgccctgtcaggaagagtaatttttaagtaaattagagtgaaatttccatgaagtattaatgaggtaagtttaagcaattattttaagctaactttcttttgttgagagaaagaaaatgtcagcgtttttctgccagatgttgagaaattaaagctttttagatgaagatagtaaatcatttttattggccaaagattacttttttaaattgctctcagttccttgattttaaaagataatgctgtttagctggcctgactgcataaagctcacttactagaaaaatattcgaagtatttggataggagaatcctgttgctcctttacttaaaggaaacccttagcccacaccaacagttatttgatgtggctgcattcctagtcttaatttttaattgatcatatggggctttgagttttgcatgcttgtacatacgaatttcttctgtgcacgtggtcatatggtaagtctcaaggacagcatcacctgtccagagctcccccccacaaccactcattggtagagccaggatttgaactgaggtccatctgactccagtgcttgatttttctatctcatcacttccttgacaagaactgtcaacagagaaggtgaaaacttcttactgggatctactaggatatttcaagttaggtctgtagtcacttcgtggtttggggcatggcaccaaatctgttggacacattttgaacaaaggatgcataaatatgcttttaatgtttttctgcttaaatattaattgatgtcatttggtatgagaattaccatcaccatcctgtgaaatatcccaaactactctaacataatttttctctacatttgaagaaacgagaaaatacttcttcagttttttattatttgaccaaattgtgtagatagctgagagtaggaacggacctagtgcaggcatccagtttagacttcctcttggatcgagagaagttagaggaactaacccaggcccatagcaaagatagatggagccaggcatggcgccaaggcagaactcctctcaccctagcatattatgtttttcttcagattgatcaaaatatatctcctagttgagaacgccctcacttttggggaaaaaaaaaatcaccttacaattagtatttgctttccatagttaatgcttgaggagtactcttttctccttttcttctttgcctatcccctttcataccaccacctccagtttatatagtgagaatttatttttctaggcacccagaacaagaccccagtgtaaaaatatagtcaagacttaaacgtgtctatcggctggacgcagtggctcacgcctttaatctcagcactttgggaggccgaggcaggcggatcacctgaggtcaggagttcgagaccaggctggccaacatggtgaaaccccgtctctgctaaaaacatgaaaattagcgtggcgtggtggtgtgtgactgtaatcctagctattcgggaggccgaggcaggagaattgcttgaactcgggaggtggaggttgcagtgagctgagttcacgccactgcactccagcctgggtgacagagcaagactccatctcaaaaaaaaatatttttaaaaaatgtgtctgccaatttttgttttattttctaaaagtgccataaaaatgggtttatttgatgtgttggaggagatatattatccaagaatatttatctgaggtataataggagtaatggaggcagggggtggtggctcatgcctgtaatctcagcactttgggaggctgatgcgggaggattgcatgagaccaggagtttgagactagcctggaaaacaaattgtatttaagactgtcttttataaactaacctccaggccagacttgatccatgaaacactgcaaagttagtcgtcttaatatgaaaatataaacttactggattttcttttgtaattctggttaagtaaatctacagttcaaatcaattatccattattctgtcaaagctgtagagccatttctccaacttgggtaaagggtgcaaaggatcaagaactgccatctccctaatgccacagtaatttagtgaaatcatttgccctctctcagtcaaagcagaagcttcatgccttggcgtggcggggaggggaaaagaggccctgaaaacagcccaggagtggtctgattatgtgccaggggatctctcaggctcaggtgcatggtgagccttcaagagggggacctggaatgtagacatttccacctacttgacctgggaaacgggatgtttttcctaccttgagaagttaaaaggctgttgtggcttttgatggacacaaaaaggaactgtgatcaagtgtacgctttgaatctgttttttaagactcagcgttggttttcactgttgggtgacttacaggtaagctggccaggttcgtaaatgtctgtcctgatcctggtgatcaggctctctcccttggaaaggacctgaatgcagcccacagtcctatatgctctggcactatgaacctagggcatttcccacagttctgcttggttcctccgtgagtggtgtagactggaacttgtgggacttctttgtgactaaaatgtcaagatgccatttcatttcttccaatgattaaacctccctatgtcttatggacacagcagacatttctaccttcattcccatttccaatgatgtaattgattcccaagctcatgatctctatctcctgagcatttcctatgtatacttggcattttcaccagtgctgaatgagaagacaaatgatactggatctttccttcttcccagctgtgggtttttttttggcagtggggcgggagacagggtctcactctgctgcccaggctggagtgcagtggtgtgatcatggctcactgtagcctcgatctcgtgggctcaagtgatcttcctacctcagccttccaagtcactgggatgacaggcatgcatcgtcaagcccagctgaattttttatttttagtagagacaaggtctctcaatgttgtgcaggctagtctcgaactcctgactcaagagatccacccagctcagtcccaaagtgccgagattacaggtgtgagccactatgcctgcctcagctgtgttctccataaccctgattgaccagccactttaaggggactccaggacaagggatagcttaagaacttgggcatgtgatttttttcacaatattttgtttaaattttattttttcaattattttaaattgaggtctgtggtcttattaaaaagggatctttcaaaacttatgtttaatagttttaccatgtataatagcatagcatttgtgttggtaagttggcctttatttttgaattctgcaagtaaaaagttaaactttcttttagttttatcacatgtttgggtgtcaggttcaattctagatactaagaatctgaatgaactagatgcttttcctgcctgtaagaagtctaataggatagagactacataaacagaatttaaatattgtacagtaattagtactgaggaaagtgtgtgtgtgtgtgtttagtatatagtgtgtatttggctgaatagaaggcaaataccagaactttccagtcaacaaaactattggaatgttatgtattggccaggtgagatactctgtaaaataactgcatgtgtcagaatcctttccccagctttttttggaatagggtgattaatgacttaaaccttaaagtttgagtgccatattgtaacataccattaaatccttgtcacttcctgtggatcatgaaatctgatgtctcttgattgatgttctctccttgtcagtcccagcctctccatggtctgttcaaaattttgtatgacacggtcttcaccaaaaatttgttattagttactgaagttgtaacggttaagtttgccattgagatctattgagtgtcatttactacacttcacagctgtggtcttaatggctagtgaaagcagagcgcgttgtgagtcggcagtttctgatgcttttgtgaaattcttctaaagtgagttaacctgtatttcagattgcttccaagtatgatcatcaggcagaagaagatcttcgcaattggatagaagaggtgacaggcatgagcattggccccaacttccagctgggcttaaaggatggcatcatcctctgcgagtgagttacagccctccagaatctgtttctgctcttccagttctttccacagccttctctctcactctccttctcagcccagggtgtcagaccttgatattctacagatatctttaatgctttcccttactgatgctaaagggagcaacttgatatttcaatccttgtttttgtgtgccagtaaataagatgtctctcatatttttcttttcagacttataaacaagctacagccaggctcagtgaagaaggtcaacgagtcctcactgaactggcctcaggtaacagccaaaccaaccacctctggttctagttggttgcattttatgtagtgaaaacttgatttcaggtttggttttttggttttgtgttttttttttttttaactttttgattacggtttttacatagacattgtagcagaaatttgtgcatatttaattttttgcccttttgtaatggttctgtaattacttatttaactagttctgtaattattatgtttagcttagaagttttcctatatttagtctgtgtacattcagaaaggacttgacacagcttacacagagaaatgcaacccagaccttaaggataagggaaaaaacaaggcattccacataactaacagtggactgcagagcactgtatcagacataaccttagttcatgagtgtgtatgaggaaggaaaatgggatacttactggtcttgaacatgtgtttggagatatgagagaatgagtatttagtaaccacaaatgtattctgaaattaaaataacacataatgaattatttattagtatgagtaattatataccttttgacaaataaaattccaggcctggatagctctgatacagaatccttttaaaatatataaggaagatcttgcccataaaaactgaaaacacgtaactgcttaaaaatattaagactgtgatgtgacccacagtgagagacacactctcttcttgctctttcctgttccagagagagccatgcttagtatgtatttggttgaatccttgtcaaacagctttctgggcagcgtcttataactgtttatgaagacttggaattcttagaaattatgaatgtcaatatttagctccagaaattataaaactcttcttctttatagttggagaatattggcaactttattaaagctattcaggcttatggtatgaagccacatgacatattcgaagcaaatgatctttttgagaatggaaacatgacccaggttcagactactctggtggctctagcaggtctggtacgtacatgtctttaatggctggttaacagattcccaccacattggtgatgaattgcatcattgctttttcatgggggttcagaccaggtggggcggggcctgtctcttctgtaattagtagctttgtggaaaggctgctgacatcagctgcatcgtactagatagcttacttagaacactcacatttcaaatgatgcagtatattattgaacagccttaaatactttttatctctagtttgggcccctttgtctatggacatatcatttctttgttgttccttctgtgaaactctgttggccttttcagttagtgtgcatgtttctgtctaggctaaaacaaaaggattccatacaaccattgacattggagttaagtatgcagaaaaacaaacaagacgttttgatgaaggaaaattaaaagctggccaaagtgtaattggtctgcaggtaagtaatgtggtgttgcttattcaattacttattcaatatgattaattctcaccatgcaaaatattaagcctctcctaagaatagatagaagtactatagtactggggggggggtgtagtttatacaatttatatctatttataaagcccataagacagtgataattttttagaggaaacctcaggtatgccacctgacttgacaattatttctccaggaaacgaaaatttttaattgaatcatattgtcttttttttttttttttaaaagaaaaatacacttttaaattttttattttatctttttttttttgagacagagtctcactcttttgcccaggctggagtgcagtgacgcgatctcggctcactgtaacctccacctcctgggttcaagcaattctcctgcctcagcctgccaagtagctgggattatgggaatgagccaccatgcccggctaagttttgtagttttagtagagataggatttcaccatgttggccaggctggtcttgaactcctgacctcaggtgatctgcccgcctcggcctcccaaagtgcttggattacaggcgtgaactactgcacctggcctgttttatcttttatatatagatgggatctcactttgttgcccaggatagtctcaaactctggagctcaagcagtcctcctgccttggcctcccgaagtgctgagattacaggcatgagctaccacacccagccagaaatgtactttataaattccttaatgttattgaccaaattaggcaattttacacgaccttaatgccaaagtcacttatttacagtaccaaatcatgatatagcagccaagccctgttagaatttgtcagtttaaattcttctgaaatacgtagttcagatgttttccttctcttcattgttctcttcactggtcatggaaacgtcattgctaattccccaaatgctgttggctttactctccaaaagccactgtacctgcttgatacagtgcccctttctactgagtctatgcaagttagatttatttttacacagtacaaaattgtattggtggtgagaaactggaaacctaaatttcagaacagtagtcagttggttgaattacaactccataaaagcaaagtgtaatgtaaaattatacactagagtttgaaaagataggttatgggggaaaaaaatcagatcatcaaatactgtggtcagtatggatttttaaaattaaaaatgcacatgtttttgtatgtatttgtatatatgtgcatctatagatatatacatagacacataggttaaaaagctaaaaggatattcacaaatgttgacagtgaatggatggtggtatcacaatgatttttcccccctcctttttgcttatatgtgttttctgaattttcttcaatgaacagattttatattagtaataaagattttctttaatcttatttttaaagaaaaaatatccaacatcagaaaagtgtgcctaaccagtggaacagggtgtaatggttggtcctgaagccatactgttctcagtggggaagaaaaattaattattgtttccctgaactttgctgagttcaaattcctcattccacctttctccagctctgtccaaggacatgggagttacaggaataaaatgtggttcctttctggagaaaatgttggtgattttgaaactttaaaaagcccttgttaagctcccagagaaaacacttggcatttgctttcacattttatgtaaaacattcctggagtagaacagcatattgcttggcctaggattacttctgttgaaataaccgaagctggtacctcttaatttggttatctggggaaagagtagcagaggaaattattctgccactgtaatgacttttggtgtgtcagtccacctgttaaagtgtgtttaattcttctatgtatgagtttttatctatagtgactttaaattttctttttaaagttagcacttgaaatttgtttgtagacacatagaagagttgactggagcctcagctcagtaacttgtcggttgtgccccttctgtctttttggtagcatggaaagttttgtttgtgttgtgtatattgttgacatctgataatttgtgcaattttatttttaacttaaaagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgattattttctggctagcttctagataggtagggtcagatttttttttaagtacctttttcctaggtactgttacaaggtacattaacattttatttacttcacacaacactgcactctatgcttaaggagattgaggcttaggaaaccattacacatagtaaatgacagaattctaatcattttctgacccttgcttatttcactgacttggctggcccagattcatcttaaattcaacttggaataatcttaaaatctttaggaatattgacaggaggggtggggaattttcctatcttagggtaagtaaacatgaataagaaacatgctaggtcagccataggatgtgctgcttggtaataagccagggtttatagtgaaacataaaccttcagtcctgacagagggaaggacaaacaatagctaggtgtcatagtgacaaaaatgcagtcactaaaagaaaattagtaactcacactttccgacattgtctcagccaagccatgtcttctaataggattggctctattaggtttgggggcgaaaaccgtctgttttttgctgagagatgaggagtatatacacatggtttgatgagcccacaaaagtgaaggctatttgctcatcattccacaatgactaggtttaatgcttctgggaaactgcttgtaaaggaaactattggagtcaacctaattcaatagtggcatttaagaaaaaagtcattgcatttaaagtagacctgagttctaaggctttccttgtcatctttgactcttcaaagtttagggaagggaagccttatatcacactacctgccctgccatttaagtcagattgattcccatgaggctgccaatcaacatgttaaaatgtttctatttggttagagttttaaaaacgaaaagctcttcccctcactcccatctacataaatctctgaggtccaggcagaagtatttttaaaaatctgtctccaggtaatttctcaggtggggctgtggttgaaaaccacttcttccagaatgtctgctgtaagaggagtgcttgtgtatcaggagtttggataaattgtgtgtgccatcacggaatgtgatctggtggagagacataacagaaagtggattcacagtcatatcagagaagagcatggaggaaaaggacagaagagagggcaagtaatgctgctcagaggcattgcagaagcatgatgctatcagagctgggttttgaagaataagtaggagtttgccattagcaaagaggaggaagagtattcagaaaaaaaggaagagcatgtgcacagactaaatcattggttacactcctgcctctcctgtacatgcccagttcaggtggtagttcatgttagagtatacagttttggcttttattgtcaccaaatctaagaattgtactttgaaaagttaatccatttagcatatttccaggattggctgagtagggaagtatcctactctgtataaaagcaactttccaagctgggcatggtggcatgcctgtagtcccagctgcttgggaggctgaggcaggaggatcacttgagcctaagagctggaggccgcagtgagctatgatggcacctgtgcatagacactgtactccaaccttgggaacatagtgagatgctgtccctttaaaaaaaaaaaatccagagatttctgctaacaaaatccttatcttaaaaaggtttatttattagttgtgcac

SEQ ID NO: 15742 - DNA, 18923 bp, Human
caagtaactgggattacaggtgcccaccaccacacccagctaatttttgtatttttagaagaggtgaggtttcaccatgttggccaggctggtctcgaactcctgagcttaagtgatccgccccccttggcctctcaaaagtgctggtattacaagcatgagccaccatgcccagcctgaagaaaatttaattaaaatactgtttttaatcaaagaaattttgttttgactaaatttagtagcactgaaaaacaagtgtctacacttcagaaattaaagaaccagtaagttgtcctgcagaaaatgctaaatgaaaaaatagcataataaactgtaatgtcttcttgagagcagcatatagggctcagacagaacgttttaagaaaacactgtcaacaagccagttgccatcatatgtatcaagagtaatgaatctgatgaaccaaagtgacaaaatggatttcaacagtgtcttgtttagtttttagaaattccaacatcccactatttatagtatagcctcttcttccacatgacagtatgacagactcagtttttttactttttttttttttttatcttttttgagacaaagaatcttgttctgtcacccaggctggaagtgcagtggcacaaccgcaactcactgcagccttgaccccctggctcaatcgatcctcccacctcgccctccagagtagccgggactacgggtgcctgccaccaagcctggtgaaaaaaaaacccgtgtttcatattgtcatatagaagaggctatactataaacagtgggatgttggaatatatatttatatatataaatatatattatatatatatatatatatattttttttttttgtagggacgggtctcactatgttgcccaggcgggtcttgaactcctgggctcatgtgatccccctgcctcagcctcccaaagtgttgggtttacaggtatgatgagccacaacgcctggctgacacactttttttttttttaaatgcaatttctgtttagaccttgacacctgttgatattactagtcactatggaaagaagtaaaaacagttgcttaagatgctctaacactttttttcccctgtagaagccaacatggaatacaacatgaaaactgtctaaatgggaaccttctaatatagctcattgtatgccatgcatttccactccatttccactatgttggaactgacttctgctttcctacttagccattaggcgacttagttgcctctaggcaagtaacttctctgaaatgtttcatttttcatgaagtttaaaaaaaaaaaggtggaggactttagagagctttgaaccgaataaggtctatcagacatcttgaaaagctttttctccagacgacgcagaaacaggcacacggggttctgctttccccacctcccacccccaagcccaggtcccattcttctcactttcaatcctcatttgggctcctaaaggaatagcaaagagagttattttatcaataccagcgctcctctgtccccaaatccagctagggaaggtttcggaggcctcagctacttgagagagggtagagacgatccttcctcgcctatctacccagccacccaccccttcccagatgtagcgtccgggccccagaccaagcgcgtgcttggagctctccggtacagtgaggcgcgcgcttgcctggctagggtccctgtgaaggaatgggatcccgaggtgcttgccaggaccgtagcaggcggaagctgctggcagcgcgaacgggcggctcccgccggcgtgggtgggggaagggcggcagccacacccggaagtcggtccgggagggagggggaaatctgagggaacgaggcttccggtggcgcaaagggtgtcgggagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaaggtaagtcgtgtgtgagagctggtttgaatgaggttctagggtagcagtctgctaatcgcgtgaccctttcgtgtcaaagcctccattcctcttccctggtaagtaacttaatgaaaaagccagactggcatgtaggcagccggtgctttaaaaacaatccctttgtagcatttttgcagtacttttcatccagcgaatacatgtaaggagtgcaaacatttaggtcagcgtccccaaaacgtaaagaataagagtgatctcactttacagccaggtaagccgaagcaacaagaattacttgcctgaagttgaacttagataataattaaggaacgcagaaattctcctttggaaagttaaaattcagacggaggaacttcaacgtgggtggagacagagcacccccttccccacctgacctttcaccaatgtagaggaaaagatttattttctgaacacatgagttaaaaaattcttaacatacaatgtgttcaacgttgtcaagtttatcgttgttaaataaaaggtgtatgttttctgctctaaaaatggtttgatggtacgttcatgaatgagttaccaaataactcctgttccattctgtaagaatagggtgaactttaaattttcgtttttttcttttcgtttgcttttatgtcgtttgctttgttctattctgtggagataagttttgaaatctttgattgaaagtttatgcaagttttttttttaacggaaaatttccccgtcctttcctgctgtcattcctatttgaatgtatacacttaggcttttatggaacagcacttctgaaaacttcaacagtttcttttatcctggaaaggatttggtcccgtaatagggatttgggggactgtattctggtggtttcagagaggagaaacatatttactattcataatgtttcgggaacgtaccttttgcgatatttttacatgtactcttgtgaaagagttgtactcaatttgaggtgagaacttgcctttcgtaataatctaattaaagttattgattgcttgtgaaatcagggaaaaatgattaattttaatcattttgataggcaggtggttgtctatcacttaatttttataatttaactttttaaaatgtgactttcctgttgtactgaagtagagaacacatctgcttatattgaccatatccaatattttactctcagtattgacaaaaggattaaatgattcatttttaatcctttatgacgtcttgaaagtagttttaaaatatatcctgccatttcagtacacaagcagaaaaatccctaggaaaaagcatatttgattcttaaaactagtactagttttttttttttctacttgtttggtgtgctgaatactctagcaagtaaaatgaaagccaagttgtctattttttcccttgtgtatttatttttacattgtatgtgtgattgctgtcataagtctttcacaagattatccagcacagatagctataatttctttttacaactcttaaaaaggaaaaagaacctttatcaacattgcctttctaatgaaaattgcaaaagatttcagcagggtctgcctaaacatttgtttacactacagaagtggggatcgttccaaaaacctaataacacattacagtctgtcttcttggggagagttgattcttttctaggatatatttagatttctgattgacatgatggaatagaagtgcagctgtagcaagcagtatgctaaataattcaactttggaatatgctaaattcagtttaatgtgtgagtcagaaagctatagtgaaaaagcatttccattgtgtaatgaagatgatttgtttttaaaaatcatgtattgacgtgttaccttaaatttaaaaatttacctttttttcttgtattatgctattcttaaaagtggttaagaatctacattttcgcccaagaattctccctagttggggttgtagactttatacatttataatctcatattgcttaattattccaaagaagttttgttttgagagattacatttttaaagaaattcttaaggtttatatgttttaggtgtttgaagtgtgtgcctatacactaatcataataggacatttttatacttttctgtcagcattgattaggaatgtagaatatatccaaatggaataagtaatgtacattttaaagtgatatgattctcacatgttgaagtttgggtttttagtgataagtttaatgaattagactttgcttcaggacatttcacttgttcatttctcaccttgctttatcttgtctgagcaaattaagcattctgagatagttctgtaaaatgcaagttaaagttgaactaattttatcaccagtatatctatgaaataacttatttaaaaaaatttttttttctgttttgcttattttgagtttaagaaagtagacttggtattgaagaccatagatacatgaatagagggagttctaagctataaaaggtgttcctattttgttgcagttttttgtgaacacgtattcttgaatgagttctaacatgttctgttgccttatagaaagaattgacattgagagtcagctgtaagttccgcactgagaattctttaaccttagggaaatcttttaactaaggttttcttatttgtgtacaaataatacttgatttcaggtattacttgtaatttttgagaattagtcaggggttgagaaccttacatgaaatatctcccctcacatttatgagaattgtaactgaaagtagtaaaagtttgaaagagtatctgagaatttgcgtcttcagctgttgagttgctccaagctgtcttacgttgaaggaatttttaaaaaattcctgtccttctcacactagtagctttgtaagataacatgaaaatagatcactggaaaagatgagggaaagaccaacactcaattttttactatttgattcaatagacataaaattattttgtcaaattgcaatgaaggtacttaaatgctttgaatttccatacttaactaatgttaaccattaggagcagttttggcataagtccatggaccacagtttgagaacctttgctctaaagcctaaaccagtctctgttggaaagtggacgtaagtagtaaataatcgtttatacagatattttttccgaagggacacatctaatttgcactgcaaaatttatcacataatcaaatgcttttcaagttaggattttattaatacttttctttaaattaatatatcttttatttctgttttccttctgccaccccacaattacttattgaatactaccaattatttggcatcatgctaggtactactaaggatattaagataaatgatactcaattccttctctgccattagtctctcattgttgtccaagatttccagtagtgataccatggaggacatggttcttaaggggtttcagaaacctttgccaggctaatgagccaagaagtcactttggcctacatcctcttaatgtattttatgtgaaatacattagttgcttccttcccacaaacaaaagaaaatggagaaattagagaatgctgatttatatagtatttaaaaggtactgtatatcacgtaattttacaaatgaaaaacatgttttatgcatatgaagtataaagtgagtcacataaattcatgttatgacagaacctttcaggagtacatcactttgtaaaataagataagcctatatgaagattattgttgcttcaaagaaatttttacttcttttttgtttttttaatagctgtcttgttaacatctgtcttttaagctgaaaaatgtgcaaagtattttttcccctaatgtacaccatggacttttctggttgtagttttgagatacacggcatagggtgacagatagtgatgtgtgttaattttactcacaaatttttaaaaaaatatttttctgttttggaaagatgagatccttagaaatagggccatgaatagtccataaggtctctgtacaaattagaaaaaggcactccttccttaaaaagcattactactgtctgccagaaaaagtatcacagtaaacatacgaatttatggtatttacaataagaatggccctctagtatgttgtgtactgaacaacctacctaactgtatgtaaatggtggccctgcttgggagccatttcctttatcctttaatattctctttgtgtaaaatgggaatgataactaatacatgatagcaaataatgtaaaatatctctctatttagaaggtattatgtccagttattgatatctgttagcccaatgtgtttaaaattaaagtcaatgaaatttttgaaattaaatttatggctgctccttttcaaccattttgttgagagtatagtttttacgtatggcaactctttgaataatattaaatattaaccttggacctacttgaaagcagtgttctcagccttaaatgtttttaaaggtagttatatatttaaaaaaaattcttaatccaagccctccatggttaaaaatagcttggattggattttctttctttttttttttttttttttttttgagacagagtcacgctgtcaggctggagtgcagtggtgtgacctcggctctctacaagctctgcctcccgggttcaagcaattctcatgccttagcctcctgagtagctgggattacaggcgtgtgccaccacgcctggctaatttttctgttttttgtagagacaatgtgttgccatgtgggccaggcttgtctctaactcctgacttcaagtaatccccgtgccttggcctcccagagtgctgggattacaggcatgagccaccatggtcggctggcttggatatccttaatgtctagtatagtaactatggtattttgaagggttgtctctccattgtgttgatttgttaattttataaatttgatattttataaatatgcttgtccagcttgtatttaaatatgatattgtatagctatacatttatttaggtcctgtacacttatgagggtactcttttaaatttaaaataaaaaatacagatgagaaatacatagtctgagttggttaagtgattcttaggtgctagacactgtcaaacgccttatattaattacctgttgattcctacaaccctaaaactaataacaatatgatatttattgcttcatttttaatttttaagaggcagggtcttgctttctcacccaggttggagtgcagtgccacagtcatagtttactgtggcctcaaactcctgggcacaagcgatcttcctgcctcagcctcccgtgtagctgggactacaggcgcctgccaccacgccggccaattttttttgtatttttagtagagacggggtttcaccctgttagccaggatggtctcgatttcctgacctcatgatctgcctgccttggtctcccaaagtgctgggattataggcgtgagccaccgtgcctggccatgttggtgaatttgatatgcagaacttagaataatgcctttctgaagtttttagggaggtcaggggaagtgagttaacttaataataggacagtactatgctttttggcatcagattatttctaaagaaggttgatgaaaacagcttaacatttgaaatacttaaagttgtaaatcattcaaaatgtctaaaaaccacagtttgcatgggcatgtagatttgtaaaggtgtttttggcattctcccagaagagcaaatccctgaagttagaagtgagagcatgtatactaaaaggagtctggttcaacataatgattgaaagacttcaagaactgatgacttaaattgatttactgttttttgccacctatgtttcatcattggttcacaatacaaaatatgcctttggggcattagtcaatataccaaaactataaaatataattttaaatactatgacccaaaaggaaattttatgccttgtcttttctggattacagaaggtatttagggtgtgtgaatttttttttttttttttttttgaaacagggtcttgctctgtcatccaggctggagtacagtaacgcagtcatggctcgtgacatcctcaatctcctggacttaagcaatcctctcacctcagcctcctgagtagctagaaccataggcacgacccatcacactcgactaatttttttactttttgtagagacgaggtcttgccatgttgcccgcggtggtcttgaactcctggactaaagggatcctcccaccttggcctcccaaagtactggaattacaggcatgaactaccatgcctagcccatttttttttccttataaaatttcctttctaaatacgaaaaggggagaaacatttttattagtgcttcttgtatctttatagtctttcagctacgttttttttgccacatcatttaaatatgtttttatttttcctgttaagttttattttcaagagaaacctgttggctgactataagtgctgaatttcatgacttttatttccaccagtattttttaaacttggcagtttgagtatctgctaaaaatagcttcctgttggtatattggacaaaagaaaaacttctgttcttttattctgtcctaccagaacttagtagagaatgtgttaccagcctactttttctaagtcaaatgacacaaaatgttttttcttactaaaaccatatgttcttataatgggcttttttttcttccctgcttacaggaaatgctttggtcttttaaaaattagtcagaatgaaaagtgaaggcatgtgccttggttcttcaagttttaactgatttgccacctaatatttagcagattgataaaatatttgtcttggctgcccagacagttgttgtacaactataaaataggtaaaattattagaaaacagcaaaacattcccctcccccaaagaaaagcccacaaaaactttaggtctacgggttgggggaaagctgtgttttatcaccctttcatattttaatattttcatttctctagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagtaagtaatttatttaaattattttcctctgaatcctaccctgtttgctaactgaaattgcttcctaaattaacagacatacccagaggattccctttttctaggtagttgattatagattctggtgttcagagctgaccaatttgactctggtttatgtgaaagtaaatatttgcagcaatctgttctaaagagaacaactccaaatacctattgaaatttcacttgatattttttcagacagaatgaccattttaaggcatgaaaagtatacctaaatattcttaagatttaaaatgatgagctgatgagaaaatactatatcaaattttatgatgcatgacataccagcaaaatctgattaatatcaactgtgtagttaaattaggtctttaatatacacctttgaagcattttaatcttaaaaaatattttaaagctagtagagcaaagggagaaaatgtcttcttccttgcttgtaataattctaatatctagactctgaaggattagaaccaaatactaatgttctctgtttcaaaaagagaagggaggggaattggtggcaatgctgtgttttcccttctaagttctggcctctcatttgaaattataaggcagctttggattgaatagaagagaagccgtagtaaccattagaactgggaagtatcattttaggtaaactcttccaggttagtcctgtagctgatctctctgcagccataacaatcagtttggtttacatcaaactgcattttagtcttaagtattgttggtcactagacaccaagtaccatttaaacaagataaaaagaaaaacttacatttattgagttctaaccacgtgttaatcacattgccaagtaattttcctgcattatctcatttaatcctcccaacaacctatcataggcactaaagaggaaaagcctttgaagcaggcgttagtacatgcagtgttataattcatatgaatatgaggtacaaaagaagaggtgttgatgttttaaaaacattaatggctatttattgatattgcagaccacctagagaatgctaaattgaacatttagtgacagaagattttctcctggatactttaaatacataaaaacttggcagagtttttatgaaatataaattttattgtattcatttacatattaaaaaatagactcagaggcggaaaaacttccttgaaattgtttgtcatttgttctacagttacttactgaagtcattactatttaccaagcatcatgctaggtgctaggcttacaagagtgaacaaggagacagggttcctgtcattatagagcttaatctactggggaagattgagtgggaaagattgacttaaataaaacagtaagttcagaaagttaggaagtgttggagtctatatttaaacttaggtattttgacccaaaagcctgtactgtttctaacataccatgctgatgctctagcctccattttatatgcttaaacttattatggggcttttaaatagaatatgtattatccttgccagggcaaaatataaagaaataattgactgcctgctatatctgtcttcacctttctatccctattatctgtttttttattcctcttttttgtctcccttgtttcttaccctgacttatgtatgaagatctctagtatttctttactattgtgaggatgaccagcggagaggtaatattatagcagttgcctagtacttcttccctagagcactgaagttctaaatatgaaagagtggataagtaaatatatcttttttatcactttcattttgtttcattttttagactttaaatattaacacaatgacagcctcatttgaagctagcagcaaatatttggaaggagggaacctttaatacatcaagattaaagttaactttaaattataaatgagtcattttaatatgtgggagtgagaatcttaaaacataatgaaaacctccaaaagaaaagtgaattaggaaatacatgcctgcttacctgtctttcacaccccaattttagaagaaaaatacttgggatggattgagtagggggcaagagagaaaaaaatatattacagtaaatatcactgaaaaatgttcaatttgtggaaatgaatacaaataaaattttatcaatcaacttttttttttttttaaagagacaggatctcaccatgttgcccaggctggagcacagtggctattgacaggctcgatcaggcacacttcagcctagaactcctgggctcaagggatcctcctgcttcagcctcatgagtagctgggactatagatgtgcactagtgagcccagctcaacagttagttttaaaggcatagaaatgtttttatgttcagagaaaagtatcagcgctgatacagggccgtggtagctaaaagtcaattaaatttgaaatgtaactagtacacagctttgcagaccattgaatagactaccaaatcaagcacctttgcagtaaaacctttgtagagacttgaaattatttgaattttttccatgtcacaaaattataccaacttgtagttgattagaccacaaaatataggtatgcttatgttggttgaatttatgtatttgatttgccctgcaattttcttatgaactcttacaattttttttttttttttgagatggagtcttgctctgttgcccaggctggagtgcagtggtgctatctcggctcattgcaacctccgcctcccgggttcaagcgattctcctgcctcagcttcccaagtagctgggattacaggcatgcaccaccatgcctggctaatttttgtatttttagtagaaacagggttgcatcctgctggccaggctagtctcaaactcccaacctcaggcgatccgcccaccttggcctcccacagtgctgggattacaggcatgagccaccgcgcccggccttaaaatgtttttagcgaagctctgttagttggttttgaactctggatattcctgccgtaaaagtaaatatgctattgtgttagaatcaactatttttcctatttctttacaaaaatggatgacagtcattattagggagaatggatggtttctaatttcctaagcaaaatgaagtttttgtttactgtaaaagttgtcttatccttgttttttctaatatctatagtcttttccttacttatttcttcctctttgcctttaaccatatacgggtcttctgcatttccttgtatcccccaaaccctttcatcttttgctataatgatctgtgttacccaccaagcaaggtggcaccttcctgtagtcccagttactcgggagatggaggcaggacaatcccttgaggctaggagttcaaggttgcagtgcataacaactatgcctgtaaatagccactgcactttagtctggacaacatagcaagaccccatctctaaaataaataaataaataaataaataaataaataatgatcagtgctaccattttttgaaaatgtacaatcacttattcctcaaatttaacttctgtcctaccacagaggcatttaatcaccaaattcagtaattttttttcctttcaattcttactcatctgtttttttaaaaataacatttaatgtagacctcttcctttattagtctctgatactatggttacttggatagctttcccccaaggtaatagcttttcttcttccacttcactactgccacctacaccagcaccaccctactcctgcccttcagtcaacaaatttcaagtcagaattcaattaacatgtccctactgtatgtaagacatatgtggtactatagatataaaaaaaaatgaagaatatatcattatgagactgactacttggatgaggaagataactataatatgaggctgaccacttatgagaaagagattctggctgggcatagtggctcacacctgtaatcatagcactttaggaggcccaggtgggagaatcacttgagcccaggagtttgagaccaacctgggcaatatagtgagaccctctctctacaaaaatagaaagaaagagggaagaaggaaagagaaagaaatcccaagtatggaaacattacatcaaattttaggggtacaggagtatgccaactagtaagcaattatcttagctccagacccacctttctatgctctgctttgtgactggacctagtactctgcaagccacatgtttctttgctagctgactctccattagactctgttgccagtatggggctatcgtgggagattgcatggatggaggaagagaaagggttttctcttactttctcttgtctttcagttcctttgaacaacccagcaacacttcttcaccctggttgcatcagttttcctgtagcagagactgaacgcggtttgcattttctctaatacaccaccagcctgaacccgcaccccatccccccactctggcagtgtggatcccaacccttggggccctcctccaagcgcagatatattagtactagcttatctatgcccattcttccgaggcctgagtttcagttccatgaagtggtttcttaagcttctaaattttaaaaattccagcattttcctttattccctcagttttagggttggtggctgcttcctgtagctgctactttcatgacatcttcatgttctcttcctgccttttcagctccctaataacaactttatacttgtttaacaattcttcgtattaaattttttccattccagtaactcatgtgacatctatctcttgattatacactgactgatgccaggaggagaaaatagtatttcagtttgacttgaaggaagggtagaatttcagtaagtggcaggaaatttcacataggatgagtgtcagcatgagtaaaggtagcaaagatgaggaagtatggtgtatatttgggaaacattttgtgttctaggcttttttgaagcacaaagtacatgttacaaaaaaagactatagagaggttggggtagacactaatttggaagaccttgaactctaggctaggaaatttggatttgattgataacaaatgattttttttaaaaaaatgaaatagtgacctgattagaatttatatctagaaatgtttggataataaagtcatgacagattattcagaagagtgaggattgtacatggtaaaatcttaaatgttactggttatgctgggcatcactgttttcctgtagcatgttcattcagaaaatactgagggcctttatgttaggaatgcaacaaagaatatggaaacaatctctattctcaagtgtggtggaaaaaaaggatataaacttagataattctagaacaaagtggatggatatgggaatgcatagggaattatggtatattaaatagagcataaaatatggcttggaaaggtcaagaaagactagctgatttgcatttcagatgatgactaggaattagctatgcataaaggggagggtctgagttggacttaaagaacaattccaagaacagacagagaaggagaaaaggattgttttggcagagtctaatgggaaattgtaagacctttttaagaacaggttcattttttcccttcttggtgtggtttttctgcaaacagatgaaattaaattgtgaaggagccttagctgtttcataggtaattaataatgtatgcatcctggtttcttaaatcctgtggttgtttttaatagaggatatatcagatgaatggattttaagtagtatctttttactagtgtgtatacgggaaggatatgtatatttgtatgtgtgtatatgcaaatgtgtgtacttacagagagggaatgagggacacagagagataggcatatagtaggttagggaattgtaatagaaactcagaaagaaataatggggtagctactgcatacatgtacagtacttctttcctatgaggtagaggtactatactagagaacttttaaaccatataaataaattttagattgaaaaatgtttgtatcaaagttgtaatatgagggtacagaagagtcaagtgaaatgaaaggaaaagaagagggaaagagccagagggaatattgtgggtttttcacaatattggttccactttttcaacttcttcagttgaatcaaaggtcataaattacgtgaaataaaacagggccatttataagagatccaagtttgagaaatttcttagacctgtgtagttagaaaaaagcaatctctaattatatttacctatagagtttatgttctccagatgtgtgacaattacatagtacttggacagtatccaagtatgataataaactgtctgaaattggcctaatctacatttaaccaaagtgtatatattgtgggtttgtaaaaaattgttatttttttttatgttttgggtgtttaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacaccttttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaatggtttttatatttaatgttctatagagagatttctattattaccatttttactattttcaagaatcttaggcccaaaagacattttggtcatttggtatgtagtacctgccttttgtttttgtttactgttatttcaaaaaatgtggttttacttgtatttttataatttacagtcctaagatcgaggcataacaaagcttacttatgcaatattttatttttaggttttttcttttttttttttttttttttttttttagcatttaagagtcactattatgttttgccagttaaaattttttaaatcttttgaagagagaaacaaaatcttcagcgttcttgagaa

SEQ ID NO: 15743 - DNA, 24953 bp, Human
aaaagtcaggaaacaacaggtgctggagaggatgtggagaactaggaacacttttacactgtcagtggtagtgtaaactagttcaacattgtggaagacagtgtggtgactcctcaagggcctagaactagaaaataccatttgacctagcgatctcattactgggtatatacccaaaggattataaatcatgctactataaagacacatgcacaggtatgtttattttggcactattcacaatagcaaagacttggaaccaacccaaatgtccatcaatgatagactggattaagaaaatgtggcacatacacaccatggaatactatgcagccatcaaaaaggatgagttcatgtcctttgtagggaatggatgaagctggaaaccatcattctgagcaaattgtcgcaaggacagaaaaccaaacgctgcatgttctcactcataggtgggaattgaaccatgagaacacttggacacagggtgggaaacatcacacactggggcctgtcatggggtggggggttggcggagggatagcattaggagaaatacctaatgtaaataacgaattaatgggtgcagcaaaccaacatggcacttgtatacatatgtaacaaacctgcacattgtgcacatgtaccctagaacttaaagtattataaaacaaaaagtatagacaaatcttattcaatcttgagttcagaagatagttatatcgggtttcattatagtattcttgctatttttgtatatgttggaattatttacaacaaatgttaattgtatgttacagtgcatcaaaatgtgtttaagtagtggtggtgcttgtgggtagctctttcactataataaaaaatcaatatccaaaaaaaaaaaaaaaaagcagcgcaagctcgttcaatgaactcttaccatcattcattcagccaacaaatatttactcaacatcaggctcaatttctaacttcctagaaagatcttttttcccatccctcccctaattcttaccattttaccaactggttcatctctcttttcaatagctatattgtccccgcttataatgagaatctcattttgcctttaataatctgattcacctcaacgaatgtgaaagattgttgaggaaagctcaatacatgttcaatttgatgtttataccgagtccaccaccacacgtgaaatttaataggggtaaataatctcgaccacctctaaaggggtgggtgataaaagctttctgtgatctcaccggctcaagtgtcctctttaatctgaattcatctggagaataactgccctatgatgttcttataaaattacttgtttcctgtgcttagaacttgtctctgggtagagtgtacgcgtctcaagggcaaagactcagtcttgttcgttgacttcacacactgccagcaaataatgtgaatcaatagacctttaacggatgaagaaaaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggaggtgagcgtggcgacactcgccgcggggctcccggggcaggcctcgggcggggccgggcggttccggcaagggagaagcgcccgcgggcgagggagggtggcagggcctcgcgcgcacctgggctccgcccgcggtcagatgctgaggccagtgtcgacgcgaccttgggtccaaacccgctgccgagggcaacgcgtctaaaaaacttagccggtgcagctgcgcactgagtgacacctctctcggtgcttaaggctggtagcaaaactctcaaacatcctgggtccctcttcctggcacggaggtcacagagggccaggacgtcgctccgtctctctccacatctctcgcttccttcccccaccctgtccaggtaaaggaatattttcggagattatcctttggtgcattcagatgaagtagtattcatagtacacctaacttttagaatgttgacattagactctctattgcagtgaggcaaatgagtaagcactcaattttggctttggaataccctaaataccctgactttagtcattacacattttatgcacttatctgtgcatctatgtatgctttatcagtacacattctatgcatgtaacaatatcattgtacattctatgcatgtaacagaatatcacatgtgccccataaatatgtacaaatataatctatcaattcaaaaattaaagttttgtaaaaactggaaaataaaaagactagtcactagttggaggtgacagagattaatctggaattacaaacttgttacctatttgttggccatttctgagcggatagtcatccactgcacattgtgcatattggtggtatgggacaattttagtatttaaaaaataacaaaatctttagatttaggagctatatgactttggaaaattactttaaagttggataataacaccttcctcatcaggttgttgtgagaattaagaggtaatatatgaaaacgctcaccatgcaggcatctatctccctgtcatctggttccatcagaaagataaatcttaattaagagaaaaaccttcctaaactatgtgtgtttagaaaaaccttcctaaatcagctgtgttcctaagtggtttctgctctcttctatgagatgttggtaacagaccatgcagcagcacacggcatccctctgagttaagtgctggacctgtgcccaggcctgttgttggggtcagtgcccatcaagagatgagaactcttgcttgtaactttagtaggaatctgagtctgtaccatattctgtgttcacgttccagctcagtgtgtatgttttgttttatttaaaccacctactttggctgtttctcccacagataaatatttctgtattcggtacatagactcttaatttcttccagtactgttggtggtagttcaatacagaattttgcacgtatattgatattattgggtgaaattttacctatctcacaatagcatactctaaagtagtgactcaaaagagtttctgactgcaaacacagtaagaagtacattttactttgcaatccagttaatagttgtataatcagtatatctgaaacaggtttcacaaaaagatattagcccttataccgtatattctgattttttcttttattttaatttttaaaatgttgatttcttgatgctcagagtcacacaccacagtttgtaaaacattgttcaaaggactagttctggtttctagtgttttatttagggtgcttcataacagtaggataaaactaaagaaactagaaaacatttcaggaaaacttgaaggaatggcatcatactgtagggaaactatgactgcttggtaagagcaaaaggggaggcacattttgtttctatgtaaaagaactttgtaacacccagagctccaaattgggatgtactacttggaacagttccgcttcactgaagaaattaagtaaactgaacaaatcacttatttttgagaaaatgtacgtgttgggtcaagagttcagttaaatttcttacaaggtctcttctagttctaattttttaaaaaatgttatgacctctgcccagattttttgtctcactggaattttatgaaatcaaatagtttgtaagtggaccattataggactgttttgcccagttctttgttgtaagggtgtttgaccggttgaatcatggtatttaaaaaattcttatacaactccagatctaatggtaggctaagttgtggtgatgcttatactcagtgatattgggtgtgtattataagaatgaagagagcggagaacaaacataaacattaatgttaatgacaaacattaacccaagtacaaggttaatgtttagtcaatatagcaaacatgtaatttacaagattaaaaataattaggcttgtgataaagtcaatgaatttcctacgtaattgtaacattagactgttttattatttgtcctgacattttgcagaatccaagattaattaaagaaatggtttcaagaagagggtgaatactataaaaatagacttaccttcctgaattgaggaattcatcaggaaagcctcaagtgtgcaaatgagccatccttccagagggaaatttcttagaattatcccacgatttgagccaaagcacttccgatagaatttttaacctctagttggttctgctccttccatttttactaatttttaagaaaatactatgacttataattgtatctggaatgattatcaactccttttcatccactgacttaaatttgattataaatatgctttacataaagatctagaccttataatttgaattcaagtgaattgttgtgactagcatgtaaattattattatggattgtaaatcttaacataggtagttctgtgcccttaaattgataaaccagttatctcttgtaatcatgtgtactaagatatacgtagtaaagtgattgtatcagtttttatcataagcagtcatagttcagatagttcagaagtttagtgtctgctgtttctattaggaaagtgcttttgcaattcaggggcttgcctctagttactcatttgtgttttcattgattgcccacagaagaatgcaaaacactgtgtccttggttatctaataaggcagtgatttcagattgccaggtttggcccattagtggtcataaatcagttcagtgagtcatggaccagtatattttttctaattaatatattggaagccattagagtgcctggcatgttgtgagcataaataccgctttatgactgttttgttccattatatgtatataggtctttgctcactatgtgaatgtatgtcttactttggactactatcaaataagtctgaaatacactttaataaagtatgtttgaattaatttacaacatactataatatttgtataaatttttttttgtttatctaagaaaacatggaagataggttagaggtgcacctaaatgttacgaaatgacttctggagtgtcatacaagttgagttctgcaagatatgtctatcctggtggttctcagactttagagtacgtagataaagtactctccttaggatgcttgttaaaatgaaagtccaaactgctcttggagaatgattcagtgggtctaggattaggctcaggagtctgaaattttaataaacagcacaggtgaatctgaggtaggatttaccagccacacttattctctaataatttaatttgtttgtctttgagaaatgtagcatagttgtgatatgaattctagtcagacagcctgggcttgactccaagttcctttgtttataaaccttatttttgtttctttatgaatgcctttttttttttttttttttggaaatagagtcttgctctgttgcccaggctggaatgaaatggcatcatctcagcacactataacctccacctcctgggttcaagcaaaattgtcctgcctcagccacccgagtagctactacaggcttgcactactaggcccacatgatttttgtatttttagtagagacagggtttcaccatgttggccaggctggtcttgaactcctgacctcaagtgatttgcccccctcagcctcccaaagtgctgggattacaggcatgagccactatacctggcctatgaatgcttttgtgtctcaacagttagcttaaattttcactggtacaaaaaaagctttaaagtaattagacaacttctttagttcaagaacatttgagaaacaagagtaggatgaaaacaggcctgaatttatgtatgttgaaggaaacaaaaaccttgtaggattaaaattggggtttgtatggtatttcctgttgctatcttttttttcctgcttatcaaattaatatattcttattgtagaagtacagaaaagtatatagactttgattaacagtttcaaaatgcattccttttgcagcttcatgattgtatccaaaaaaccttgaatgaatggagttcccaaatcaacccagatttggtcagggtaagtgaaatgtgaatgcaaaaatcatgcaggtcaaaaaggaagtaaagtaaacaggaagttaatttcttcagttttgtgagggaagtcaaataggcaattagccataaactctctgtggttgatttgctgagacggcactctgatccagtaggcttatgcataaaacagaaaatctagaccgtaggcaactctttaaccagacaagatactaggattctcatgcttaattctcaccatggtttcctcactatcagtgttttatttcagtttatatttggtctaggagaggaatgattatcaattgtgattggtagattgctttagtagactcaacatcactagaagtaatttttcaaatgtcagtttctgatgaaacaataaggaactgtgttccactaaatgtcagtatatggctactatcataaatgttaatgttcaaaaccctaaaacacattttgaaatccaactcagtcaaaggctcacagcacattacttaggctactttaaaagtatggaaaaggacatgtgctggaaatactggttcccctgggcatactgcaaccatgtaactctatagctactatatagacattgagttatggttttttttaaatcaatctctgtttctctgaaatgactgtttattctacttatgcttgacttgtaaacacttactgaacccctgatacgtgctgtgaaagtgctcaagaatcatgggaaagcctttgccgtttactttgtatgatattgtaaatgtaagttaatatgtatctgatttatatgtactaatattttctcattatccttgtaaattattcattaaaatacattcaaatagcctttgcttttttctgctgcactcaggaaaaaaaaagttttggtttacaatgcttgtgattacaggctgggcgcagtggctcacgcctataatcccagcactttgggaggctaaagcaggtagatcacctgaggtcaggagtttgagaccagtctggccaacatggcgaaaccccatgtctactaaaaatacaaaaaaaaaaaaaaagccaggcgtggtggtacccgcctgtaatcccagctactcgggaggctgaggcaggagaatcacttgaacctgggaggcagaggttgcagtgagctgagatcacaccactgcactctagcctgagcaagagagtgagactctgtctcaaaaaaataataataataaaattaaataaataaataaataagaataaaatgcttgtgattataaaactaaatatactattgtcataaaatcagcaattatgctccttagtatctacccaaagaagctaagaacttatttccacacacagacctatgcatggatatttatagcagctccattcataattgctaaaatttgaagcaaccaagatgttcttcagtaggcgagtgtatatataaattatgaatgcatatataaactatccagacaatataatattattcagtgcttaaaagaaatgagctatcaagccatgaaaagacatagaggaaacttgaatgcatatttctaagtaaaagaagccaatctgaaaaagctacataatgtatgatatcaactatttgatattctggaaaaaacaaaactatgtagactatagttttgctagtctagtaaaaaaactagtaaaaagatcagttgttgccaggggttagcagggacggagggatgaataggcagagcacaggatttgtatgtcaatgaaactactgcatatgatattgtaatggtggatacatgttattatatggttttctaaatccataaactatgcagcaccaagagtaaaccctaagataaactggacttgggtgattatgacatgtcaatgtaggttcatcaagtgtaacaaatgtataccactgtggtgggtatgttgataatgggggaggctgtgtggatgtgagtgtagggagtgaatgagaaatctgttcaatctaccttctacttgatattcttgtgaacctaaaactgctctaaaaaaaaagtatatttaaaaaaaaaaaaacaggctgggcgcggtggctcatgcctgtaatcccagcactttgggaggccgaggtgggcggatcacaaggtcaggagatcgagaccatcctggctaacacggtgaaaccctgtctctactaaaaatacaaaaaattagtcaggcgtggcggcgtgcacctgtagtcccagctactcgggacactgaggcaggaggatggcgtgaacccgggaggcagagcttgcagtgagccgagatcgtgccactgcactccagcctgggcgacagagcgagactctgtctcaaaacaaaacaaaacaaaacaaacaaacaaaaaaacccaaaaactaaatccccttacaggttaaagttcaaataacattaaaatccaaataaattaaaaagtaaaagaaaatgcttgtaattaatgtagaacgtgtttattatgtcatctagagtggatattattttcattggtttctttttagagtaaaattatctgctgtgctactgtttctaactcctcacatatccctccactgcttgtttatttttaatttttttgatcatgcttctttctaaatacctggtcaaaatgagatacattttcctagaaaatagatacacacacacaaacacacacacacaccccactttacctttatttcagagctttacaacccttgtgaagcccacccagacctcaggtagagaactctgttgtcttataggttctctgattctaaaaggcattatggataatagaaaattttataattaatcagaagcattaaattttatatttgttttaaatattgtgtttattataggagtttccagatgtcttggaatgcactgtatctcatgcagtagaaaagataaatcctgatgaaagagaagaaatgaaagtttctggtaaagtccagtcttttctgtttattttgttacatagcggaagcgatagattttgttaggcattagaataagcctttctttgctcagacactaaatgtgggaaatacagaaattcttttttagcataattttacttaaactccaagatggagttataagaggtcagtgctggctattatataagagtcagaatagaacttcaacttgctgttcttcatgatgatgtcatcatgtcatgtaatttatgtgtcaaacttcagagcagtagaaagattaagatgaaggagatggaaaggataaagggaaggcttagaagcagcatccacccaaagcaagcataagcacccccttcctggtaagatactggtaagcaatgtgtgaggtcacctgggaatataaaaagaaacctgggcaagttacatgaagagaaagaaaatactgtaacacccattcaggaaatgtagtaagtgacaaattccagaaactgtactatactcaaggaatacaaaaatgaaaagatgcgccatctctgccctcaccttacaattagcatagcatagtcattaaaagcttgagctttgaagtttcggggtgtgcagattacaggctagtataatgttgggctaacaaagactttaacctccctgagtctcagttttctcttctataaaatggggatgtacctgtttctccggcttctttgtaaactggatgaaataacaaaagaagcacttagcacagtgtttgcctcaaagtaagttctaggtagctattatttgctaccatgttgttattattgtggttgttgctattttattattattgagatggataataataataaattacatgtaagatgagatagggtattgtctctttttaatctaattatagtaactaccatttattgagtcttgctttgtgccaggcactgtgcttggtactttatggttatattttctcatttaattctcaagacaatcctgcaagttaagtctgttactgcattgcattagtgatactaaataacttgaaggttgtcatacaaccagtaagtggttgaaccaggaatccactcaggtatgcctaactccaaaacccattttttcctgttaatttcacattgctgtttgtgttggaaaggacgtaaagcaacattctttctgaggttgactgtaattcatgatttagttccatcttgggtctcttagaagtcctcagttcctagagggcttgagatttttttataggtatcaaaattctccccatataaagagctttcctctttctacctatccaaaaaagcctcatccttcagagagaagaggccatttcagatggcacaaattcatggacagagaaatagtattggggggggctttcatagagttataggggctaaagttagaccaaaatagtaaatactgactctcatctagtagagaagctaggatggctgttcaatagggagtaatctcagggaagcagtgtttttagggagatcacctagcagtaggaaggaagggactcatataagaaacgtagaagaaaatgtgttgcatatatcgaatgtcagcactttatgtaagggtatttcattagccttatttttctccatttcctcttttgattttttttgttgctcttctgctactctacctgtttgtctattgaatacatttatttttttgaacagtgagtttacataaagtaaatatgtacatataaagttgaatttgaatgaaaccaaaacctcaatattacaaatatagaaaatgactcaactttcctagtaaccaaagaaatgacaattaatgtggtcttgggtaggtatgcattgtacctactaagttttaaaaaaaaattaataatagcatcctatgttgttagaagagcaattgttaattggtggtggtgtggtaaactggcacacatcttttaaaatataataagactcacacaaaacgtcacatgctttgactcataataacatttctaacaattcatccctgggaaattatatagtataatgctgaacaaaaagttactaagatgtttgttttggcattatatatgcgaaaacagaaaactggaactagtactggaacatttactaacctaaatgttcaataagtagaactcatttaataaatgacactcttcaaaatttacaaaataatattcaaccattaaaaaatgagcatgtaaaattggctgggcgcagtggctcacgcctgtaatcccagcactttgggaggcgagtcgggtggatcacttgaggccaggagttcgagaccagcctggacaacatggcaaaaccccgtctctactaaaaatacaaaaattagccaggcatggtggcgcaggcctataatcccagctacttgggtggctgaggcatgagaattgcttgaacccaggaggaggttgcaatgaaccaagatggcaccactgggcgacagagtgagactctgtctcaaaaaaaaaaagtatgtaaaattatacactaaaaacatagaatacgttcaaggccacccctaagtggaaaaaaagccacagaatacacagaaatctaaacagttatttgggtgatgagactggcaattctttttggtctttctgcttttataggtcttcgttatttctacagtaagcacatgactattaggataaaaaaaatcttggcctggtgtggtgctgtaatcctagcaccttgggaagattgtttgagaccgggagttcaagagcccctgggcaacatatcgagaccctgtgtctacaaaaaaatgaaaattagccaggtgtattggtacatgcctgtagtcctagctacttgggaggctgaggtgaaaggaacacttgagctcagaaggttgatgctgcagtgagccgtgatcgcaccactgcactccagcctggatgaaagtgagaccctgtctcaaaaaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagacatatattttaaatatttattacataaaggtaaaccaaatagaagaggaaataatgttatgccctacttcatatgaccaaaaactggaagatagtgtctgaaaatgaaaatgattgtattgggaaggtagaattgtggccttttttttttttttttttttttttttcagttttcttctcattacattttcaatttagtctttgtatatagattttggtttattggagaatatataatgtgctctattaatgtttaagtcataaaaatataaatttcaagtaatttaagctccaatagttatctaacctgccttctaataaatgggaaataaatatttactttttgttttgataaacatatatttgttggcaactagcacatgattttaaaagtatagtggaactatacatttatgtcttaaaattaaaactataaagttatgtgactgggaaaggaaaaataattcattcaggattatctgacatcttagtattatagtagtgttaatactagcatatagtgaaatgtgtatccaaatgtagtaatcagttttgttttctttgttacccagcaaaactgttcattgtagaatcaaactcttcatcatcaactagaagtgcagttgacatgggtaagcaaaaactgaattttttatcttaatagtggactttaaattagtataggtgtattagttataacttgtgcttaggtccaggtaaaaagaaaatgagttgattccaattttaccttttaaagttctagcttagtttcttaaggcttctgtaaaatcatactgacttatgtagggtcatattttgatatgcaagaggaatgtaaaaggtgtaatgtacttaaatgttcactatccgtttggagatagaagttcttattcttagcccttttagtactagaggtgaaatatcaaaaccaaacaacggcaaaaaaaaaaaaatccaaaaaaaatccaagtatatctgtttttagcacttaggttattgtgatattaaagttattcaatacttaaataaaaaattattccagtatttacatatattgaaaacttaaataattggctctttaatgtaactttagaatgaataatcatttaaaataagctcttaaattatttttatagaattaagaaattatctacctctataaatatggattaagaccaaacattcagtttttcagtgtctcaagcttattctttgctgtgactactagttacagaatattaggtcataattcttgtgatcatccatatgcgatagtagtgagcaagtagaactggagaagaaaattttatgaagataagggagctactaaaaacttctgggacctaggaaacaagaagaaattttgttccctagaaagaggagcatgtagtagtagctgcaagctgcctaggaataaggcaggtcagagaaacccacttgtctgccacacagagcaagtaggtaaatgggcacttacacatttttgaaagatagaaatgttctaaatgaaaagtaaactatgaaataatctgttattttgaaaacaagtgaagaatatggacagaattcagtgggatactttgaaaacattagaaatatttgtttttatgatgtaagcatttattttctttgtgtcttccttcctatcagcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtgagggatggcaggatcatgagcactccaggaagaacttgcccttttcagtctttgctgcacactgttgagcatcatgcacatagtggccacccctgcggggtgacttttccacatgtgggagttttgttttgtttctgcaggagttttgaggcaggttttatctaaatcatttgaggtttttgtttgtttttatttaaatatatctctgattgaactgaatgttaatcctggttaaaatgagtgacaaaaatactagaagatgtgtgttaaaacatttataccaaatgaattaaggccatttccttcagttctacttatgtgctgaaaacaataatacctaaagaaaaaccttacggccgggtgtggtggctcacatctgtaatcccagcactttgggaggccgaggcgagcagatcatgaggtcaggagttcgagaccagcctgaccaacatggtgaaaccctgtctctactaaaaataaaaaaattagccaggcatggtggcgtgcacctgtaatcccagctactcaggagggtgaggcaggagaatcacttgaacctcagaggcggaggttgcagtgagctgagattgcgccactgtactccagcctgggtgacagagcaagactctgtctcaaaaaaaaaaaaaaaaagaaagaaaaaccttctttttctttaggtactattagaccatggctctaatttcctaagtaagggaatattttatatataacagatattttgctgttattcaaagatgtgtaagactgtcagttcatacaacttgatatggagtgagtgtcataaattaattattcccactctctggtctaataacctacaaaattattaggaaagtcacttactagcgttttacctttactctcagtatttctttattccttttacttcttcttcagccttctccttttcagagctttcagagtttcttatggacaggaagacctagagaaagtatttccccttctccttgatgatagccagaatgaggacaagaaagtattggagagacttagatgattcagaatgtaaattaaccagtgtagctactggaagctgtcaattcttctctttcaaaatgtgtctgattcatagccatattttatactttaacattaaaggtatttacttgtatttgatcctttacctttaagaactatttgctctgtagctgaaaccatcacacttaacaaactaacaaaaatcatgtttgtgttctaggcagatgtattagattgttaaatggttctagcaggagactttttaatagtgtagtaccaggctgggcatggtggctcatgcctgtaagcccagcactttgggaggccgaggtgggtagatcacctgaggtcaggagttcaagaccagcctgaccaacatggtgaaaccgcgtctctactaaaaatacaaaaaattagctgggcatggtggcaggcacctgtaatcccagctacttgggaggctgaggcaggagaattgcttgaacctggtatgtggaggttgcagtgagccaagatcacgccactgtactccagcctgggcgacagagcaagactccatctcaaaaaaaaaaaaaaaaaaaagtgtagtactgttggctttttcgttcccctagtgttacacttcctttccctattacatagggaaaaggtaatagggaattcctattccctattactactaacctgggttagaaaagcatatattaataaagatattaatgtaaaagtattttgtaaactttaatcactgtggattgtgatttttcatatgttctaaaattaagttattttattgcttattgctttctacttttggtattatatttaatttagtagtgatatcatgattttattttcacttctaggtaaaaccaaatagtaaccaagttaatcttgcctcctgctgtgtgatgccaccagatttgactgcatttgctaaacaatttgacatacagctgttgactcacaatgatccaaaaggtaaaactgatattttcattatagagattgatcataagcttttgtcttacaaaaaggtatttgttgatacataattttaaatgtggacagtgataaaaatacagtgttatctgaactattcttaatggttagttcaaaacctatatgccctcattttattttcagaaaactttatctctgtaccaatggggaaaaaaaagtgaagggatcatttcctgaacatctggtcttttgaggttcacaaatattaaactacacagaaaagatcttttgagacattctaaatagtaatatatataatcctatctagtatagcaaagactggaccaaaaggccacttgatttttttagttttgagatggagtcttgttctgtcgcccaggctggagtgcagtagcatgatctcaacctgactgcagtctccacctcccggactcaagctctcctcctgcctcagccttccgagtagctgggactacaggcgcataccaccacacttagctaatttttctattttttgcagagacagggtttcaccatgtcacccaggctgggcttgaatttctggactcaagcaattcccccacctcggcctcccaaggtgctgggattttaggcatgagccactgtgcctggacaaaaggctactttattcaaggagataaatatctggaaaaagtggcacatgtaatttaattcaaaacttaataagcatcttaggataggtaagtaggtattttattaagacgtttagtgttaatcagaaatatttgattaatgagaatggcttgtctgccttttatagaataattttttacaacattttgtaagataactagaaagacttggaagataatattgaacataacttgcaaagataaatgtttcagagagcctgtatattattaagtaatgtatattactacatatttttggtataaatgagaaatgtttggttataagtgagaaatgtcttgtgaaagttttaattctcgatgacatttttatagaagttctgatttaataaatattagaggaaattatatttcatagataattcccgccgaaaaaatattcagcttttatttccatacctaaaaagatgacacaatatcagtgggttgattcagtttgctcattttaagaatgctatggataatctattaagactttatactatttattagcagtctacttcattctcatttcttcactgtttcatcagaggagggggagatggaggagaaagagttttaatagttatttttccttgaatgccaagcatcatgccaaatgcctcagagagattatctataatcctcacaacaacggaaactatacattttttttgtcaggaaatagagcctcagagtgaaaggaactagccaaggtcacccagctggctttgggcaaagtttgaacttggcctaagtcttggattattttggagccttttccactatacaatctctttgatttgaaacattagtattacagtattacagtctgaaaacttcatccattttcatttaaatcataccagaataaaatacagtgacttttgccttcccagtagagctttcacaatcaagtaaattgattttttaagccattttagtgaaaatctaacaaattgttatgctgatttattctgaactataagtcatttaaattttaactttccatatgttggcagatgtcatgtgtctgtttactttttggaggctcttctaacagtaattgttaccaacagctgatgatccagcctgtaccctcttctagcttcacttgaaaaaaactcaatccttttactagtaggaaaggaagtaggaaaagattaaggttcctagtgttttattttcacatatctaaatgttgacatttagaatgtgtgctaatacattattgttatggcaaaatatattgcatatgtatatgaggagagagatttaatccttttttatattttttgtattacataatttgatacttagttgtcttttttaattctaagacttttggtgaaaatgtataggcttatcctgcatttatcattaatgaaccttcagacactttaatctataatgaagcaactctcgatttaatttgtcatgtttactgactaaagagttcaaccataattaaattttaaaagcagttaaatgaatagcatagtctctgattttgtgtcatattttttatttttttaagcaaccaaactgaaaaaactgtaaaacatttaactctgtaaaatttaactctgtaaaactgtaaaacatttaactctgcttgtcatctaaaatagaattttgtttataaattccctgaaggtctacccctgttctaaaaattacccttactccccataatgggtttattttccattaccctttgttctagaagtgtaataacaatttaactagagagtaaaattgtaaagtagatgatcctgaatttagaactttccatttttatttgttccccgccccccatttcgattaaatccaatctgtattatgtctctttccctcagggtcttctctgttagaaaatctgataaacaaatccatattaatgttacttttccaaggagacatttgtgttctatatatgaaaactaccatttactagtggtgtgaccttggccaacttaccgaacctctctgccttggtttccccccataaagagataatagaatctatctcatagggttagcatgtggattaactgagttaatacatgtaaagtactcagaaaagtacctcgcacatgaaaatagctaacattgattgagcgtttactgttaatgctattcaggtatcacagcagtttgggagtaggtgggtcctttagcactccgaaatcaaactgtgaagatgctcacttaatccctatctgtaggttgcttctgaccccagtggaatctttccatattgattgatgcatttaatagacgtttgagcaccatttgccagccattgttctgggtactagagataaaggatcaagtcagacaaaaaccaaccctcatggaatttatattctaatgggaggagacagacaataaaataaatgttacatatgataagtggtagtatatgctatggagataacttggctgaaggagaaagagtatccaagttaattgttgttttatatggtacagtcagagaggcctctctactaagggaatgttaatcagagacctgcaggaagggagtgagccatgtgaatatctggaaaaagtgtgttcaaggaaaaggcagaagctaattcagaggctccaaggtgtgaatgtgcttgaggttttcaggatacagcaaggaggtgaggccagtgtggccagaggagtgaggcagtgaggagaggagtggtgggatatggcatcagagcagtcatagagagcttggatataaacttggaatttgctgggcatggtggctcacacctgtaatcccagcactttgggaggccaaggcaggggatcacttgagtccaggagtttgagaccagcctaagcaacatagtaagacctcatatctacaaaaataataataataataattaaattagctggccttggtgacgcacacctctagtcctagctactcaggagaatgaggtggaaggatgcattgagcccagaagtttgaggctgcagtgagctgtgatcatgccactgcactccagcctgggcaacagagtaagacattgcctcaaaaaaaaaaaaaaatagaaaagaaaaaaagaattggcactgcggcactctcaaattatcaactgctggtagaagtgtaaagtatagcctttctgtaaagcagttggcaatatagcgtgtatctagctttaagaatgtacttgtactttggcccttcattccacagccaggcatgcattttaaaatgttcatcatctgcatcattgtgacggtttgtttcttccatatttggagataaatttatgtgtagactttttttttgtaagacatagttgataatgaaaatttatttaaatggtcttgcaatgatttaagtattcaaatgcttaaagaaagcattgctggtacaaatatttctatttttagaaagggtttttatggatcaatgccccaagtgtcatcagagccattggtgttttcatttttaaaatgtcacctgtaaaatgggcattatttatgtgtatatggctttttttggcattcctgataaatgtattatataaagtctatacattggataataacactagtatatttaaacttacagacttatttgtaatgcaaaccaccattttaatgtactgtaattaatatggttataatatatatatagtccttctgtcctaccatcacacaactttttgtgtgtgtaataaaccgcttttggtttgaaaatatttttcgaggccgggcacggtggctcacacctgtaatcctagcactttaggaggccaaggtgggtggatcacctgaggtcaggagttcgagaccagcctgaccaacatggtgaaaccccatctctactaaaatataaaattagccaggcatggtggtgcatgcctgtaatcccagttacttgggaggctgaggcagaagaattgcttgaacccgggaggtggaggttgcagtgggccaagatcacaccattgcactccagcctgggcaacagagtgagatgccatctcaaaaaaatatatatatatatatattttttaaaaaaagaatgtttatcctggcattattcttattagcaaaatattaggaaaaacataaatgttttgaccaataataaggaaatatatgaattatgatatctatgtaatatagtaatggggaaattattaaaaatgatcttttcacagactattacatgggaaaatattcacaatataagtggaaaaagataagcaaataaggctttaactacagtgtgatttctaattttgtaagatatggatatacacacacacatacagatataagatctagagatatatagagattcaagatatggatgaagatatatatatatatatgaagatatatactcatatacaccaaaaaagttgtaaggaaatgcatgacaatgttatatcatctccaattgataggattatcagttactttttttttctttagactttcctgtattttccctgactatacattagaatcacctggagatctttaaaaaactgcagatgtctaggctccactcaccaaaagttaagaattaaataggctggggtacaggtgtagatactttttaaataactgcctgggaatttctaatattctggttcagattcatagcacacacatgaagaataagcatattatatattaaatgttgaggtgtttcttttgttatgttaaatgcttacctacatactaaagtgcttttttgttttccaatttaacacgctggagttttgtttgttgttgtttcttttagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaattttttgatgagtttttacttttacctctctactcttgattttctattattgaatactcttttaaaacactgatttttaaggctttatatatgttttccaggct

SEQ ID NO: 15744 - DNA, 64049 bp, Human
cattgtatttatataccacatattctttatccattgatctctcgatggacatttaggttgattccatatctcttactgttatgaataatgctgcagggaacgtgagagtgcagatacctctttgagatactgatttcatttccttaggatctatacccagaagtgggaatgctggatcatatggtagttatgttttaattttttgaggaacctccatactgttttccataatggttgtactaatttatattcttctcaaccaacaatgttcaagtgttctcttttctccacgtccttgccaacagttatcttttatctttttgataatagtcatcctaagaagtatgagtattatcccattgtggttttgatttgcatttttctgatgattagtgatgctgagcattttttcacatactagccagccatttatatgtcttttgagaaatgtctatttgggtcctttgctcgttttttaaaattggattgttgtcttgctattgagttgtttgagttccttatatattttggatattaacccctaatcaggtgtatggttgcaaatattttctcccatagtttatctcttcactgcattgttttgtcgtgctaaaatgcattttgtataacagttttacaattcataaaagattttaaacatataaataatcatatttaaaatatcgtataatacaactgaaattagaaataataataatctacgtgctttttaaaataagcgcatctattgtagttaagtttggctttttagtcttgtttggtgtcctggtatcttactactgaagatgtgcattcggcagatcatcggagttcaaacagatgttgaacatagagggttgaataatgtatgacccctgtagtagactcagattcccctttaaagaagggtttcctgcccagctgtgagaaatgtgaaatcctgacagccccctctttccccgcctttgtcccccaccttagagtctggctcagctctagagacactcccctctcctcatgtcacagacttcctggggcagcatgcatttgcagactgagcaaggcggaggtaaaaaaggcctgaccatttcagcccatcagagagcactctgatggacagtgcttgctttagaatttcctatatggttggctgaagttattttgggcttgcatcagtttgagttctgtccaaacctgatttctctgccttccattcacaggtgttgatccctgatgaacatttgtaccccagacaccatattacctcagcttcagagaaaccagcctgcagtagctcctgatagcatggaactagtttaatggaagggaatatacatccaacaagaaatttaaaacgtgatcaatgttatgtagaagcatagggtgccatggtagtgcgttatggaaaggaccgatgcccagctaattatattgttttgggaggtagcctagactagtagtcagaatatgaaccttgggcatactgcttactctctccaggccactttcctcatttgtaatatgggaatgacacatgttctgtcatcctttagaagactagcctaggattgctcacatggttggggaaagattcccagcagtaagagggagcaatgcacattttccaagcctctgtttgtgtcagtttgctgatgtcccattggccaaagtggtttacatggccaagctatgattcaaggatgaagaagtagacttgcatttatgtttgtatttatacacacacatacacacacctaaaaattaccaaacagaatgtctgttacataatagtggtagttaaaatttattaagcactttttgtaaataatgcctagtaagagtcaggtggactattattatttaatatgttctatctcactatgatgtgaaaaagaagaaacgcttttaaataatttggtatatttgacatcttaaaatcatcttaatgataacacttttcacataaagtaaagctctctctctctttttttcctctgcagtaagaaaagtggaaaaccaccattacagaacaatgaggtaaaagtttaaatcatcttctttttgggatttcatgcatttatttcatttattttgtcatatgattctgatttaggattaaattttataattagtagggaacttaaaaatactccagtcttctacacattacaggaatactctctgaaataggactcctgacaggaaagtgttactctaggaggcagcattaactgcattagttctagcccatgatgatattagtttccccccctcttctagcttcttagcagtgactctgttatatcttttgtatcgagatatatctttgtcccccctcccttcccctccccgcttccctcccctcctccacctcccctctccttttctcccttcctgtcccctcccctccccttccctcttttttcttttcttctcttttcttcaaaattttctttttaccaaccaggtctcattctgtcatccaggctggagtgcagtggcatgatcatagctcactgtaaccttgacctcctgagctctaaggatcctcctacctcagcctgaagtagctgggactgtagatgtgagccaccttgcctggctctgttttctctagtacacccacatatatttgaagatagttgtatcttacgagtctttcttttcctgtgctaagcaatcttgattccttctaatatgtctcatgtgacatgggttctgatcctttttcagttctgtatacattcctttggacctatactagtttccttaggcattgtgcttagaatggaatgtagttgtccagttatggcctgactagcatggaatatatcagcatgattacatttcttgatatgaatacaatattgctaaaattcatcctaaaattgcttttaattctttaaccgtaactattttttacattaagtggaatttatggtaaattataaacttcaggtgtatttttgacaactctatatctctacatgttatattcatgatagatttattgagatatatataccataaaatttatccatttaagtgtataaatgagtagttagtgtagtcacagagttgtgtggctatcaccactacctagttttaggaaattttcatctctccaaaataatcctgtactcattagcagtcattccttattaccctcttcccccaatccctggcaaccacaaatctgtttctgtccctgttgacttacctgttctggacatttcaaataaatgaaatcatataatatgtggctttttatgcctagcttctttcacttagcacaatgttttcaaggttcatcatgttgttgtatcagtattgcattcctttttattgctgaatagtgttctttgtatgcatataccacattatgtttatcagttcatcagttggtggacatttaggttgcttctactttttggctattatgaataataacaatgctgctatgaaaatttgtgcacaagtttttatgtagagatatgtttttatttctcttgggtgtgtatctaggagtggaattgctgggtcatatgttaacgcagttgctttgttttagataaacattaatttattgcggtaaatgtcagcttattgggtttaacctactatctataccattagtctaatttttagtgcaattctcacatctggtatgttaagtagaagaattatctacaaatttaatttgcctttcctttctttcacagaactgctgatagtattgactatgtaaggaccaaggagattgctctgtgacatctcttaatctttgtttctggttattcagctgtgactacatccaactatagcaaaatctggttcttatttctccattgagaccacaataattttataagaaacatctaattcctttattaatttattaattcacttagtaagtcagtctttcagtaagtaataagtttccaccctcatggagcttacattctgcatatcagctagtatgctagttatggtatccttaacaaataagaaaattagaacaatttaacatgacgtactttcagtaaactgatgctggcttctagtgattagtgtctctcaagtcttccccaaccctccatgtcagtgtctgttctctgaatatcctggtgattgacatcaagattgttgttctttagtctctgtaatatttccttcctagtctttgaaaaatgtgataagatgtgcttatgtccacttctctggcatatctccagctccgtgatctctcatgtctaagttctatctgagtaatcaaatgttagttatctgaacttagtcatatctcttatttgcatattggatatctgcaagttctaggacagctagattcattttactcatttttttcttatttttctgtacaatattttagcatatacttatttgctggttgcatagtgtgagaaagataaatttaggttatattaagtgattggcaataaaaaggacacaatatgcacactgatagcacatttgttaaatgtataggaagtacacacgtgtgctaaaatgaaatctagtaggatatgtaacaaaggcagtaggtttaattttcttatttttgctcgtcagaattttctaatttttctacagtgaatatgttacttttgaggaaagcaacttaacgtatttttttggtagaaattttttatatcctttgtgatggagatagggtggggagaggcaattttcataagacgtgaattttaaggaggaaaaaagaatttaattagaaagttggagaacaatataatgaaattcaaaatgtataaagataagtactgtgctgggttcagtatttagcattcccatgcatatttttgtattttggcatgtgtatgtgtgtgtatccataaacaatatagttagaattactttacatatttaaaagtttcataaattcatgtgtaaaatgaattgcatgtatcattctaattttttccagcatactaatttttaggtcacttcatgtttaaagctgtagacctgctctttcatattctgtttctgtgtatgtgagctgctttcttttttacagttgtatagagttttcattgaataattttgctatgatttatgtaatattggtgtacatcaggttgtttttaattttatggtattataaacgagtacgatgtttttatttgtgtggctaagcatatgtgcaggtatatttgtagggtaagttcctgaaagtaaatttactgggttattttacattttacagtcagtgtacattttacattttgataaatgatacataatagttgtaccagttttcacttttccctacaatgtataggaatacttatactctgtcagcactacatggcctcttattttactgctatttcaaacatctttttcagtcagtctcacctacggtgattgacgtatcaataggaacttctcattgtactttgacctttgttaccttttgaattttaggttttcttttttcctttgttgcattattacttcgacttctcaaatagcttttaatgatttgtttgctttttctataatgttcatgttaaacttatatcaccacagtggtcttttttttgtatttaaaaaaattattgggaagtttagaagtgggaaaagtggtctttttttgtatttaaaaaaattactgggaaagtttggaagtgggaaaagttcattgtgaatttaaaatgaattcttaggaaaggctagtaatattatgtactgcctctatagttactcttatttagattggtttcaggtagagttttgctgtgatcaagattcctgacatctctttgaattcagcccttctgagccagcctcccagtccaggtgatcctttgcagaaaacaatgataatttggaagaatatagttagttcctttcatggattgaaacgtaatgaaaatccatcaggtttcagtcagtttaaggatagggaaagtgacaataggaacagaagaaaatgaggaggaattttatacaagttagcaactaatattttaaagtgtttcaacgttactctcttgtaattctttttttctaactttcctcattgtttgtcttagatcatttctttagagtagctagaaacaggtggtcctctgtttaactcagatgtccatttcacctcaggattgtgccacttaaagttccagctagcaatagagaagggtgttgcctacaggtaaggcaaggtgaagtgaggagggagtggtgatggcgataggaggaagaacaagtagtttaacttctttttttaaaaaggtagttaatatgtatcaccttttctttactcttttcttcctatgttttctgggtttggggaaaatacaaacagattaggttgaatgtgtaaggtttagcttgaggagaataggctagttcaactaactggactgtgagtggggctttttgtctgttttgtttgctgttgtgtgcttatcatttggaatagggtttggatcaagtagttgtttgttgaatgaatgaatgtaagcatgtatgaattaagtagactgagcctgtaactcagtaggatgaggtttgcaactttgtctgaaagacctgaaatgctgagtctctgttccagcagttgcagggtaggtggattcttttccagttcctcctattgtagtctttctagtctaaccctataaacacagtgccttcagacttccttttttggcctacagttctgcactgcactcagtgcttatttcttaggattatgtctataaagccttagcacagtgtctgacacatagttggtagttattattattctaattcagtacccaaacagttcacttaaggctcatcaagttagatatttatttaatcaaagcacatttacattatagctaactaatagcgttactctactaatacaaacaggtatttgtttgtcaggagcacagtagttagccagataagtgagctgtgataatggagttggggaaagggttagtcagggaattggggtttttctggagtgtcttgccttttccaagaagtttcccctgtccttccaaacagtccaagagtagtaagtctcgtcacgtgtttccttatctttgcaaatggtttagtacttccattttcatggagctagtgaaaatgaaaaaactcttgagagaggtaagattatcttcttttaaatccctctacactcacagtaagctctcaatctttactgtggcttcaaggctctgtcctttataagccctgcctaccttttaaacttctctcattcttgttccctttgctacagcaatactgccatcttgctgtgaaatgtgcacaccgattttatttccaacactgtatttttgtgctcgttgttccttgtgcttcactccctcccctctgctacccactttaaataatcacatggcttttttttatttatgtctaagcttaaatgtcaagagacttttcagaccatcctgtgtgaactgttcttttttttcccctcatgaccctgtctagtctgtctgtaataatttatttattggtttattttttgtctatgtttctcccgctagaatgtgagctgcataagtgaaagaaccttgtctgtctttgaattttatgaggaagagagagtgaattgacagactgtatattggaaatgttaaatggtaaatctaggaatccaaaagtttcctctatttaatatcaggcaaaattctgttcaggattttttttttttaaatatggtgttaatcaggaagtggctaatacaaaactcagtaaacccttgaccttttttcagctgtctctctgacctcgtcctctgtgatggtaccttcctcacagctccagccaggttggccattttgttcttcctcaagcacgttgcaggtgttcaccttggtattttgcagttgctatttcttctgcttgcagttttcttcacccagataattgtgtggttccagaactcacttccttattcagtttttagataacattgttttctcaaaaacatgtttgaatatgaggagcagtgtaagtatgcaagtctgtgttttgtaaattcagtttttatcttgatagctgtttatgttgacttagatgaaacatggttctttaattttatgatatgtttgttatagctatcttaaaagggcttcttttttttaatgcagaaagaggggaaaaaggagcgagctgtggtggacaaggtgtttttctcaaggctcatacagattctgaaaatcatggtccctagaacattttgtaaagaggtaagtcttatgaaattataatcttaagtatattgggccgttctttaataaaatacctgaggctgggtaatttataaagaaaagagatttaattggctcctggatctgcaggctgtacaagcatggcacagcatctcctccacttccggggaggcctcaggaagctggcaatcacagctgaaggtgaagggggaagccagtgtctcacatggtgagagagggagcaaagggccaaggaggtgccacatacttttaaacaaccagatacatgagaactcactcactgtctggaggacagcaccatgccatgagggatctgcctccatgacccaaacacctcccaccaggccccacctccaacactggggattacatttcaacatgagatttgggtggagacagatacccaaattaaattattaagtgttcaactttcaaggttatgtaagattagaacagtaaaatcataacactttggttatactataggtcaaatgttttctctgtaggtcaagaagattactaaatttttgtctttaaatcatcacctgtcatacaaaaaaccttgttcagtgccagtttttaaatagttttctcttgtttctgaagtattatttcattttattttatgtgaaatgctagggtactgctatacagctaccctaaatggtgttgctttgttatagttaaatactgttgataaacactagattaaatttcaaaagacaaacccttttattacattgagatgttaacaagtcacattagtgtggagtatatttgattaaatatttttaagatatgcaaaatgatatctggattcatcagttatttcattcaggaagtgagctgcttatacgaatagttgtataattcgttcctttgcttttttatcaagattatcttcattatttgataaacatttttaatgattattaaaataatgccgtattctccatcttcctcagcattctctcattctgtaactagaagtatcattaccttcagctcttcctcttccccttgtcaccctttttggtcactgggatctgctaatttttcctatacttaactgttacaaaagcattgcagttcccaaagaaaacgtacattccttcatcatgctggatttgctctttccctcactttggcatcatctcctgatgattctgcccttgagaaattctttttttaaaaaaagtaatggcacttgttttttcctaattagacagaggtaatacatgttccttgaagaaaattagaaaatgcagctagatttattttttggcacctatcagcctcttactcgttttgatatatagtcatcctgtgtgcaagcatatattttaatttaaaaatgggatcacacacttttaagatctgctccttcccttatattataaatgttctttctaagtatcctaaagtttcttataaattattctctccctttacattcctactgttctcactatatcttacctggattattatatcttaattggtctttttgcttcttttccttttccaatttgtattctttcttaaaatcctaatcaaaacatgtaacttcattttccttatagggtaaatcacaacctgactttggccttccttttaataccatctgcttaggagatcattgttttacgatctggccctatgtcctcagcctttcatttgtttacaacatcatgtctgtgacatcctgtacgtccccacaacaaaaacaaatatgtttttaaaaattgcttaatgcttatcttttttgtgaatatttccagtgactcttcaggcataactaattgtcctgcctttgaagaatccttatttaaaatacaagcttctctggaaagatgcatatgttaccttccaatcagttaacagcttaatgttcattttaactattgcaggggttcaatgaatgtaaaacaaatttgaaacattggatgagtccctgggaattagtaagggaggtagaaggggctaatttggccagcttcccaccctctgcaggccttcttcccttactttaacttctatgtcactgtcttattgttccaatttagaaaatttaagatcagctttaaatatgtgtacttggggttggggtggcaggattctcatctcacagaaagataactgattcccagccagtcacccagcatcttgactttccctgcttcgtaatctgtcttgcacagcattgcttaagtaatattctttaaacatcactttttaacatcactttttgttctactgagaagcttgcgagaattttatgtgtgtaaactcagtacagtaccatagttcatatgattttaatcccttttttcccccattaaatccttcatcttttttacctttaatcctcattctcttttttgttttactgtttatcatatttctaatgccataactgtcttttgctaccccaaaccttcccatcccacagcttaggacatgaaatgatacaaatatgtttgcctaaatttgtctgctactttttatgtgtaactcttcccttcataactaaattgaaagccctatgagggcatggacactattataaatttttctaacaaattaaaccaaatttattctacctaggcaaaattttaggcttcaattttggttagttgtataactgtatatgtgcagttactgtcatttttctttgttaaagttatatgtcaaaatataagaaaatcaacaatacactatgatctaggtaatctaagttacattcccagcttctgtccttgactaggtatatgaaggcaagtcctttgacctgcctaggattcacttttgaattctgaatgagaaagattaaatgaatctatgaggcttttttcatttatataatattcttgcgttccctttaaactatatttaaaattacttatagaaaaaatgtcagccaactatattgaaacttacataaagctttagatttggaaaccaaaaattgttaccaaggtaatatttctttgaactttctaaaatgcatgtatttaatttactatacctggtttattttagacaggttacttggtacttattgctgttatgctggtgtctcgaacatattgtgatgtttggatgattcaaaatgggacactaattgaaaggtactttttcaatcaccttcctcctatatgtatgaaatgctaatttgtctcatatttatgcattatctttataagcaacaaatagattctaagttaggtaaaagataacccaagtcaaattatgtgtttgttcatttacttaaaaaatacttagtgtttcccatgtgccaggcaatgtgctatactgtgatggggtctatatgccagcaactaggagaaactgtaccaagccttgctgagctgacagtttatcaagagttagagacaggtagacagaaaattaaaatgcagcataataagtgctgtaatgggaattctaaaaaaccaccaagttggatttttgaaattaatgagataatttggaggaaaatttcaaagcatttcaaagaatcacgttgagcatgtttattagaagggaagacaattcttagacatttctttctgcatctggtgatagtgctttttatattttttcattatagtctttctacatattattaatcactgcaattgctaattttgaatgtaaaaacgtaaaaaatgtcagttgggatatcttgggttataacaatttaccatttatctgttaataaagaatttatttttcataataccaattagaatgtcagagtaaacatttttgctaggaattttatttcctggtatgcagtattttgtcagaaaattccttaaagtatttaatctaaaataactttttgaatgacagtacttaaaattgttaaatgccccaacattttggaataaaggtttttttctcttagattattgatctgcttcttaaagatttgtaggaagaggaagaatgctttatgaccatgctctctgactcatttctctaggacagtaaaaaatcttgtatgtataggattaaagccttgaattacatacttctgaatatgggtaaattatgtaggccctcacattccacccaagtctccctgaaacctgtggtcagtcctgtgccttttaattttaatcaaagtaatatatgaatgtaactttaaaagtaatacatgaacatagcttaatgtcagatgttctgcaggacttaatgacaaaacacatgaattccttggctcctctcactcacaactgtcattacgtggagccggtcttttttcctattctttttactgcttcatctcttattttgtgtctgtgtttccatattgcatacttgtattactgttcatagatttctcagtttcaagagtgtaagtgttcatttcctactttggaaggtgagaattagctcttttacactccctccgtgctcatcttctcaatgttttatatgtataataaaaattatataatttttggttaaatcacaatttattgtttacatgattttgactattgcttacagctgagccacatggcatactttggtagttgcgtttccatacaactttttgtttttcctggtgtttacaaattggcagttatttgtgcacattagtttttttttttttttttttaaacctacttccccctaattcagtttgagctttttgacaatactgagaaatcttctcagtattgtaatatggtcagacaccaactaatctatcaacttcatctttctatttccacccccgccctatacgttttgtagtttccagtgttcttgccttttttttttttttttttttgagatggagtcttgctctgttgcccaggctggagtgcagcggcgcgatctcagctcactgcaacctctgcctcctgggttcacgccattctcctgcctcagcctcctgaatagctgggactacaggtggccaccaccacacctggctaattttttgtatttttagtagagacagggtttcacagtgttagcctggatggtcttgacctcctgaccttgtggtcctcccgcctcggcctcccaaagtgctgggtcttcttgctttaatcaggattggttgcattttaggcccactgagtagcaatcacgtttgaatttgcttttatcattattttgggaatttctttcatctttgtatcctgaattaaataacctgtttctggattttttgtttttctcttcctcagtttactttctcgttttggcagatgcactctttttctgagtaaggatgaagggagataaatttttgagaccttgcagatctgaaaatgtctttcttctagtctcatacttgattgataatttagctatgtttgtgcattccaagttggaattcacttttcttcagaattttgagaacatcactctgttctgggtctcaaccttggctgcagaatgattggaatcatctggagaattttaagaattatgaatgtctgggccccaccactagagattctgattcaattaatcaaacctttttgaagcatctagtggattctgttgtgcagctccagggtgggtattgaggcctcttgccattccgattgctcagctatagctggagatttgttcctccctcaatctccccctcaatctttttttaaaaaattgttgatgttgtattactggatgtttgaaaatttcactgaacattggtatgaattttttttttttgttcattgtgctgggcactaggtgaactctttttccatctagaaacttattcttcatttgagaaattttcttgtgtttaaaaagaaattattcctccattttttctggaattcttattagctgagtgttggagcctctggactgatgatctgattatcttataatttctcttctatttttgtctctgccattttattttattttctaggaaatttctttattatccagtgaatttttatttgttataattttatttccaagttatcttctatatggatgttcatttttatagcaatcattcttttaagtatgcagtattttttcacctctgaagctatttaagtttttaatgtgtttttagctccctgcattttttgttattctgttgtcattcacattagaggccttcctcaagcattctgtgactcttggctgtgaattcatatttaaaagtaagtgccttaaacacttactagaagctggagttgagagcttgttaactggtctcccttgaagggtgtttgtagggggaccctaatcatgtgcacgtgtgtgtagtactcagttttaaaatttaattatgaaattttaaaaaattgtttttcattttttgtatgagtttctgaaccattttttaaaaccattattttggtatactttacacttacagaaaagttgaaaaatagaataaggggctgggtgtggtggctcatacctgtaatcccaacactttgggaagttgagtcaagaggatcacttgaggccaagagttcaagaccagcctgggcaacacagtgagacttcgtctttacaaaatataaaaaagttagctggctgtggtggcgcatacctacagtctcaattacacgggaggctgagcagaaggatcacttaagcttagggatatcctgtctcacaaaaaaaaaaaaaaaaagattagcataaggaacttccttatattcttaacccacattcaccaattgtaaaacactcattttaaagttgttaactttctcctaaatagttttgagcctctgctgtgtatgaaattctttaatatttggaccttatctcaaaaaaagttttaaaatattgtacattcgtacaggataattttatttgaaaagttaacatatatctccatctcagtatttaagctacagtgcaaattgatttatttattttctctttttgccttttctaaagtaagtccagattcatgtatttctgctaaagaaagcctcaaagagacttattatggtccttaatgtacttcattttaatatccttttcatattttaagcttatttgttgatggtgactaatgactttggagtatgggcaaatcttaataggaaagacaccctctttaaggtagaaactatactaattccatgacatggaggaaaattcttcataccttgttgctgctttatctaatcataaaaatatattttattttcacccatttggctacaagcagaatttaaaaattaccaaactctcttttataaagattcttaaacatttggaagttgtagtgattagggctattgtaaaattgttttttgttaattattttttttgcagtggaataataagcagaaataaggctttattcaagaaaccattttttaaatttatagctgctactccaatggtaaaccattgctgaatgatggcatgttcttgtgtgtttcacagcttgggcagcactaaagcactttggttttaagtaaggtttggttcaaacaattttaacataaattctctgaaccttttgtactgtcttgattgcttaatgtctgtaatattcttattgctataaacaacatttttgtgtggttctatttaactttcttgtagttagcgtttttttttttttaactgttttactttttaggggctatataaacattggagtattaatttctcttaatcagtctaaaggaacatttcccaaagtatgttctgtggaatcttggctatgatagaggaaatgtttcatgctacaaacccctctcagagagttaaaatgcacatactatacattaaaagctttgagaaggtctttggtaaagacatttgttagatttgtttaacctaggatttcccaaatttatccatctagtccctcacagaaaagaaattatttctctagtcatatactagtaatttttgtgtgtgcgtgggcagctaggtttaaaccacttagtccagtgtttaaatgttttatataaatatgtcttatgaaatttgggaacattattaagtattacttgaagtaagagttctgtgatcaaatacatactatctttgtattaggtcatagacatatcttactcaaagatcctttacttatataatactgctttgttcaaatttttaataaagttttagaaccctttttaaaaatttttaatgtatattttaaaagcagaaaaatatgtaaaacagattaacaacaggcaaaagagaagctagtctagctgaagtgtgttgaggaacatgaagcttctgtagatccattctgggctctgatctatgcgttagtcccagtattggcaaactaggacccacaggtcaaatctcactacctgccatctgttttggtaaagttttattagaatacagccacacttcttggctgcttttgttttacagtggcagaattgagtagttgcagcggagcccttagggtgcacaaagcctaaaatatttactcttgaccctttgctgatccccattaagtctgtctccctgccattagttcacacaaatgagaatcagattattaaaatattttaaaacaaacaaatggtactttgtttattcataataacccattcctgggactataaagttgttaattgttatgctagcttagtttcttttgtagccacttaagcctttttttaaagcagccatttttactaagaaataattagttatcattctgtttaattttgccatttgcaggatgaggttccagcaagttcaaaatgatgacattttaaagttgcaaacatgtttttgcaaaaaagtggtttttagcatcttttttattgattgttttgatttaatagaagtttccaagagtaattttagagctttacagaagttttcctagtgttagattttgcttcttttgcaactaatgcattgcatgtggtggtttgcagtggtatcattggtcgtagcaggaaagatttcaagagatacttactcaacttcatcgctgccatgcctcttgtaagtttaattcattaaaaatctttttaacacgggaaatttgcatcttattaaaatctttaagggttttacttattaaattctttaaagacttatgatactaagttcctattttcagtttagttttgtaatttataatataattttcaatgtaaaccttcatactagataaaaaagggattatgtttggtttaatttcatttataatgtgtatatatattcatatacatatgtatgtgggtgaggggttttttggcattttttttttaaccttcagtccaggttttcttcagtgtttagcatcatcaatgaccattagatagcagtagcacccttctcctagttctaacaaccagaaatgattccagtcattgcaaaatgggtatgggcagggggcaacttggggagttggggggatttagaggggggaatgcaaatcatcctggttactttaggccataaactattacagtaacttgaactactaatttactttaagttaaattggaatttatggtctgaattttttacagataaattgtttagtctaaaatataagtgattttcttaggttggttctcattttaattttcttggcgctgtaagaatgtaatattctgaatttgtgggtaaaaatgagaagcttggttgtaaaatccagttatgttgaaattgccagaaattcttgtttaataaagctggaagctggggctacatagcttttagactttttaaaataaacaattggaataagcaacatagatatcaaagattaagattcagcaaagaccacttgagaaaatttgtaatgtaacgatggaaaatgttagtaaagatggctctagaaataatctggaaaatagcattagttggtgtaaaacctgtagtgttttttttttttaacaaatgcaaatatagtgtatatagaattccgttgtctagggttgtagtgctgatagtaggaaacagaaaatataaatgtctgaactcctaaaagcaagtctttacattggctagaaaggggatatatttgactttttgcccgtttaccaaaaaaaatgggcaaggtatgtcgcgtaattagtgatattaacatattccatgtaaactttaacatagaataattcaaacgaggtacatttggtttagctaaatgcagtaaagtaaaacagaactgaattatataaatttggactaaattataaaaattgtaggatttgggacacaggaaataatagagaaataaattatagtttagtaagcagaaatgaaaagcaaaaccaataatatttgtttgtttgttttagatctctctggttaataacttcttgaagtatgggttaaatgagcttaaactgtgcttccgagtaaggctcactaaatacctctatgaggagtatcttcagtaagtgataacctatttttatattaaaaatatttaaatagaagagtatttatgaagctgatcaatatagcagtttttcttatttattgtatgttttctaagaaaaccactcttaggtacagaagcatgttgggaacaacctttcagttatttggaatctagtcctggctcttccattaattgacaagtcatcattttctggacttgtgtcctcctctctaaaaatcagttagggcaatcaataggatctcttctggctccaaacttttttgtttctatgtatttgagctaggtggtgtaatatgatttttttgttgttgttttatctttaaagtcacttgttttaaaatcacttttcttcttgctattttagagctttcacatattataaaatggggaatctggacaacagaatagctaatccagaccagctgcttacacaagatgtagaaaaattttgtaacagtgtagtcgatctgtattcaaatcttagtaaggtaagtttctctcctttttaaaagattatttgtttaattttttgaattttgaatctaagcaaatttatatagaattgattttatggacataacagcagcatgtaaatatttaatgcttttataagaaaattagagttgttgtaatagttttaattattttaattttttctattatttttgtgaggtactttggcaaagaactgataatttagtgtcttataaggattttctaagaattttgcaggttgattccattaaaacaacagaaatttgaattctcatcttttgacctgtgtgcatccggccattgttagagattgactgtcaatttatgtttctaactccacacttataacactagactaggacttcctttctgcccatttctctgcttcagtatctttaattctaatagatcattagtaagtagtagtcaaaaaatttcacaagatgcaagtatatttcagttttctaattactgtttttcccattctcctcagaatattgccaaagctcctgactgtgataggccttagtcagttttccttcttctcactgatttctccagttcttatcttagtcatgttatctcaccacccttacagcttttgctgtagtcttcttattaaaccctcttctttgccattacctcttgcattgactatgatatgtagtaggcacctataaaatagtctgcccagcatcccctcccctcttcatctgagatgcttcagttcccactctaactcatgtgacttcccttggtgttggctaggagcttgtctcatactggaccaatgatagtatctttgcctctggtcacagttgacctagatatacagttttgagacaaaagaaaaccaaaactataaaaaggactgggtcacattgtaagaataggaatgttcttgcttcaaccagatggatggagggaaggcaattcttagagatatatatccacaagagctgctctcctcatgcccaggcccaatgcttttcacttccagcccaactttgttatttatttagctctccagaagcctttgctaactgatcccaaactcgggaactctgacaactacaaatagttcagtaattaagctttcttttctgttcccattaccacatttgaaagtttgttctctctctttctctctctctctgtctctgtgtgtgtatgtgtgtgtgtatgcatgcatgcatggtgggaatggggggtgtatctatacaactttccatgtaattttatagacattattatgtattctttaaatcttggcacttgagcaagtctcaggttttgtcaaatctggaatacagaagaatattaaattaagtacttgtagtggggctgtacaccagtgtgtaagttagatgttttaaacatctaattgacctccaacttaaattatgagtcattatttttgtcataagttttaacagttcttgaattttataagtatctctagcttcttgataacttataaggcaaaaaaaaaaaaaaaaaaaaaaaaaaaaggaaggggaaaggtagatgttgaaacaagccagttaacaaaccaagccatctatcctagtaataatgtggattagaaagtgctggctgttggccgggcatagtggctcatccctgcaatcacaatactttgggaggccaaggtgggcagatcgcttgagcccaggagttcaagactatcctgggcaacatggtgaaaccccatctacaaaaaatacaaaaattacccaggcatggtaatgtgcgcctgtactcccagctactccagaggctgcagtgagccaagatctccagcctgggtgacagagccagaccctgtctcaaaaaaaaaagtggaggtgcaagcagtggctgttgacttaaagtgaatgaacacaatttgtgtttcttgaaaaacatttcaaactaatgcagctgatggtgcattagttgagttgtctctgtgtgtaaagagcagtacattaatgtgttattttggttctagagacttgagttttatatcacaaaattagattcaatggcttacttgattattttgccatggaagtgataaagtaatagagtcaaacaatattggagcaggaaaagctcctcactttacaggtgaagatatgtagaaacaaactggtagcagatttggggttacatctcaggtcattttattcagtgtctttacattatattgacacattactgagttactagtggttaattatcacagtagaggtatcttagttgatggaaagtgataaatgtttttcctacttgatggtcagtagacattgtgtaagctgttcccattttaagtttcttgagaggaaaactgttatctttcatgtattctttgatctacttactatcacagtacattgtacatagtgggacctctacatgttgataattatatattaaatgtttaatgacattttatagttaacatgttgtattagctatcattctagtgctttagttttaattctgtgtattctaatatttattttacagccatttttagacatagttttgtatatctttaagttaacgagtgcaattggagctcaggtgagtctgcttttatttcaacttttaaattgatataatataatatttgaaatacatattgtgaatagcttgatggcctgtaagaatttttgtagatctcaaagaatgtattttcacatgatttacctaacaaagtctggttataaaataatacttcattcgagattttagaagtactaatttttctttttaattttccttaaattaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaaacagaagttcttaaaccatgaatatacttgtacttattgtttcaaagtaatgtctaaaaagagatatggagacatccattttaatatgaaattctaatgttaaaataacgatacatttagagtgggtgtaacagttccaagaatattttataatgtaaatggttggctatcccatgagccttattatccaagtctctgatatttgtgatggcaagaatcacttttaagttttctttgagttatcttattgaaatgtaactttagtcatttaatatgtaatgttattgttacatatttataacacagccatataatagtatggttgttttacatatgtgtatgtgtgtatatgcatttcagttgattaataaattatttccatactggtttttgttgctttccaaaacactggaaaagcagggttttggttttgctttgttttgtttttcgaatttttctgtttattttcctaattctttgctgtcttgtgatccaggttttatcattcttgtattttgttttactataaccaagtgaataggccaaatccttcttgtctccttgcagtcatatttttatggtacttaactacatttttgtgatacttaaatatgtctccatgtctacttgttatctgattctgcatttcttaaaggcagaaactgttttagttatctttttggtccacatttgtagtagttgttgatatgcattgaattgatcagatttacttttttttttttaatcttgaatacttactagcccatatattgtgctagatagtaggaataaaaagataagtaagacacaattcctgctgaagaggaattacaatgtggtaaaacaggtagatagtcaaacaattatgatgcagcatgataaagtttagtaatagaagtttcaagaaagtatttagtgccaagaagaactggaggtgatatctgagctactttggggaggtaagtaaacatccattagattatgtcaggcttgccaaacataagaacaacctcactgaatggaaactgttcaggaaacatttatatattttagtatggcagagtatagggtatataggggaatgagggaagtgcctatgatgaacttggaaaggtatgcttcaagcatacctttctttttctcttgggatggtcaatgggtgatgaggtcacgtacaaagttattaatacatagtacagcagctggaagcaagatgtacacgcagggaaagacagagctcgttcagggggagctgaacttgaggcatctgcacagtattaaggtaaagatgtgtagtacttatttcttgggttcataagagtgataggactagaggtatagatttgagatgagaagagaactaaggaaggagtttgagggaatattaacattaaaaaagaaggcaagaaaaagaggtctaagaattattgtggaatcttaagagattatcaagaagagttccaacaggagagtgttagataacatagaaaaactgtgaactgcaattaggagtttttaggtgagcaaaatgtaggagagctgagggataagctacagtggtaagaggaaaagcccatgagtagtaaaagtgtagaggctactgtgtactttttcagaaaaaaaacaaagggaaaaaattacccagtagggcaatttctttcagtcattgaggttaattataaaaattgtacatgtttgtatctaagtgaatttattattatatcccagaactttgtgtatctttctctcccaataataatagggcccagcgagcatgatggcctacttggttgtttctgggctattcctaactcgacttcgaagacccattggtaagatgacaataactgagcaaaagtatgaaggagaatatagatatgttaattctcggctcatcacaaacaggtaaagacaaatgcattaaagccttgctaaaaattaatttctatggatattgatgtcatttaaattgactccaaaaagtctagtgacactgttactgtaataatgtgcatattgtgttgaaaatatacattatgaaagagactagttttataaagtagtaatcatgaatattttgaactctttttcttactaaccatgtagtattcctgattcacctgttcataccttctgttgatgaattttctgttaattttacttcagacataatcagtttacaattcaaatttcaacttacaatacctgttccaagacaattttgtctcaatttttccacaaatatttttattttgactgttcataatgctcaatgattcactgtcactgcatgtgcctctacctattttctagagttttttaaatgtaagataggaagaaaaagtgtggactttggagccagccatactagcttcaaaatctacctcttccacttatcagttgcatgtatttgattttagcgaattattcatagtttcacttttgtttataataggtagataatatagggttgcaatgaggattaaatttgataatacatataaagcttccagctcagttttttatatggagcaactgctcaataaatgttctcatatattgatctgttaatgttaagtcattttgagggttctaatatgtatttaatattctactctataggcatttgcaaatgacagttccctcttcctttatttccttggattgctaaaatagtacaagttttaaatagggttttttgctctagggaggcagcggaatagagttaagaggtgatttgccaagtaaatgaaagatgccttttagtgaaagaagcagaaagcatgactcatggctccagtaataagaacactcactgcttcacgtgagaacccttaagacagggcagttccaggtatggcattatcagggctctggctctctggtgttctcttggctctgccctgctttgtatgctgccccattcctcgggctaattcttcttgtgaccacaagatggcgatagcagttacagatttcactagctcctctcccctgcagaaagctccagaaacaaaaaggggccatctcgcctggtgtgtctttatgagagcaaagaaacctttcccaagagtcccacaactgactttccctcatatcttattggctggaatggttacttgaccatgcctaaagcaatcacagcaaagtgattggcttagaccagttgggaccctaaatggggttgaggcattcctaaagcattagggtacatggaaaataatagataactttacaaaagttgggattattttaggaagaagaacaatgaagagaatagatgttggatgggcagccatcaatattccaggatgttttatcctttcagatttttcattaaggctaaaatgactcagttcaggaggagaatcctcacctcatcttcttccataggcttgggtgtggagaggagatagaaggaagtttttttaaaaagtaattagaggtatagaattgtaggcttcttatactcttgagtctctgtcattgtgtcaaggaaaccatgaaacgcgtgacaaatgtgtcatatcttatgggaagttaattttacttgaagtggttgaggtaggtggtaccttgtttttatgaaaaacgcaggtccatttcaaaatagaaatataaaacataaattgtttaggggaaaaaagagactttaaagaaatatttcaaccttgccttctagacttctctataaatatttttctctgccataagaggtactttgctgggaaagcttacatcattcctgtgtaatagaaagactataaatgttagggtcagataggagttatgatttcagctccctgacctgctggctctgcaacctttacaaatttacttaactacactgaacttctcttcatctataaaataccttttttttctagtcgtgatccctgtggcccttgtggacccatgcacatctgctcaggaaacgtggaattgttgtgaggatatgatggggttccagggtttcctcctgggagctggcactttgaagccggtgggacttagcctgcttttctgtctttaaaaggctgtatgtcaagtcatcactatccatctttttctagctgttgctttttcatctctttcttgtttgggcctgtactttaacttgaagtctgcaatgttggtcccagccctgcctttctgtacatcacagcaacttctttctctaatttcgaatttctgagaattcgtgcagtatgtcttttgcagccaggatacctatgccataggttgcagtccagcatatgattcagtcaggagtgtattcctgtgctccgatcagctgagctaggaacagaatctcaggtatagactgtggcttgagatgcaccagataagctcttagtcacaaaatgtccatttaaatacaaacattcagccatcatatactgtatttcaattattttccaagcataggtaacattaaaattaattgctaaattattttctttaatagtgaagaaattgccttttacaatgggaataaaagagaaaagcagacagtccactcagtcttccgaaaactggtaagataacacacttgaggttcatgtgtttatggaaagggttttttttgtttgtttgttttgcctatggccgacacacatacacacacacacaaacacacacgtatgtatacatatcttaaagattttttgaaaaatagctataaaggattttatactgcatttttaataaaaaatatgagattaaaaactatcatatcaatatattcaagtgcccatttataaaattgcatagatttattaaaataatattaagtgtaccatctgatctttgacaaacctgacaaaaacaagaaatgaggaaaggattccctgtttaataaatggtgctgggaaaactggctagccatatgtagaaagctgaaactggatcccttccttacaccttatataaaaattaattcaagatggattaaagacttaaatgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaattttttgcaatctacccatctgacaaagggctaatatccagaatctacaaagaacttaaacaaatttacaagaaaaaaacaaccccatcaaaaagtgggcaaaggatatgaacagacacttctgaaaagaagacatttatgcagccaacagacacgtgaaaaaatgctcatcatcgctggccatcagagaaatgcaaatcaaaaccacagtgagacactatctcacagcagttagaatggcgatcattgaaaagtcaggaaacaacgtgctggagaggatgtggagaaataggaacacttttacactgttggtgggactgtaaactagttcaaccattgtggaagacagtgtggcaattcctcagggatctagaactagaaacaccatttgacccaaccatcccattactgggtatatacccaaaggattataatcatgctgctataaagacacatgcacacatacgtttattgtggcactattcacaatagcaaagacttggaaccaacccgaatgtccatcagtgatagactggacaaagaaaatgtggcacatatacaccatggaatactatgcagccataaaaattatgagttcatgtcctttgtggggacatggatgcagctggcaaccatcattctgagcaaactgttgcaaggacggaaaaccaaacactgcatgttctcactcataggtgggaattgaacaatgagaacacctggacccagggtggggaacaccacacaccggggcctgttgtggggtgggggcctgggggagggatagcattaggagatatacctaatgtaaatgacgacttaatgagtgcagcacaccaacatggcaaatgcatgcatatgtaacaaacctgcacgttgtgcacatgtaccctagaacttaaagtataatcaaaaacataaaaaaaaaattaagtgtatttttacagaggttgcttaggagccttatttagtgattcccacagaaagaatttgttcctgaagcattcatgaaaatacaataaagattattatgtaaagcaagagtcagcaaactttttccataaagggcaagatagtatgtatatattttaggcttttcataccacacagtgtcttgcaactattcagctccgctactcaagagtagctatatataatacatgaatgagtgggtgtggctatgttctaataaaactttacttaaaaaaacaagtagcaggctagatttggactatgggtcagagtttactggctttttgttttaaagaatataagcattgtttcttgtgaaagctttacttcagtttttatttaattgccacttggaaaatttgaattcaagtacttttattccattatttattcaaaagatattgaatgccgtctagttgcctgtgctcactccaggtgctaaggatgatggtggtggacatgatggataaaatcttgcctttaaggagcttacattttagtggaagtctgaagtttgtgaaattaaatgtatattttagatgagttaaagaggttaaagaaattgtcattttaaattatttcagaaattggatttttgcctcgtcggtatttaacatggcagaacttttagagtgctcactggtagaatgcatttaaggtaatttttcaggggcctgcagttcaccagtttgctctccacacggcttgcttattctcatcctttagattttcagcccaaatgttaacaccttattgaagctttgtcttctctgatcagcctatttgaaatggcctccaacagttacttcttgttttaatcatcatctttccttaaaagtatatatatatttgcagtcaaccctctgcatctgtgggttccaaatccatggattcaaccacacagattgaaaatattcagaaaaagaaattgtgtctgtacttatgtacacatatttttttcttgtcattattctctgaacaatacagacattagtgtaatagctatttacattgtattaagttttataagtaatttagagatgacttaaagtgtttgggatgagccagttgcggtggctcacccctgtaatcccagcactttgggaggctgaggcgggcagatcagttgaggtcaggagttcgagaccagcctgaccaacatggcaaaaccccatctctactaaaaatacaaaaattagccggttgttgtggcgggggcctataatcccagctactcgggaggctgaggcaggagaatcactggaacccaggaggcggaggttgcattgagccaagatggcaccactgcactccagccttggcgacagagtgagactctgtctcaaaaagtaaataaagtgtatgggatgtcgtactcaggtatatgcaaatactatgccatttttcatcagggacttgagcatccatggattttggtatccagaaggtcctggaaccaatcccatcccctttggataccgagggatgactgtattacagtctctaattatcttgtttactagttatgctctttcattagaatgtaaactccataaattcagggaccttctctgttctattcattgtatctccagcttgagcacagtgtctgacacatggtagtcattgaataaatgttccagagattgtctagttgcagaagataccaagttgttaacaagctaccctgtactcaggaagccacattttagtggagcagacaataaataaacaactagatgttctgtataatttcaggtagtaatgaattcggtggccaaaaatgaagcaggataaagggatagatatgaagggggctattgcccagctactttagctggaatggccaagatctttcttgaggaggtgacatttagtcagaaatccacatgaaagtgaaggagtcacaaaatatagataccttagaagaatgtattcctggcagtgagaagagcaagaggaaatccttaagaaggtacatgtttgagaaaccgttatttctggagcttggtgaggaggagcaaagtagaagcatatgaccttaaaaatagagctcagtgccagatcatgcaggaccttgaataatctggtagatggacagtttgagaacactacaactccagaataaaaaagcagttttagacttgtagttttaagacaatgcgtgctcatgttaaagctaaaactgaggctgtgtggcactgatttacattagcactcagttcagattgggtgtaatacaattcttagataaagcacagaccatgtgtctccactgaaagcaaagcattcagtgccaatccggacagctagtgtttcactcaaactagttaatctctgttctttttgctttcgttgttgtcctcttttgggatatgtgtatccaaaagcatggtgactacaatagcattgtgctattgcatgcaagagaaacagcattgttaaaattgtttatgtaatttccatgctgtttgcataaaaatggtttcatgaagtgtttgtttggcacccgctctgtgaagagcattgtcctcggtggtgtgatgtacaatataaacagaatataaacagaaatcacgggcactcagtaaatatttgttgaataaatgaactatacagtttgttttatccttatagtagattcagttttttatacagagaaaaagatggttttttgtttttgttttctgccaggtggaacacctacataatttcattttgtttcggttttcaatgggcttcattgatagtattattgccaaatgtaagtatattttgaaagagatgagatttgtggaaaaggtgaaatactgttactgttttaaatcttacctgtttggtttcagaccttgccactgttgttggttacctagttgtcagtcgccctttcttagatttgtctcatcctcgacatctcaagagtacacattcggaacttctagaggtaaactgatgataatacaatgaaaatgtaacagtaaaaataaagccaaatttttagtcatagaactataagtaaaaactaatatttatttctatttaaggattactaccaaagtggaagaatgcttttgcgaatgtctcaagctctgggtcgaatagttttggctgggcgtgaaatgactagattggccgggtaagattagtaataatgagctgttgcagaaaataatttttaaaaatatattatccttaatgattgtatcagttgagattaagataaggggtcaacatttcctagcccaggaaggtggttttgatagaaaattaaggaagatttttctgatggtgaacttttcatgtttcttgaggacagctggtttgcgcagtacagtagattagaggctgtcaagttgtttgctccatggacacgtatttgctaagttgggaaatgttgaatcatggcagtcttaattcacagaaaactatgtttatgaatagaattttctcatttaaattttcttgtcctctaccatacctttttttcttggatcttagataccggcaacctagcaaaacagatgaatagaaatgaagttgactttaatgggaaaaaaaatgagatgttatcttgtatctgtaggcgtgcttgtgaatgtagtcatattatctagtagtaaaattatctttagacagtagaatgaaattaaatattaagatttcagtatttcaatctccaatataaagggcatggtatggtgtaaaaaacaccataaattttaggtcacctgaagaagtttgatgactgaatatctttcctaggcctgtgatccatcttcatatttctctttttcctccttcttagctcctgtggcagttatggtcttcatgcaatatagaagttgttaactactatgagtagagtctctttcatgagaatactaacattcttcctacttgttaacttttcttatggctttacagttcatggtatataaggtgcttctgttcctttagggtgtttcctttcactctctctctctctctctcgctctctttctgtgtgggtgtgtgtgtctttctctttcactccctcccttcgtctccctgcccccctttctttctcttttttccactttgttgaggtatgattgacatataagaaactgttcatatttagtgtatacaatttgatgaatatgggaataagttatacacgtgtgaaaccatcaagaccataaacattcatcacctcccaaagtttgctttaggaggtttctgctttttattcagagaaaaatcctgttttcttcttcgatgcagaatactttctctttggcgatcatggtcatttttgttatctccaacctcttgtcgttagttttgatttttctctattgccacagtgatttctatctaataataagaactcatcatctttcccctcttcagagtaagaaagagggaatctttcagattcttccgtttgcaggaaggcagcatgcattcggcatacatttaataaatgccttccttggatagaaagaccagctttatacatggctttataggtcacttcagcaagagatcagagtccatacttcctgggtctaaggaatatactagtagtggtccttttgtagtatccaagagaaacctcctgaaaattctcagcaaataactgccttgacttggctattaatgaagtatctgttgagttggggatcctatggaaacctcttccttcatccctatattcctgctctcctactgaaacataataaagcacacgttatcattaatactttatgttgatgagactgttaggttacttcatttatactaaattataattttaggaacttcagtttgtataaaataaaagatgtgacaatagtctggagttttgattatggtttccttttctaaaattttagttttactgctcggattacagaattaatgcaagtactgaaggatttaaatcatggcaaatatgagcgcacaatggtctcacaacaggaaaagggtaaatatgagtgtcacagtttaaggtcacaattttaagtgtttgctgacataatatgatgctttaatacctattttccatttaaggtattgaaggagtacaagtcattcccttgatacctggtgctggagaaatcattattgcagataacattataaagtacgtacagaaaaaggtcttttagcaccataaatgtttgttaaacttcatagtagtctttctttttcagcttacaattgcttagtgtttaaaattatttctgcttttttaaaaaacagcttagaggtatcattgacctaaaaattgtgtatattaatatttaaagtatgcaacttgatgctttgatatctgtgtatgttgtgaaatgattacgttttggctaattaatttacctatcgcctctacatagttaaccatttttgtgtgtgtttagtgagaatttaatttagatgtgtcttagcaaatttcaggtatacaatatagtattttctactattgtcccagtacagtggatctacagaatttattcttctggcatcactgaaatgttgtgccatttgaccaatattacccccatttcctctctctctaaccccctggcaaccaccgtcctactctctacttctatgagtttgactattttagattccacatacaagtaagatcacatagtgtttctctttttgtgtcttgcttattttgcttagcataatgtcctccagatccatctatgttgaaaatggcccagtttccttcttttttaaaagtggggtaatattctattgtgtgtattttgtgtgtatgtgaatatatacacactgtacacactatattttctttatcctctcatcagttgaaagacatttaggcagtttccatatatggactattgtaaataatgctggagtgaacatgggaggaagattctctttgagatactgattttatttcctttggaaatgttcccagaagtgggattgctagatcatacggtagtcctaattttaattttttgaggaacatccatattgttttccataatagctgtactatttgtagtcccaccaacaatgtacaaggtttcctttctccacatctttgccaacacttaccgtttgtctctttgataatagtcatcctaacaggtgagaggtgatgtctcattgtggttttgatttgcattttcctgatgactgagatgttgagcaccttttcgtatgcctgttggccatctgaatttcttcttttaagaagtgtttaagctctttgcccattttttaatcaggttatttgtatttttggtattgagttgtattagttccttatatactttaaagtaattctctttttaaaaatttcctctataggtttgatcatgttcctttagcaacgccaaatggagatgttttgatccgagaccttaattttgaagtaagtttttaaatgatcatataaaagcttaaatcatctttaaaatgtgaactgaaaaagattacctgaatatttaaagtaactttaaggctcgacttagtctctgaatccacagaattgctttaaaaagtaagtctttgaaacgcttagaaatctatttttcttaattgacaggacttcaaaatttcaaatactactaccaaaaaactttttgcaaatgaagtttatgtcaagaaagtcatagaaaatatagtaaattggagtctccagtgtaaaatgagtatttaaacacacaaatataattttagtctctttacattaaaaagaaacttatggtgtggctggtattgttgtgactgtacaggatgatttgtacctataaaaacaaaatacagactgttttattactgatgaaaacgggaagagccgcacagtagcgctacaaatagacactcacctaaaacaagtaaaatcccatgccaagtgaaaactgatgttgattcaatatactctgctaatgaaatgggatatggcagaccaaattaaaaagaaaagacaaaagatgaatgtttttgtacgatttgtaagactcgcagatttaagggttactatttaggttttctctatgttgtggctttatgaatggttcagatccagaaatcttcataattagtaacaaattcctatcacataggctatgttccccattctagacaccattcctctagaacaacactttcccgtagaactttctgcaatgatggaaatgctctatactttcactgtccagtaaaataaccatgtgtagatattgagcatgtgaaatgtgactagtacagctgcaaaactgaatttaaaatttaatttaattaatatgatttaaaattaaatagccacatgtgagtagtggctatggtattggacagcacagctctagaattcctctccacatgctaatgtgcatggccatctgtagtttgtgtttcatgtggggatttttttcctactgctttctttgaaggaatattgtctgatagtttataaaataaagaatataattattggacttgtttttaatttgttacagtcttaagtaagtcttcagttttctgctcttagtaatttatattaagcacatgtctactttcttctcaatgaattataaaaatgaaaattgttagttatgcaaagtactttgaacttattcaacaatgagtattctatcgttatcatatttattccaaagccaggaaatacaagaagtacagaaaatgtaaatgtagttggtaaatattgactggctccacatatcacagaagtgttttctcacatagctccaggtacttcagtcacttgaatgttcctttggcaaagtaggtagccaggcttgatttccagtagcccctttattgccactgtccaaggataaaaaggacgtgagacttcgttgaagaatgcctcttgtccctttctcctacttaccctcacttctgtctttatgcagaaataaaatataccaataatataggggcacacatgactgaagcacaatgagaaagggggttgggatacttagaatagatggatcatgattatggtccataataatattttgtcttgatgttaccacactaaagctgtcactttctttttagttcaaagccttttcttttaaagcccttatgtttgtattgaatagacttctgtcgtttctataatttcacttttatagtcttaaaaatgtcctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcagcctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaacaatgctcaccatcactggccatcagagaaatgcaaatcaaaaccacagtgagataacatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggataaagaaaatgtggcacatatacaccatggaatactatgcagccataaaaaaatgatgagttcatgtcctttgtagggacatggatgaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtggggtcctgggggagggatagcattaggagatatacctaatgctaaatgacaagttaatgggtgcagcacaccagcatgtcacatgtatacatatgtaactaacctgcacattgtgcacatgtaccctaaaacttaaagtataataataataaaattaaaaaaagaacaataactaccctgtattaaaatacatcaaaatgtttaaattaatgagtttattatgatactcattatgttgaaaagtgacaaagggaaaaaaatgtctttaattctttctcttttttgggtttcatttggaaagtcttgagtccccacttatgtccttacttgttggagtgttttacttcataaccatgttccttacttcctggtgtttatcctgtgattcttgttttctcctcccctgggaactgtttctctgacttctttttggttcactgttatgaattctaatctctttctgacttaaagtattctaaagtagacctgggtttctcacattcattatgtctttttattgtttttcttaacatagcctttctataatcaacaaatgttcttcagttctttgcagcctctaattattttctactcatctggcttacttgaaaataaagatttctttctcttggaaagaggcataataaaacagacttggcccctcaaataaatctttcctactttatgattcatttgccttttgggttacatttgtaaccaaataataaaaacttctttggaataagagattttataccattttccattataaactccccagtacagacatatttatctgtctagatattattctgggaagtatgtagactggagagatcctaagaggtaacagcttgcaggttaccatgtggggattaaaatagtactttgtccaaggtgggcggattgcttgagctcaggagtttgaggccagcctgggcaacatggcaaaaccccgtctctgtgaaaaatacaaaaaaattagctaggtgtggtggtgcacacctttggtcctggttacgcaggcggctgaggtgggaggatcgcttgtgccagtgaggcagaggttgcagtgagcggagatcgcaccactatactccagtctgggctacagagtgagatcctgtctccaaaaacaagtactttgtaagttactaagatttttaccttttcagtaaggtatacttatagtgtttaaagaaactaattaatcttcataaacaccatacttttatataatttttcttttacttaaatttatgtgtagaattttttatttgttatgataaatttatagaaagtaggatttatcaaggagtattatttggggggtatatttttattggtaagaatatggtagttcaaagcattggttgatccggtaaagcattctgagagccccaataatacaatgctgttaagaacttaattttcagtaaatgttactcttggcttttagtcttaatttaaccccacaaaaatatgtacttaataaatttttaatacagaaaaattatcactggcttatcatggctgacgtcataattggaagttttgttcaacactaccaaatgccgtgaagtaaagaaaagtgaatgctgagtaggttagccaggcttgatttagagcataaaaggataactcaggatttcagtaagtctggttattatttatatacatcattacaaatctgtttttggggtttcctggcatactgcaacaaataatgtggaagggtattattggaggcaggaatattgatgccattgtaaaccacaaagagcagttaggaggggagaatttatatacggccaacattactcaaataaaacgtagcagggaaccatttaattaccagctcactgaactttaggaccttctaagggcatcgctgttacagtagagtatgattattttatatgataaccttgctttatgaggaacattcagtatattcaattttatgtgataaggaaattgtgttatttaaaaagaagtctatcaaaatgattctttatcagaaaaaagtttattcatctgaacgactctttaacaattatgtgtgtaaattgttattttcttttagatcaactatgtgttaggctgcttcattcttttttctttaagaagtttttaaaatgtaaaaatgaaatttggctttttaaccatttctaagtgtataatttagtggcattaagtacatttacagtgttatgcagccaccaccactatccatttccagaacttttccatcatcccaaatagaaactctgtactcattaaacagtaactctccttccttcctctcccttgcccctggtaacctctcatgctgtctgtctatgaatttgactgctctaggaatcacatataagtgaagtcatacagcatttgtccttttgtggctggcttatttcatttagcataatgttttcaaggttcatctgtattgtagcatgtgtcagagtttcattcattttaaaggttgaatgccatttcattgtgtgtgtgtgtgtgtgtgtgtgtgtcacattttgtttatccattcatcctcttgggtcgcttccttgcttccaccttttggctattgtgaacaatgctgatggctctccattttgtcacagtaaaagtcgaagttctttcaatgcctgccactaccctacccctacctgatacatctctgatctcatttcctactattcttctttcctgttcattcttcagtaaaatcagccttgtttctgtttttttttttttttttttttttttttgaataggatagctacattcctgcttcagtgcctttgtaccagcaaatttttttttttttttgagacggagccttgctctgtcgcccaggttggagtgcagtggcacgatcttggctcactgcaacctctgcctctcgggttcaagcaattctcatgcctcagcctcctgagtagctgggattacaggtgcccgccactgcatccagctaatttttgtatctttagtagagacagggttttaccatgttggccaggctgtaccagctttttatgggtggtaaaggtgggggctagaacagtcttcttttagttaaatcctaattcaccccttctttcaaagttttacttagttgtcatattcaataaagtctgctctgaccaccttaaaaatgcggctttcctcacccgctcccaagttccctttgtctgttttttcctccaaagtacttattttctaatatactatttaacttatatgttatgtatattctttattgtatgtctcttaccactagaatgtaaaccagtaagggtagaggtttttggttttttgttttcattttttgtctctttaattcattaatatggcctacttgcctagaacagagcctgacagagagcattcaataaatattcattgaattaaataataggaacagaaggctcaccagcttaacaaatttgttaaaggcaggttaccagctagggtaactcatatctttctgatattttctttcctattgtgttgcattggtgtttagtgttgtaagctagaattatagctaagattttctgattctttacagagttgatcagatacttacaagatcataagcctagaacttaaccactctttacattttctcatttatctttatgttgttgcagaataatttagtgacacttgtatatatttatagtgcacatatattttgataaaacacttataatttctaagaatggaatctacagaaacattgcttactgttacataagttgctgacttgtacactcattgcaatattatctagaagagcaaaacaaaatgcagatgacctaaatatttaaccaaaggggagtgtttaaataagttatagtatatccttactatggaagatgcttgaggcattaaaggaaaggaatgggggaatctgaatatactgacctggaagaatatctgtgatatattgttaaataataaaagcaagttgtagaacagtctatagagtacgttttcatttttttaaaagagactgtgtatacgcatgtatttattgttttcaagaattctcagttttctaaactttatctctctttatcttaagttgatgatatcaatcagtcagtaaatttatttatttatacatgtatatagatggggtcttgttctgtcagcctaggtgacatcatagctcactgcatccttaaactgctggactcaagcaatcctcccacctcagcctcccaagtagctggggctacaggtgtgcaccaccacacctgcttaattttttatttttattttttgtagagatgagggtcttgttttatttcccaggttagtctcaaactcccagtttcaagcgatcctcctgccttagcctcccaaaatgctgagattatgggtgtgagccacagtacccagcaataataattttttaagtgaaaaaaaagtaatggtaaaaattggaagtaaacaaagtaaaaggtcccttcacaatacctcttcactgctctacctaatgctacatttacagacaaatagaaggcttataattagccaggagctattaatatttgagtctaaggaaatgttgattaagtatatgttaatttgatttaattacttcacagactgatttttttttttttttcaggttcgatctggggctaatgttctaatttgtggtccaaatggctgcggaaagagttcacttttccgtgttcttggtgaagtaagtacaagttggcctcaaaattttgcagtcttattttgccatactgtctaccactttgtaaattttacaattgttcttctcccttctctctctttaatagttatggcctctttttggaggacgtctaactaaacctgaaagaggaaaattattttatgttcctcaggtaagacctagcttgagttatctttgatctaaagatctttttgtttatttattttttcatgttgcttctaattgacttttgctctactactgtcagagaccttacatgacccttggaacacttcgagatcaagtgatatatccagatggacgagaagatcagaaaaggaagggaatttctgacctagtaagggaatgtttatatcctagatccactgaaaatactccagattatttattttaatcaattaagtattttaaatgccaggtagtttatcttaagctgtaaagccttccaaagctgtaaattgtgattttctaagctgaggtaagatgttaatcccttggcttaaaaagagtttaatcttaacctttacaccattgtttgttttctcattgccatcatccttttactgtgtacaatagtgttattctctttaagctactagacatattttgtcaagtttggtgtagatactaggagctgaaaggttcagggctaccttgtgccacattcttttctgaaatgtatcttttaagtggtacagacaatagaattatagtgattccagtttaaaaaataaaccactattaagaatgttggcttatattaagtttaatttcatctttaatcattttgctgaaaggtactgaaggaatacttagacaatgtccagttgggtcatatccttgaacgtgaaggaggctgggacagtgttcaggattggatggacgtactcagtggtggagaaaagcaaagaatggcggtaagtatactgtgaagaagttgcacaagaatgcaactggttccagcattttgattaatcaggacacaaagtttcatcttatatttttttattcagcagctgtttcagtatggattagtttaaattatcataaaagtgcttgaaaatctttaacttgcatgtaaatttggaattctgaaaaattcataaataccctgccagtatctatgaaaggaaaagctgcagatccgactatataccaataatccatttttctaaaagttcagagaaactctgtagctcattattcctgggatataaggtaatcctggctgggttatgaaatttcttctcatgtctcttccctatagacatctcttttgtatcactcaggctattctttctgaaatagctgaaggtattagaaacgatccattcaaattttatctttattctgttcttgcccttttcctccactattatatgtatgtttttgtttcaaggttcagtatctactacttaaagttacttagaatttttaagttttcctaatataaacaagcatttgaaagaaactactttaattgttatgatgactaaacttgtctcaaaccaaaaatatgcgctaaacactacgtagtaagaatgagaccagcctgggcaacatagcaagaccctttctctacaaaaaaaaatttaaaaattatctgggcgtagtggcacacacctatagtcctagctactgggaggcggaaagattgcttgagcccaggagtttgaggctgcattgggctgtgatcacacaccgtggcactccaggctgggcgatagaaggagatcgtctctctaaaaataaataaataaataaaaatttaaaaagaacggtagtttgggtaccttgtcaagaggggcaacttcataaagagtcattttttaactatatatttcatagtttgaatagatccaagcaagagattctcctctccccctgcagagtatggagattagagaaaactgtagctaaggaaagaaagcaaaagaaattggcttatggcagaatttctgacccattatattcaggttatattccacctttttgttacctccgagtccctgattttgcaagttgtttttcccaaaatcatacccactctacatgaggttaatattaacctaatagtgtgacttgcctggctagtgctataacgtgagatgaatctagtgtgaagagtaaatcataaatgagagagataatagctatattcaaaatggaaattaggctgaaggagtgaaaatttgaaatgattaggcatttctagagtcaatttagaagatgactatagaaataactgcaaaaaagagctgcaaaataactttaaatttctgtactatgtcttcagagaaaatggaaggatgtggttcagaaatggacacgacggaaactcagagaatgaataatgaatgtacttaaaccaaggaacagtgtgtgtgtggtataaaagtacaggagggataattttgatttgaagattaggaattcaaaggcgtgcccagagcagtggggggctgaggcgggagaatcacttcaacccgggaggcataggctgcagtgagccaagatcatgccactacactctagccagggcaacagagcaagactctgtctcaaaagaaaaaaaaaaaaaaaaaaacacatgatccataatagaggcgtttgggaaatggggaaagctcacctgtgacaccactgcatatataactggagcatggccaagccattgtctagagaattgaatgtgatgtgtaaaagagagcctgttgttttgtttcagagggtggaaaggagaaggctaacgctacaaatactaacgttggtgaaattaggtaaagattatatatgtgtattcattttactgtcctttcagttttttggtaggattgaaaattaccaaagtagaaagttgaggggaaagtaggtattagaatttttaggaagaacagacctaaaaggcctagccacttagaacagtgagtcagccagggttgctccagctaatgtcacaatttgggatatcttgtgtttctgaccaaaagttatcttttccactccatttttcttgctcttcctatttagtaataacttttcttattttgaattatgaaaaagtatatatgatggaaaagtggaatatttatttaagtataaattgggccaaacccctttaccagagataccactgttataaaatttttagtgtttttttaatccatttttgtaaatctttttttttttttaccttaaattagcaactatccccctttctcaaattccctgagatctctagaatattaatccttccctttccttacaattgttcagtccttttctgtctctgcctcctttcctgtccagtacagacttcataatccagggtgtggcccataggagataagatatatttcttaaggaatgaacagttcatcccttccccttaacttcctttcccactttttgtgtcatcgtattacctaaatcccagcccagttatttgccttggcacttctctaaccgctcttctgagcacagctaaaaaacatcagatgggctcacagcatggcttagcaatcattttacttatttttatccttctctcatttttcatgacaatcattttaaaactaccaattttgggttttctaccccgttacttaacccactgcacttggcagaataactcgccttctacttttcaaagaaagataggctattatttcaattaaatgacagctaatttttattgagtgctgaaaagatgacagacagtatgtcaggcaccttacacaggtgatctcatttcatcctcacaacagtcctgtgaggtaagaactgggaatgcccccctagttttttttttttttttgagacagagtctcattctgtcgcccaggccggagtgcagtggcacaatctcagcttaccgtaatctctgcctcccaggttcaagagattctcctgcctcagcctcccaagtagctgggattacaggcatgcaccaccacgcctggctaatttttgtatttttttttgtagagatggggtttcaccatgttggccaggctggtctcgagctcctgacctcaagtgatccacctgcttcgacctcccaatgtgctgggatttcatgcgtgagccgccgcgccccattttacagaggaaattgaacttttgtgcaattcagtagctggccaagcaaagacagctagtaaatgttaaagctggtggtgggggctttgtcaggcttaggcaagcagtatggctgcagtgtgcatatgcttattcactttacaacaagcttgtccaacctgtggctcacggacacatgcagcccaggacagctttgaatgcaacctaacacaaattcataaactttcttaaaatcttatgagatttttttgtgtgtgtaattttttttaagctcatcagatatcgttagtggtagtgtattttatgtgtggcccaagacaattcttattcttccagtgtggcccagggaaaccaaaaaattggacactcctgctttacaactttcttgtattgtggcattaagtagctgacagcatagtgggagcgagagagacacatgttgagaaaatgtccatgtcatgtagtaagtgtggtgatgaatgtacgcagagagtcctttgggagcagagaggagaggcattggtggaatgccctcagataaccattcctcttaattaactgtgtgctgctctgtcctgacctccctacttccgctgtcttggaggatatgtcatccttcttgagaaaggcaaatacttccatctatgtttatggagcctctgtcttctgactttatcacatccttttccttcagttatatcccctcccgcagcccccacctacatttaacctcttctagtccttctcttgtggaaagacatttttcaggtctctttgatctaaaaagcaaactctgccttagccaaagcttctctgtgatctgtacctttcattttctgcacagttgaacttcttcatagtctatacttgctgcctccccttcctcacttcatgcaaacaggtggaaagctgttttagtcattcatttattagatagttgaatgctacccatatataagtgtcaagtacatggtagtgattaaaacagtctctgcttttctgaattttttttttttttttgaggcagtctcactgtttcacctaggctggagtgcagtggcacaatcttggctcactgcaaccttcacctctcaggtacaagtgattcttttttttttttttttttttttttgagacaaagtctcactctgttgccgaagctggagtacactggcacgatctcagcttactataacctccacctcctgggttcaagcgattctcctgcctcagcctcctgagtagctgggactacaggcacgcatcaccatgcccagctaatttttgtatttttagtagagacagggtttcactatgttggccaggcttgtcttgaactcctaaccttgtgatctgcctgcctcagcctcccaaagtgctgggattacaggcgtgagctgctgcgcccggccaggtacaagcaattcttgttcctcagcctcccaggtagctgggactacaggtatgcaccaccatgactggctaatttttgtatttttagtagatacgaggtttcaccatgttggccaggctagtctcgaactcctagcctcaagtgatctgccctcctcagccccacaaagtgctgggattatatatgaagtgcttcagaggtgttacagaaaggacccacttggattgtggctagggatgagggtaggtttgcctgagatgacattataagcagaaatctgaaagctctaaggaacagaataaggcatttgagacatcagaaaagaatgatgtgtgtttaaggctctaaggtgtaaagcaccttgttcctagcagttgagaggaggcggtgttggctagaatgttggggttagagcgtgagtagaaataagattgtgcaggtcttgtagactgtggtaaggagtttgagttttaagtgaaatgggaagttgttgaagggttttaagccagagagtgaagttccctgattgacatttgtgaaagatgttctctggttacatggagagtggactggagaggagcagcagaagtggtaggaggctacttgtagtctatccagacaggagatgagtgtgctctgggctaagggcatgtttgtggagatgaggaaaagtgagtgaacttgaaacttcacatttctttcttgaatggactttttagttcattttaaaaatagctgtgggagagtgaaagggaagaggaaaagggaaggaccagaccagggaggactcctggctttctagctggagcaactgtttgatagtttcatttgctgaagtgttcaagattagggaagggaatggattttagagggaaaatctagaaattacatttgagttttagacttttaacgtttgagagtcctgtgagatacccaagtagaaactcaaagaggaatttttatttttaattttttaaatgttttaaatttaaaatgtttgttttttgagatagcgtcttgctgtttcagccaggctggagtgcagtggcctgatcatagctcactacagccttgagccttgacctactgggctcaagccctcctgtcttagcctcctgagtagttggaaccacagatgaacaccaccatgcttggctaattttttttttttttttttttttaagagatgtggtttccctgtgttgcctgggctggtttcaaactcctgatctctagcaatggctcctgcgacaacctcacaaagtgctgggattataggcgtgacccactgtgcctggctgatatttttatatatctggaaatttgagaagtatgagtgagagatgcatattgcaagtttataaaatgtaaatagtatttgaaatcagaagattggatgagatcactgacagaatacaggaaaaagaggaggagacctagaaattagccctaaggagctcctgtatttaatggtcgagtgaaggagaaagtgctagaaaagaagctgagaaaggatcctcagaagtaggaggaaacttaggtgcatggtttcactatcactttctcaagaaggatggagtggtcttctaaagagaatgttgcagagaaggtaaattaaggatagaagagtgccccattggtcttaaacatggagatcttgtcagggggcagatgacaaaaattggaatatctgttagacaaaaggtcagaataaacaatccccagaaaatacatgggaacataaatgtaggaaaatgttcatcattcctgatagtcaaagaaatgtatgctataattttgatgttaattttcatttataaaattagcaaaggcttaaaaaaatgagcacaaccagaactgacaatggggatataaaacaggtacaataaaaattattggtgagaatattaattggtaccattacttaagcaacaaaatatttaaaatagagacctttttgcgtcggagtcatctagtctgaattctgagatttggttaaaatatgtactctgtaatcttatttgtttagtgagctttctttaatactagtttgaaacttcctctctcatcagtcttaaggtttgtgttttactctgagcaattagtatttcccatgaagtacgtttttccctttgttcaggatgacagcaaaaacagttatgtttatattgtttctatttctgggaagtagattttttgaattagaataatttttatacttttgatttacaagactacaaatgcatatttaacataagtttgtttcggcttactaattttaggtctgcctgtgttttacacaaaaaattttttttatgcttcagatggcaagattattttatcataaaccccagtttgccattttggatgaatgcacaagtgcagttagtgtcgacgtggaaggctacatttatagtcattgtcgaaaggtaagtacgcaggtgctcagtttgaggagccatggcctcctacctagtgtaaactatgtccaaatctgtccaaagagaagattccaggtcactaagtaacaaaatttctaccaaaagatttcttgttttaataaagatttaaaacatatgaataaaagaaaaagaattataaatacagttctgtatataattctctttatatatgggaaatagatttaaatatgttgttttatataagtgagatataaaagatatatataaatgagatacaaaagatatctcatttatatataaatgagttacaaaagtttttaacttttatgttaaaagatttatttatttattttttaatttattattattatactttaagttttagggtacatgtgcaaaatgtgcaggttagttacatatgtatacatgtgccatgctggtgcgctgcacccactaactcatcatctagcattaggtatatctcccaatgctatccctccccccttcccccaccccacaacagtccccagagtgtgatgttccccttcctgtgtccatgtgttctcattgttcaattcccacctatgagtgagaatatgcggtgtttagttttttgttcttgcgaaagtttactgagaatgatgatttccaatttcatccatgtccctacaaaggacatgaactcatcattttttatggctgcatagtattccatggtgtatatgtgccacattttcttaatccagtctatctttgttggacatttgggttggttccaagtctttgctattgtgaataatgccgcagtaaacatacgtgtgcatgtgtctttatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctgtttctccacatcttctccagcacctgttgtttcctgactttttaatgattgccattctaactggtgtgagatgttatctcactgtggttttgatttgcatttctctgatggccagtgatggtgagcattgtttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttctcctagggtttttatggttttaggtctaacgtttaagtctttaatccatcttgaattgatttttgtataagatgtaaggaagggatccagttttagctttctacatatggctagccagttttcccagcaccatttattaaatagggaatgctttccccattgcttgtttttctcaggtttgtcaaagattagatagttgtagatatgcggcgttatttctgagggctctgttctgttccattgatctatatctctgttttggtaacagtaccatgctgttttggttactgtagccttgtagtatggtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcgtgatttggctgtttgttgttggtgtataagaatgcttgtgatttttgtacattgatttttgtatcctgagactttgctgaagttgcttatcagcttaaggaaattttgggctgagacaatggggttttctagatatacaatcatgtcatctgcaaacagggacaatttgacttcctcttttcctaattgaataccctttatttccttgtcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagataggtcccatcaatacctaatttattgagagtttttaccatgaatggttgttgaattttgtcaaaggccttttctgcatctattgagataatcatgtggtttttgtctttggttctgtttatatgctggattacatttattgatttgcgtatattgaaccagcctttgcatcccagggatgaagcccagttgatcatggtggataagctttttgatgtggtgctggattcggtttgcgagtattttattgaggatttttgcatcaatgttcatcaaggatattggtctaaaattctctttttttggttgtgtctctgcctggctttggtatcaggatgatgctggcctcatgaaatgagttagggaggatcccctctttttctattgactggaatagtttccgaaggaatggtaccagttcctccttgtacctctggtagaattcggctgtgactccatctggtcctggactctttttggttggtaagctattgattattgccacaatttcagctcctgttattggtctattcagagattcaacttcttcctggtttagtcttgggagtgtgtatgtgtcgaggaatttatccatttcttctagattttctagtttatttgcgtagaggtgtttgtagtattctccgatggtagtttgtatttttgtgggatcggtggtgataatcccctttatcattttttattgtgtctatttgattcatctctctttttttctttattagtcttgctagcagtctatcaattttgttgatcctttcaaaaaaccagctcctggattcattaattttttgaagggctttttatgtctctatttccttcagttctgctctgattttagttatttcttgccttctgctagcttttgaatgtgttttctcttgcttttctagttcttttaattgtgatgttagggtgtcaattttggatctttcctgctttctcctgtgggcatttagtgctataaatttccctctacacactgctttgaatgcgtcccagagattctggtatgttgtgtctttgttctccttggtttcaaagaacatctttatttctgccttcatttcgttatgtacccattagtcattcaggagcaggttgttcagtttccatgtagttgagtggttttgagtgagtttcttaatcctgagttctagtttgattgcactgtggtctgagagatagtttgttataatttctgttcttttacatttgctgaggagagttttacttccaagtatgtggtcaattttggaataggtgtggtgtggtgctgaaaaaaatgtgtattctgttgatttggggtggagagttctgtagatgtctattaggtctgcttggtgcagagctgagttcaattcctgggtatctttgttgactttctgtcttgttgatctgactaatgttgacagtggggtgttaaagtctcccattattaatgtgtgggagtctaagtctctttgtaggtcgctcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggatcacaacccctgccttttttttgttttccatttgcttggtagatcttcctccatccttttattttgagcctatgtgtgtctctgcacgtgagatgggtttcctgaatacagcacactgatgggtcttgactccttatccaatttgccagtctgtgtcttttaattggagcatttagtccatttacatttaaagttaataatgttatgtgtgaatttgatcctgtcattatgatgttagctggttattttgctcgttagttcatgcagtttcttcctagtctcgatggtctttacattttggcatgattttgcagcggctggtaccagttgttcctttccatgtttagtgcttccttcaggagctcttttagggcaggcccggtggtgacaaaatctctcagcatttgcttgtctgtaaagtattttatttctcctttacttatgaagcttagtttggctggatatgaaattctgggttgaaaattcttttctttaagaatgttgaatattgtcccccactctcttctggcttgtagggtttctgccgagagatccgctgttagtctaatcggcttccctttgtgggtaacccgacctttctctctggctgcccttaatattttttccttcatttcaactttggtgaatctgacaattatgtgtcttggagttgctcttctcgaggagtatctttgtggtgttctctgtatttcctgaatctgaacgttggcctgccttgctagactggggaagttctcctggataatatcctgcagagtgttttccaacttggttccattctccccgtcactttcaggtacaccaatcagatgtagatttggtcttttcacatagtcccatatttcttggaggctttgctcgtttctgtttgttcttttttctctaaacttcccttctcgcttcatttcattcacttcatcttccatcactgataccctttcttccagttgatcacatcggctcctgaggcttctgcattcttcacatagttcttgagccttggttttcagctccatcagctcctttaagcacttctctgtattggttattctagttatacattcttctaaacttttttcaaagttttcagcttctttgcctttggtttgaatttcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttggtgaccgtgatgtacagatgggtttttggtgtggatgtcctttctgtttgttagttttccttctaacagacaggaccctcactactgatttcttctcttctttcctccctttttcctttttttccttcctaaatgatatagaaattttaggtagtcatgtaaaagatatctcattgatatataaatgagatataaaagatacctcatttatgtaaaacaacatatttaaatctctttataattctctttatatatgggaaatatatttaaatatgttgttttatataaatgagatataaaagataaaagatataaaagatacctcatttatataaaacaacatatttaaatctatttcactttacctcattacttagagttaataaactgaccttttcttaatttttccattaactttatctaaacattagagtttttttatgaataaaactcaacaataattatttggcaatttttaatttatccgttttattttctagcctgagcaatattttaccaaagctgcttttagtagctaagtctgaggctatctttattggttccattctttaagtaattattcaatagtatcagttttctttctttgagaaattgttaccaacatctatactatggttaaattttggaacaaatgtagtatatcctagctgttttatagtttctatataagtaaatgaggtagatgaggatttttaacattttgtatgtgttctttgggagttctcaataaataaaaaaggtcatattgagtatatatattatgaattcctactattccaagtgtgttcatgatcagcagcagcagtgtcacctaggggtttgttagaaatgcagaatttcaagccctgctaaatcagaatctgcattttaccaaaattctaagatgattcaaatgcgcattaaagtttgagaagcactggcgtgatgatgaaagaatttgctattctttgtagaaagattttaactactgattttatcttgttaatgatttattttctattcttgaatttgctttggtaatatataattatacatttgttcatgttggttttcaaatatataggtattagagatgtttatggtattctcatgtacataaaaccatgtagtctgcagttgattcaatgacatagcagctctttgctggtaattttgaccacgtgatttcctcttatgctctagctataggcttgaagtccccacataagactgtataaattctataaaacatcagttccatttaaaagaaaattcatatggggcctcattgataatttaaattactgtgataccacttaaacatgtataaacatgatgaggtgtgaattccttaagcttagagctcttttacagctacaaaactaatataaacttacacattaaatacattaaatacagacaaaacttaaatacagtttcaaatttacaacattaaagagacctatgataccgtttagatgaaactaaaccagtggtttgggatttaattaaggaaagatagaatctgaggttcaaatttcattattttgcattttgctttttattttgacttatatacttcatatattttttatatcctcatgtaaagaatgtgtgcattaagtagatgtctaatccaattattgtagtatcataaacagagaaataatatcttaaatgagctctgaaaaatcagaaaagtgtggtatggttgaaatatatgttttattaatactgataatatgcttattttattatgcaattcctaaccaatttaagaacctttttacagtgcagccaaacttattacacattagaagttttattttatatcactttggcaatcagaggtgtagatacaaaccgaggaacttgaatctcatggtaaaaatgatctagaatatacttataatgatcttttaaaaattatcatcaaaatgaaaataaaattaagaaaccatggtggaaatttcccagatgccctaagcatgcatttgccagccttgagtgatccacttggaggaacagtgacccagagtggggtttctcagtcctggcactattgaccttttcactgttaattcctagttgggcagggttgagggttgctgtgcactggaggatgtttagaaagcatccctggcctctgcccattagatggcagtagtgctttcagttgtgaaaataaaaatgcctccagtcattgccaaatgtccccctgagggacaaatatcactgacctccccaccttggttgagaaccactgatctagagcaactacagctattatctattaatgtttttttttttttgaaaatctgaagtacagatctataaatacgtattcacaatctgaaatccagaaagtgcttaaatttaaaacatttttcataattttgtagcaagctcactgggtaaaacttcgcctaagctaacaaaagatatttaaactctatatgtctcaatatcagtgtccatgtgtgttgctacagaaacatttatgtgtttaattataaaattctgcctcagaactctctgggggtgttaaataatacattttcaaaatctgaattccaagacacattccaaaacagtagtttacggtaggggattatgaccctgtatttgaaaagcaagttgactgtcaacaatgctatactgatttaatttttcctgattttgacctttggctatttttatccttctcatattcctctcatatatttttcacaataaaataggagacatgataggagatatgttttttgcccaaaagaaaataatacacttaatgccagtacctggtagtttttattatgtggttgatggccagtactttccattgctataaacattttgcatccagttgtaaattttttctcattgacattgctttttaactttagtcactgaagactgtcctcttaacagcttaaagtacatggactagtttaatttgtgactctgttactgattaaacctaaatcattttctttgtattaggttggcatcactctcttcactgtgtctcataggaaatctctttggaaacatcatgaggtttgtatttctttcattgaatggtacagtgaaattttattttctttaaaatatgaattcaggttaatatggttttagattttatggtttgtattcccttaaacatatgtcttaaggagaaaaggtggttttgttttataaaataggattttcttaaatattatagttgtcagttttgaaagcaatggtgtaacagtttttctccagttttataagtgactcttatctgttaatagtaactgactaaactttgcatagtcttatcacaaatatggtgaagtaaacttttcttatccagcagtgacagaggagaaaaagtcttaagaagaattagatggcaaaaaatttagggacatttttaatagaggtcaggactacaagggggaagattgaataacataagctatgtttatcaatgtactgtagtaagtaggattcattagatagtcactataatttacaaagatattcaaatgaggcttacattggtgcacgtgtattacttattctggtgcttcagtagtgccattctcactatgtcagttcttttcaactcaatgtgaaatgctcaaaacctgaaagtaaacccagtttaattctctttattttctttcctcctccctccctccctcccttcctttcttccttcctttcttttcttctttcctttctgtctttcccccttccctctttcctttcttctcttctttccttcttttccttcctaaatgatatagaaattttaggtaaaagcaaggatttgagaaaaattggaataatggtaaaggtgccttgttccacaaaatacatacctgattaaggacctttttttgccagatactgagctaagtgtcatgagggatgcaaattaattacagtttttaccttcaagaactttaggatgtagatgatagtctacaagtgataaaatgaagagcataggatttgaagtcagagagcctgggttcaggcaccaaagtttctagcctcagttgcttcctttgtataatgaagttattgagccttaccttcctatctcttagattaccatgaaaattagacaggtagcctatatgaaagtacttaataaaattcagtgaaattctatataactgtgtgacttttaaagatagcttttattattttatggcatattataacttgtcaatttttcatgaactgagcaggaaattgaataactagaaatcaaaggcatttaaaatatagccaagcctttatgttttctcggaagttcataagtattatagccataggacattgagaggaattgagagcatttgggtttcacccttcctcttcttttggaggtatagacaagtagcaaaataatcatcacgccagtgatcatgtgaaggaggggaacacaactagaatgtgaggggccaggatagctaagaaatagtaatacagaaaatggaaactcagaaagctttctgaaaataagccactaaataaaaacagaaggctttgtaactgctgttgtgtcttcagaggttaggatatatcggcagtttttatagctctttttcccctctactaaattaaaaacaaataaaaagccttaagctggagatttcaagctgattaggaaatcaggctacaggaaacaatactgactgacctatggaacagtcttgcatttagcacagtttaacctactggtagctgagatccttggtcatggagttacggaagcattctgatttgtgggatgcttatagatttagctcccttaaaataatgaggaagtctgtattttacttttcataaaagacagtactatattcactcttagttactgactttttttcccccttctttcccatagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggtagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttagcacagtgtctcttttttaaagttttgccaagtgtggtttttaattgaatgaatttctcttttagaaaagttcagtaaaatctgtgtacctgacaaatgctaccaaacagccaggagaccttaaaagatactattcgtcttggaaaagattttaaggcatgggaaagtttcagattttcagatttctgggttaccttaaacctactcgtagaagtattctcctagctgccttataattgcttttgttatgattcttgccatcaaaacaacaacaacaacaatttgggctttttttcttaattattttcttttttatgtaacaaatattacagtgcctcaccatttgaggcacagaggaagatccttctggagaatcacattaacataatagtggttcttcgaagacccacagtaaagaaatccattggttcaaaaacatgattgaccacggaacatctttttctacataattcctattaacaccttccagaaactgcagtgggaaatggtagtttaatccgaagaataaaccaaagaataagaactttcatccatgagcaccacgctgcatgccaagacatatcaccgtgttctcataataagtttttactttttatataatgagaaaataagtatgaaacagcaatggtagtttgttttgcattaatagaataaaatatatctagcatttgtctctttctcccctttctgaatgattaacatttggcttaaaaccggtgatatgatagcatctggcattactttatgtaaagttttaacttttaaatttggtgtttaaaatcataatttgtgctgagaagcagaatgaattttcttctaacagatggactttgacattgttagctgcaggaagctgtctctttttttttaaacctacattagtgatttttcctttgtgaagaattggaatgttctgaccatttccatatacataacatatgcatgtcactttaagaaagtgccaaaaaaactgaaaagcaatcccctccaaaccttaggagcaacgattttaaactcttctagttggtgtaattgcatttcatttttttaaacaatatgcctttatagccatttcttgatttatcaattttagacattccctaccacctttgtttctgccacatcccctcatgtagttaaatcattttttaaatttgtaaacattttattgtagtatatgtacaaaaacattgataaatttataagaaagcatacacactggtaaccacacccaaacaccaaatgaaatagaacattgttacagcactaaaggctccttcttgttctcttccaattattagctcctgacttctatcacataaattggttttgcctgtttctggactttatatatattagatacccttctgtgtatggcttctttccctcagtattgtgaggctgattgatccatggtaagtgtgaccataattccttcactttcattgctgtataatggttaattgcagaccatccctgacttaacagagggttcaccttacaagttttcagctttatgatgggtttacctggatgttaaatgcattttttgacttaacgtatttttgacttactgtgagtttattgcgatgcagctccattgtaagaccagcagcatctctatattgaataggctatgtattcctcttcccattgatgggcattgggttgttttctgtttggagctgttaggaacacttcatagaaacactcttatgcatgtctttgggtgcacatgtgtgtgcatttctggagtggaatgtgttcagctttggcactgccaaagttgttcagtttttacactgccaccataagtgtgtaagaattctggtcttcttagtccttgcaaagatttggtattcccagtgttctttttttaatttttatttttacttaatgtatcttcagccatcattgtggtttcattttgcatttccctgatgactaatgaggttgaactcatttaatgtttattggct

SEQ ID NO: 15745 - DNA, 16439 bp, Human
tatgtactttttaatggtgccaagcagcagctattatagatcaactgctgtttggcaccattaaaaagtacacttcgcaccgtcaaaaagtagatctggccacaattagatcagtcagggaaaaacacttcgcaatgaaatattatttaccacgttttcttcctccctcttcttgaaaatagtaatgactttagcatttttaaatcttgaagaatgtcattccgtactgactaaaaagcctgtgcaaacacccaacatcttctctttcctgtctattttaatggatatacaaaataaatattcatctaatttatcaatatttaaggcacattgtgtatcacaatccaatggtaaacatttttcttatcaaatggctgatcttgacattgtttaaagccctatatgatttcagaaaagtcagtgactccaagtggaattgcaacaatttcttgggtcttgtaacaaacctgaagtgtaactatttctcttcagctaccttcaatcccagagagcaaagaatcacatcccaggtggagctgaagatctcttagggaaaatgactcaggctagagcctgcataaaaagaggattgcatggcttagttttgcaaacataaattttgtgggtttcagagctggcagagagctcaaagaggaaatcatcaagggcaactttctgcttcgaggaaggaaagtctacaagggctaaacctggatgtgctatttcagttcaggcaaaggaggaaaattaaaattttgcacagttttattctgttaaaacaagtggttcagtatatagtatgcattaaaatgcaagactgacttccctgggaaaacgtgggaaagaaggagagaggaaacaaacaattcttacactaagaattctccagtcgtgtcttgcaggcaatatagagtaataataataaaaatgacaggagatactttgacaggatggcttaaaatgccactcaatagatgaagagttgttctcatgcttggcaagtttacagcaaagcccagaaggagaagccagaaaataatttagaaaaaccaaagcttaaaactagtggcacacaactctggttacatttttcattttcatttttggttcctctgcatttcggtggaactcagtcccacagatgtcttcttcaatgtgggaaccatcctttctggaaccacagagctgcagatgtcacgctggaattctcccagaggcaaactgccagatgtgaggctgctcttcctcagtcactatctctggtcgtaccgggcgatgcctgagccaactgaccctcagacctgtgagccgagccggtcacaccgtggctgacaccggcattcccaccgcctttctcctgtgcgacccgctaagggccccgcgaggtgggcaggccaagtattcttgaccttcgtggggtagaagaagccaccgtggctgggagagggccctgctcacagccacacgtttacttcgctgcaggtcccgagcttctgccccaggtgggcaaagcatccgggaaatgccctccgctgcccgaggggagcccagagcccgtgctttctattaaatgttgtaaatgccgcctctcccactttatcaccaaatggaagggaagaattcttccaaggcgccctccctttcctgccatagacctgcaacccacctaagctgcacgtcggagtcgcgggcctgggtgaatccgggggccttgggggacccgggcaactagacccgcctgcgtcctccagggcagctccgcgctcggtggcgcggttgaatcactggggtgagtcatcccttgcagggtcccggagtttcctaccgggaggaggcggggcaggggtgtggactcgccgggggccgcccaccgcgacggcaagtgacccgggccgggggcggggagtcgggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtgagtggcaccagcccctggaagcccggggcgcgccacacgcaggagggaggcgacagtcctggctggcagcgggctcgccctggttccccggggcgcccatgttgtcccccgcgcctacgggactcggctgcgctcacccagcccggcttgaatgaaccgagtccgtcgggcgccggcgggagttgcagggagggagttggcgccccagaccccgctgccccttccgctggagagttttgctcggggtgtccgagtaattggactgttgttgcataagcggacttttagctcccgctttaactctggggaaagggcttcccagtgagttgcgaccttcaatatgataggacttgtgcctgcgtctgcacgtgttggcgtgcagaggtttggatattatctttcattatatgtgcatcttcccttaataaagagcgtccctggtcttttcctggccatctttgttctaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggtgaatcttgtcatgaagaaattctaggtctagaaaaaatttgaagattctttttctcttgataattcactaatgaagcttttgtggttgaaaaataaaaagtgaggtttatggtgatgtcaggtgggaaggtgttttatacatcaatacattcgagtgctctgaagtgcatgtaataatagctgtttctctgttgtttaaaggcactacaaatactgtggcagcatataatttaacttggaaatcaactaatttcaagacaattttggagtgggaacccaaacccgtcaatcaagtctacactgttcaaataaggtaagctgggtacagaaaaagaaaattaaggtctttgatgtttctactgtcctatgctgaacaagaatgtctttaaagctgattactggatgaaattatttaacagatgacgaagaagaagggattcttggcaattcgctggccggtgtcatactctattaggcctgcaacatttccagaccttaaactgatagaacattttaattgttttaattgtttttggaaatgatgggagagttcctaagtggagtataaactgtggagagatgaaccatcttgagtaggcactgaagtgtgctttgggtcatgatagattaattaatctcatctaaacattgatgtctttttctgttgctgtctagactgtgaacaatgtctaacaccttagggaagaggtggggaggaatcccaatgtatacattgcccttaagcagtgtttgattcattcatctttggactccatgaatcgaaatctggtagaatacatgatcttagtggaggaggccaaatgcgtgactcactgagcctggcagagcagaaatactctgctgtctgcaccctctgggtctggtgtggctctgcttcttggtgcttcaactctgactggcagctgtccccaggaggcgataattcagcatgttcaatctaaaggttatgacttccttgatggttttcaccatattcttggcaagtttttggtttttgaaatgttctaggaggcttggtagagatcttatgaaatagagaatagctgctgtggaaattattttaatgctaattacataaaagtacaaaagtagcactagctaaaacaaaaggtattttgctgttctgttttgttttagcttgtgccaggccttttacagcattaggaatgcaacttctagataacgatgcatcttttaagtgaatgttcttgtttttcaaaatgaacttcatgacagtagttgccaaaccagcaaggagaacttgcatgcatacgtgcatgcatgtgtggatatgtatgggggtggggggagagaaagatgaaggaatttcataacatgaaataatgattacagttctggtcaaacttgtcaattcagatttcaccaattgagaattagtaagtaatttctctgatacaggcctgaagtttaccttagtaaacactttacttccatatggtaaaaattagattttgggaggaatgcttacctcctaaatatattcaatctaatatttgagggacacatgggaatatatttatgattcatctgctttttaaacataagcctttgttaactgtaagttcttgaactttataaggctgctgttatttaaatgagcacagctcctgatctgcaaacagcagagcgcagggctacagcttgggggatgccagccgactcagggtggtcctgtggactgaacaatctcttgctgctgtactggagggcctgggagcttttccatcagcctcggcctgaggtgtgcactcttctcctgcccaccccaggaataaatgagattcctggttaaaaaggaccagagcagtcattttacagttgaggaaactgttgctctgagaagtgagggatttattcatgactacactgatggtgagtgcccatgtcaggtctggaaccaaagtctacccagtatccacacaccaccatccctcaggtggctctgccacagtctgatgggaggctccaaagcgggaggaagaaggaaagtcttgcccactgcatctcctcagttggccttcctctctgcctgttttccctccctacagttagcatcttaagcagctgcctctcttccctcccgactgctctcactactgcagcctggctccagccgcaggacactactgctgtgcagaagcccctacttggaactccaactgcatttttcacctttgctaacagttttcagtggtggttgggaaatgttattggcttaagccttagcacaaaccgtcaccggtgatattcattccatggaaatgttctgaattctaaagctgaatttacaaagcttctggaaaacaacctgcaaccaaattagtgactgaattttttagttaactcaaaattccaaatcagagggttttgcaatgcctggaggaaccttggaggcttttaaagtgttaatgctattaatggcattcagagggattttctacagaattgtcccttcattacctgtttatacagttttactacttaccagggtactgtataaatccttgtgctaaattttgctatagagtatgtggtccctgctgtgagctgggaggaaccaaatactgtatctctatgttacatagaaagccctaggagactttctcctgttatctgaacaactatttgctgtactgataaaaaggaaacagcatagtctcattcactttttgaaatggaaatgataaaataaaacacattttggtcattcgggaacaaaataccctctctacttttatcacataaaattaaataaatagaaaccaaaatatttcagtatcaatcttagtttgtgcactttaggataaagaatgtgtttacccaaatccttttggcctggttacttagttcagattttgaaagaaaatatatttgtggcttttatgtgtgaatttagacaatggaatccatgtggtgcctcgttttccctgagattatgtattaattcaacctgtaaatgcaaaccatctaatagtcagcgagaccctatagccctgctgcttaatgggggcacacaagggcatgcagccctcgtaccaggcagactgtgttcatattaacagcatcgtggagaaactcatgctgggggacaggggagggagatgtaaatgctcagcagggagatctggagattcctggagcaggtggagttgggacctggccttgaacgatgggtctggctctggcagtcagtaatgccaaagggaagagcagcataactgtcactttccatgggacagaagtgtgtgaatcaagttgcagtgacgcttcacctatttattattttggtcatttagaagaatttcattgtcagtagaagtcctttaaatcatttccccttcagtgacgtctcacaaaagaaagatctgtctttagctttttagtctcagactttattagacagatactacctgtactcttattctgtaatctttgttgggatggattcacatcttgcaaaggaagggaggcatgtagtataatggggcaaacagacccagctctgccactcgttagatatgtgaccttctgcaagttgcttagtgcctgtgagcttcagtgtcctcatggataagaaagatccaacaccttcttggaaggattatatcaaatgaagtaacatgagtaaagggtccagcagaatacctggcatatagtggagtcaatgaatgattaataatattattaatagtggtcatgagagaatatatgtataacatgttattatgtagactcactatatagactctattctacatagaatatagaacattatataacaaacaactataataagtagactatagtaaacaacctcactttgtctcagttgcctcatcttgatggaaaactgctctttctctcctgttaccctgacagagagcgtctacattctaaaagaaagatatttaacaaaatggttgagtacagatccaagagtcaaatagctgtctggttcaaagtccagctgtgtgattttgagctagtcacccaatctcactttgtctcagtagccttatttgtaaaaacaaggcaaattacagagccatcccctgggttgctatgaggactcaaacatgcatcccaagtgctcggtgttgctaggtatgatggctcacacctgtacattcagcactttgggaggccgaagcagaaggatcagcctgggcaacatagcaggaccccatctctacaaaacaatgtttaaaaaaaagcaaagtgctcagcacagtgactgcatcattaggattgattgtagggctcctgatgttagcacagaacaccacagccaggaagcagtctatcttgttgggtgcaaattgtaacattccatttatgtttcttccttcttttctttctttagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagagtaagtggcttgggctgtaataccgttcattcttgttagaaacgtctgaacattctcgtgatcttgtgcctttaggggctacaaaattaaaaatatttattctttttttctcagaaactggtatgtatcacagccctcttcacacattccagatgtggtaggaggttcacagaatgtgaactttggagctgatgacagtgtcatcaagtaactttctcccccagtctgtccccagaccctgttactgtcctcagtaaccggctgaatgtgtgttgggagagggcgggccagggaagcgggtagggataggaaatccaccaaggccggggttttagcttttccctatatatatatcatgtatcctgatttttctgtcccgttatcacactaaaaatcccagttgaggatttttcccaaacggtcataaatcaatgaggaaagtccatggtttccctctgagcccataattagcctaattatgctgaccttttctaatcagttggccatgatttgagttccgtgatgtgccagcacctgcccagccatctgcctgtcaccctcgttctggttttggaaaggtggaatactttcctcctcagcctttgcccctgtaagctggccctaggagccagtaaaagaatgaagagaattcctgtcaagtaggagatttattcttttgccgcaactgtggctctgagctaggcaatttagataaatgcatgtagcacattgagtagagtgaaattagcttctcttgtaaggccagctggttagaatgaaggtgttgtgtgagtgttaggcccagcgagagagaacagtttctcaaggtaggaatggtgaaaagaaggggtggacggacaaccaaccaaccatcctcctctggtatctactttgagggttgaaatagggggcctgaccccaggtgaatgtggctgccttcccagagcccccatttgcaagaccctccagacccccaggtgcttctgcttgtgtcttttgtggcaccaggcaagaatgtagcagcgtcagcagcccctctggtgactgtggcatggttgacattcatttcccccctaattaatggcatcctcatgattctcttttatattaatagttcttgagtttttttgtaagctacttcaaatcctttgttggtgcaagatagaagatattttatgtgtttgttttgcatgtgcacacacatatttggcctgtgaattgatgtttgttttcctgtcatttaaccaaagcacatgagataattgagccattgcagagaccccgtggttaaatccggcttctcgaggtaccaaggacatttcctgggctttctcacagccctacatatttttgaacctaaaatatcgtagtttatgctaccaccctgttcagtatagtagccactagccacatgtggctgttgaccacttgaaatatggctaatgctctaagtataaagtacacactggaatttaagaagtgtagaatatctcaaaacttttttatattgattacacattaaaatgattatattccagatatatgcagttgactcaagcaatgcatggctgagaggcaccgactccctgtgcagttgaaaatccgagtataacttgactccccaaaaacttaactactaatagcctacctatcggttgactgttgactgcagccttaccaataagataaacagtcaattaacacacatttttcatgttgcgtgtattatatactgtattcttacaataaagtaagctagaggaaagaaaatgttattaagaaaattataaggaaaagaggctgggcatggtggctcgtgcctgtaatctcagaactttgggatgctaaggcgggtggatcacttgaggtcaggagttcaagaccagcctggccaacatggtgaaaccccatctctactaaaaatacaaaaattagccaggcgtggttgtgggtgcctgtaatcccagctacttgggaggctgaggcaggagaatcacttcaacccaggtggaggaggttgcagcgaactgagattgcgccactgcactccggcctgggtgacagagcgagactctgtctaaaaaagaaagggaaagaaagaaaaaaaagaaaagaaaagaaaagaaagaaggaaggaagagaaagaattataaggaagagaaaatatatttactattgataaagtggaagtggatcatcataaaggtgttcatcctcgtcatcttcatgttgagtaggctgaggaggaggaggaggaggaagagcaggggccacggcaggagaaaagatggaggaagtaggaggcggcacacttggtgtaacttttatttaaaaaaatttgcatacaagtggatccacagagttcaaacccatgttgttcaggggtcaactgtctttggttaaataaaatatattattaaaattaatttcacctgttcctttttactttttctaatgtgactactagaaaacttaaaatgacatctgaggctccattgtcttccccttgggccagcactaccacagaatgtcttaggattcagctccaggccgccacgcctgcttctttcagggagctggttctatgcacatgttttatatgagagataattaagttgtcaattgtgataacaaaacaggatttgactttgtacagaattctttggttccaaccaagctcatttcctttgtttcagcaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaaggtgagcattttttaatttgtttttatgacctgttttaaattgtgaatacttgggttttacaacccatttcttccccaattcaaaaatagcagaacagagttgttgagaaggtgatggagtagaagggggagcgcgcactgtggggaggggtggacaacaggcctggtcctacctgtgactctgcactaccctgtgactctgggcagggccccctcggagacccaggttcctcagccaaccggctggatcaggtcatctctaaaggtcccgccacgctcacatttctccctctattgaggatcccaggcacaaaatttgtttttggttcaatgcataatactcccttcctttttcttttactgcagatatcttctaaaggggctcaatagggttcaatatgcctaaattggatcttctcagtcttggaaaaggcatttttagcagtgatcaagggaaactgattagcgaagtcacttctaatccttcacgtgtcagctgtgttcttgtaggctttgcttagaacctaggtttttacttccacagtgacttaataaaggggaaagaattgactcagagcccagatgaattaagaactctatctttttacagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagaggtgagtggctctgccagccatttgcctgggggtatgggtgctgtgggtgacttctggaggagtagctccaccctcagggctgggatatacttccttggttaaatattcaggaaaacaaactgcctggaggttttttgttgttatttgtttgttttggttttgattttgctttggtacaaaaaagattttggacatttagaaatgtttctgtgttgattgtgcccttgtattagcaggtgttttcttgagcacctgtcatgtgctaagccctctgctgagcactggatacacaaactgtgtttaggatttagcaacaagtcacagatttccctgggcattttttcatgcttaaattctaattctgggggtggcttctggaccagctgcagcaggacacagtagacattcgtgagtacccactgtgggctgttgccacagaggctgtagagtctaacccatcaagggaagggattgagtatatcaaatatacccacatgcatgcatgtgtgtatatggcggacacgtgtgtgtacatgcatgtgcatatgttgggagctcaggcccattgtgcgaggaacagtccctaaccggaagtgctgtgggccttcagactcttgcaggaagctgcaagcctgtgtgtctcgatccatgccttacagggaaagtattctgagtactttcagtgaagaaaagagtcaggggatataaacgatggcttacgctgggtgtggtggctcacgcctgtagtccctgcactttgggaggcccagacaggcaaatcacttgaggtcaggagtttgggaccagcctggccaacatggtaaaagcccatctctactcaaaatacaaaaagtagctgggtgtggttgcacgtgtctgtagtcccagctactcaggaggttgaggcaggagaattgcttgaacctgggaggcggaggctgaagtgagctgagattggaccactgtactccagcctgggtgacagagcgagattccatctcaaaaaaaaaaaaaagaaacaacgaaaaaagaaatgatggcttagctccatgtgaagatgatatttgaacattttaaaacactttaaataaactgttctctcctgtttattgccactgacaggagaggtttctctttacctctggtcctgcacccctctgagccatcctacccacagccttcagtcattgtcctaaagcctagctctaattccactgcctctccttttgtgcacacacacttctctgcttccctggccgttctctatcttggagaggcatttcaaacgccacttccaccagaaggccttgctactgcaccaactagttactatctcttcttcacccaaatcctggtagcactttggatctcccactttgcacttagggttcaccttccgttataatcattgccatcaatctcagcatcgtttttaggcacttctttccagccattgttcttacctccaactacatatcttttctggactgtgcattattcagtttattaaatgcccattaaatgtgtttagccattgtcaattactctgaaacgttcaggttttgacaaattctttcctaatgtaagtgtggtggaaagagtgaaagaaagtcaaattgcacaaaaataggatggtgtaatttggggttatgccgtcaattttgtccactgataaatgggatttgagctctccaagttgactagatgccctttatttttcagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactacagtaaatgactgtaaaattgtcagtggcttacaacaacgtatctttttcgcttataatacattttggtgactgtaggctgactgcacttcttctcaatgttttctcattctaggatgcaaaccaatggagaagcccctaattagatcagggcagagggaaaaacaaaaaactggtagaaaccggcaaccacagcttcaagctttaagcccatctcctacacttctgctctgtacgtgcccattgtcacttctgttcacatgctactgtcccaagcaagtgaccaagcctgacaatactttgtctactggagtcactgcaaggcacatgacggggcagggatgtcgtcttacagggaagagaaaagataatgctctctactgcagacttggagagatttcttcccattggcagtagtttgactaattggagatgagaaaaaaagaaacattcttgggatgattgtattgaaacaaaattaggtaaaaggacaatataggatagggagagatataagtggaatgagatctctagagtccattaaaagcaagctagattgagagctcttggagggcagggactgggcctagctcatggtttacagctcttgagggtgactgcacagtggactcagtcagtcatggctgagttgagttggctttattatctctagaatgtagttctccattcaaatgcaaaacagccttattctctcaactgtagtaaaagaggattctaactagagatgaaaaaggttcttggcacctactgggccacaagactgcttttgcttcccactgtggaagggggcactgttatctaggaaaaacatccagatggcacacctactcagaagtggttccacaaagaaattgagcaagcattcagatgagcagcctcagctcactatctagctgttaataaattttaagtccgttttgttcctttgcaccaaagaaattgaacaatgtcaataaaattccaaacgtgaactgttttatgtaacaccacatcctaaggaagaatgcctgaaacaaacctttgatgtcctcataaaaatgatagccattttggagaaattatggaaaacagaccagtggttggtttatttggttggttttgtttattattacttttttttggccatcaacacagaggctagagaggttgaatcttgcactgttgtagtgttttgttatacagagaaaagggatgtatttgcagcagagtcaacaaaaaagaaactggcatgggggcacatcctcaaggtgcttcaacctttatctcaaattcctgctcacatggggctacctgggacaaagagcttagtgcattacatgaggaggcagaacaagctacagcagaaggtgcctaaccagatatttccctgccaggattaattatagcattatgtaatttcttggcctcattatctaaggaatttgaattattccactaaggaaaatactggcagatagaaaacaggtctgggtactaatgaggaatctggctgatcacaaggaagggattcattatggactggaatgaggctgaactgcaataatcagaaagcttccacacagcaaatgttaaccactccctactttgccacatccctctgaattgctgagacctaacagccgatactaaaaatcagcactgtgattgacactggggcagaaaccataccaaagactgttggctgcaatccagaaactgttgccctccagtggaccaaattatacttcattacttgaccagtaatgtaccccatagagctaattgttagttaaccaaactatcatgcattctttgttttgttttgtgagacagagtctggctttgtctccaggctggagtgcagtggtgagatctcggctcactgcaacctctgcctcccaggttcaagcgattctcgtgcctcagccttctga

SEQ ID NO: 15746 - DNA, 118868 bp, Human
aactcagcgtaaaatgctgtagtaggggaaatcgaccaaagacgagattttgaaagccttttgaaagtcgtttttctagctaaaaagaaaaagtgacttattcaggactgactccccctgccagtcccaggaaacaggagcagcccggcgcgcccgggagccccgcagcgcagtgcgcactgcggctccagagcgaagggctggcgcccgccagattctaaacgtgctcggctgccgcagcccgccggggccgcgcgccgtggtccgcgcgactccgcgctccgggtttccgcggtcaccagcactggcggaagagccctgccgagaggggacagccgcgggcggtgtcccgggagtcccgagagcgcgctccccctttgcgcaaccttcccgaggcgtcctgcccgggaagccagttcctgggttctgggctggctaggttggcagcgaatgaggcttaggcatcactgcctgaggccctcacttagcatgtcgacagccacagacttgtctggcggagtttctcctggtgcccacttaagtagtctcaagtttgttcaaagctggactcctcgacttggaaccaggagcagctggagatttgtcaatttagagctcatttgccacgggagacgctcttggtgtccccagcaccgaagggtaggtcaactctacagttttcctgaacatgataaggtgtgtgaagacgctgtgcaaattgtacagcgctctgcttaaggagaacctcgatcttcatctcgcccccagaacttccctcccttgaaaataaaactcccacctgaatgtaaagcccaggagggggttttgttaaccgcacttattcccaaagcataaaggaatgtctaatagttttgcaaatgcttccatgaataattgttgaatgagttcatgtacaacatacacacttgaggaaaactggtctggttgggaacatctgggaattctccttgcttttctggtagggaagcgaccgaccaaacatttattgggcactactccttgccaagccttctaggctttggcaggccaatggggagccgggggagggctggcaaacctgttagttgttcaaggacacaaagggggctttataagatggcctaatcagagcccttaaacgtgggttcgcaaaatggttcattcccgccctttcacccaccccctcccaccccagacgcaaagcatatgttaaaaacacttaagtgcatacagaaggcgcttggctcagggtacacagggcaagaagcctcggatcccagctccctttaacacacattttttcaacgccgttctggaccgagactgtccggggcactgggtgctgcaggacccggctcccagtactcctagcagaagaccctctgatgaaatggcccatgacaaaatgaccaccataaccgttccttcagtaagccaggtagacgtgctcacagcttgctgggaagtcttctttcggagatttctgcagttttctccttcaccttacagcctaacaaagggtgggccgggggtcggctaggacagaaagcagcgggaaaagcggctccacgtgttccatctctggcctcggccttcagcccccaggttcggtaaccactgggcgtggcgagtccgggtaacccgcagtccctcgcgcccgtccaggtgcgggttgctccggtagccggactcccttttcctatatactttccttttgagcttttgctaaaatctggagacgtggaatccacccgcggaaactccgagcccctccgactgagcatgcgccatcgccaggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgtaagtggaaaatacaatcttcgttgcatttctgcatgtgtagtgcaaccaactgtcagagaaatgctttggctattgtcacatactttgctttgcatagatgcgtctaaatgcatggggacaatttccttgcttaatgctggcgatctgaatgtgctcttagtccatgggggatcttttggaatattgggggtgggggaagggggagtgtttatatgcggcgtgtttgggggattgtcttagactagatttaagacaggtgaaactgagatgctttcttagtttgtcttagacagatttaagtagctaattgaccgattgtgaagttttccggttgctgataaaactattgagcgggtacagtcgagtagcaacctgtcatccgtgggattggtgcaccatttttctcaccgtggaagggcagcaaaggtgtttgctaagtaaaactgagtggatgagattggtatggaaatcatggttgatctctgagcgggatgttagtgtttaagatccacggagtcaggcgcaaaatgagcacatttctctcagtattcagaaatgagtagataatttttttcgtctttgatttttgtcacaatggtgaatgggcagaaaagggaaagatgctctactgcactgtcgattttgaacggagtcacaggctcggtcgctgaatggggactgtcagacccaaactagttacctgcctttgcattccgtgttcgccatccggaatctggggttaaaaaatgtaaatcaaggtgtgttacatttggtagtatttctttaaaggataaaaggtcgttttgtgttttgagttaaaatgggttgttccttgcccagaaactggaagaagggtctttgcaaggtcaaaccccgggtggaaatcagaatgatgaataccctcaggggtacaagaatgtgtacgtggaaggagcgaggagaggctgatgctccctgcatggtggaaatgatgagtgctccgcattgcctgatcagtgccctgtgagatgccagagtgggaatccatttttctagagttgccctcctgtccgtattttggaaactaaaataaaatagaattgttggtggttgtggagaacactaagtacatactatttgtgtatcactttccagttgaaggcaagaaaagctggggagttttatttctacatattaatatttattttaatttctaaaggaatttcaggttgagacaaatttaaaatgaaactcttgtgaaaacacattttacccccactatcatttaaactgcctacgtgtgtttgtgtgtgtgtggtgggggggagtagggggtgatcctacatcattgaacaacttacttttgaatgcactctcattaagccttgggtatttaataaccccagaaaatgctgcactgaagcaggttggcagaatgggcatgaggcagaaagatgagaaaaaagcatggctagtgcgtgctggatttccacgaaataagcaaatccaattttggggatgaaatgaaataaattttccctcaaatcgggtgtgggggccatcaaatagggctctttggccctttgatcagtccaaccatttggaacccctcaaaggaatttataatttatttaaatggatgaaatttgtaattgaaaattcgagaagaacctctcattggaaatccacagtataaatcatactgccttgtctattccttctttccttactccagggcagaaggactaatcatttgtcataattgagccatactccctgtcatcattgagcattggcatcagttcgatgaatggtgcaggtgttgacactgcattgataaagaggggtggtagaggaaaaaggggggaattaggtatcaaaactgataaatgcttggtcttggagtccctggctcataggttgacagagaggatcaagttaggcagagaccctgtaaggtatctagtccaaaccccttgctttgtagatgaggaaactgaggcccagaaccatggatgtagagaaaagtcaattaacttctagtctatggaataaacaattaaaaagtaatgttgagtggaaatgtttccttctctctttcattttcagcagtctcagtgacattgctgcagacttcaaataaataactgtctgctctccagcacatcttttgaaattgtctctaggggtcccttttataccacctcatttctcttccttgcctctctttgtcttgtaaggtctctttctctctcttttttattgcccctcacctctaatatccccacctctttggatgtttagtctggcttttctggcctcctctgcatctcagacaatttctttggaatccttggcgtttgccgggagcactagcgtatcagaatctgcagttcctgtttgagaactgcccagggcccatttccatctttccctgctgtgttccccaaaatccttcagggaatccagccttcaaagacactgcagttacattcccacttttctccccatctgtcctcctccaaaaccactgcagctgcagagattaggacttcgtggagtgaggaagctgcagggtttccagagtggactttgccagctcacctctggctcctaggaggcagaacccaaattagagatgcctgtctccagccttcctggaaatcctccagataaagccacctgcggagaagggaaagggaagggacagaaagaccgaagaaggcttgactggtttaacctgaagttgtgctatagaggagagtagtgcagctttttcatcctttaaagcttttaaagcatttgcatagcttttcctcaggcagatcttttgttttattctttcgcagtttctgctctcatcttgctggatgagggctgcaaagcagacaaggtgacccgcctaactggccttcctaccttcctcctgttttttctcctttttttcctcttttgctttctccatttcttcctcattttctccctttcttccataaaaattctctgagtgcctatacaataacattctatgcctcctaaatatagtctgggccttcctgtttcttctccaaaaatgtaatctcccaggcactcagaaagatactcacaactaccacaaatggggaaatgctaaggattcttacatgaaaaaagctgaggcattaggaaaggaggagcttgatgattggaatgcaaggccagaggaagtcccacttgggatctctttctcatttcaaagagtaggtaactactcttggaagttgttgaagcttttaagaagcaaagtggtgagtttctcaacacctttaccaattaacaatttaatttaacccctcctctgttggtaaatctttacagaattgggatgagctctgtcttggatggagtctgtttctaacaaatgctctcgggttagttagatgttacctgatcttgctgatatacccattcatatacccttgcagaatacccattccagggtattctgaacaccagatagatagcctttgcagagatgcggagatttgtagttgctaagtgccccgctttggtttactacactgtgaatcacctccccattacatgtgagtcacatgtgataggattacagcatcaggaatattgtcttgggcaagctatagattttctatttgggttgcatgtagttatgaattccaaacattgtggagaggctccctagggagtttcacagaataacagttcagcatcagtatcaaacatatggtttcctaattgataacagcaatatattttcactgttctcaaggtctttttctttgttttgagtgatttctatgctcctaaaattagtgattatttaggaaaataggaaggctctctccacagaaatgatcacatttaattaatctaaactgacagtgtccatcttcattatgcatagtgaatataaacattaattttcctaaagtatcaaatggtacagagatatattaaagaatgattgatagttttactatcccaatggttaattcatatgactaatagaacatatgagctggacaagatccatataagtcacctaatccatccctccaatccatttttaaaatagtatcttcaggaaatttttttatcttaaagacacccctacaatatgaattcgttgtctggaaaagcaatgattttaatgaccttttaaaatatttccacaatatctgtacaatgtcttttatagtggaaactcaatatttgtcaattaaatatttgttctaataagaatcagttgcatgtaccttgttaattatatcaaaaattaaatttctactgaaaccatgtgcacaattaacatttctttaagtatctttgttagtaacgaaaaaaactagattaaaaattattttatacttgaatgacagagagagaccctatctcaaaaaaattattttatgatttattttttgtaaagatattaaagcattatattaatacctctaagagtgctttaaaatctatttacatgtttatcctttttgtctcttaataagtaaaaagataaagtatttttacctatttacaagaataagaatattgataagtaaaagagggaatataaatctagactgtggtagctatgtgctccacttagatcatgctctcttgagctatggaattattttaacatgttcaccctgtgaggggaccacatcattgcatttctcatttacagtttgtttctaaaggtaacttatgcactcttaagtgaatcaaaatagtttgcgttgctcccagcttaaatcattgagaacttttactaatggaagggtcttggggatgctttagaaactatttaatgaatgaaacagaaatggaatagtaaattactgaggaatcttcaaagaggtttgacactttaatcataaggtgcctgtgaatatgttcaagagctgttctatacccctatcagctaacttaaagtatgcagattgggtaattttcacaattcttacactttctctggatttctccacctctttacttaatttactgcagtcctaacacagacgacctgctgtgtaaccatcaattgtttattcttttttttaatgcatggtaattccaaggacttactggattatttccaggtgagcattctatttccttttgttctaaattacaattaagacttggagtactctcattcaccaagtggtcttcaagctcaatgtacctaatacaataattactgaactttttgtagaaagtagatctcttttacttaaaaacgattttatttttatgaggcattgcttataaaaggcaaagtgttaacaaatcagttaaatttatctgcaattattatcgatgcatagaatgaatcctattcattgctgcccatataatacttttctgaaaatagaaatctctcactttttaagtatactttttcctcctttttttggattttgtttattatttcttaggctctgaaagactatgaacttttgaggagctttatgtaaatagttttttgttttttttggcaaatcattaacatgttaaacgtactttgaaacctgggtgaattttttctaatgtaaatcaacagatcctaatatttctgttatcttatattttagaatctttttgcagttcaagagttcttgaaatagtaaacgctggtgttacaggagactagtgttttatattttgcattggttttagtaatttgtgattggcgtgtttatttctgatttcttgaagtccaattttaaattttgagtaaaatgtcccgttggagacccatcaagcattattaataaagttgaaatgcttattaatataatattttgcttttaatgtatcaagtagtgctgcacaaggctcactttcaattagcaagttctgtttgctgaaattcttggcatttgatgttacgagttaatggaagactatcaattttgttaattccagaagttcaagagtttctgtaactttatataaagtgcttgatgttttttgctttcttgttcttatgaaaaattttatgaaaaatgaaaggaaattgtgaagtaaacttaaatcctatgtataaaattgttattcttttaaatgattataaaggtattcattcttgagtgagatgaaaaccactaaactattagtctttcctcatttttagtttgtgaatgggaaacttctaaccatgatttcagttggctcagagaaaattatgagaggaagtataaagttcttcagctaggtatattaatacttagacaaaaattcccagggccatagtttattagttctgtgaccttgaataaattgtttaaactctcagcctcagtttctaatagtaattcacaggattcttgaacagaaaatagaagattatatatgtaaagaatataatggcttattattgaaaatgtacaataaataatagttatccttatcattagcatcactttaatcagaaatcaatagctcataaaccactttggtcactgagttgaagcaatctccgttcattgcacaacttctaaataaggaatcaaatagtgaacagtttacggtgcttaccctaccttataaaacttagatttattgagaaagtgtgccaagctctgtgtagtcactgcagaacaaaattaagtaagatacaatcccagccttcaagaatttatgcctaatggagaagacagataaatgcaattttaagtcaagtgaaatgaaaaggtggtatggatgcacagaattatttcagaatgaaataaatccctgcactaagacttcagattttctcttattccttctttaaatgcatcccctttccattatgcctttactttatcatcatcaccctactatataatgccagcatataattgagtccagaatatggaagtgaaaggaaatttttgagtttatttccttattggatatattttattatctatgaattactgttcagtgtagctaaataacacgtttcccttctcccccaacctgcactcacagttgatcactgaacttcaataaaaaacgtttcaggagctccgcttttttggttaaatattacactgtgatacttctatcttttaatactttcccaaaacaggatttctatctgatactctccccacacctcctctatttttccaacccatttcgcgactaatcattcaatgtgtgtctgtgggaagagtctcctatgagctactctttcattcttttctcccaggcttttacaataaagaaaagataccttccaactgctctttcctactgaaccaaaaacaatgtttctagcccctctccacatttcccccacccccacacacatcaaatccaaagtgaccttattgtttttaactcctcaaagagcattttcaatttccttcaggttttccccccttcttcctctatttcctgcccaatttcctaggaaatttcaggcatatttctaatctgtagataaaaaaggacatctttttctctttttgaagtctacaaaacttgcacctaaattctgaggtttctttgtataataggacaactcctggatgattcatagaattgagtagggttattgttctaattaatcttttgagtttattttctcactggtgaaaatagggataatgtagttatcttatatgaatgttgaagtcctaatatagtgatgtgtatatagcacctgaaagagcttggaatataaataattccttctccccctgcacaccccaatcttctttcctgcccacatcttatcttttctgaccaccttctcagttacatttcaccatttctccttggctagtgttctaggtgtcctgctgcattttttccaagtatatcttcctaattggctcatagttaaataataggtaacataacacatatcccaggtagcatggtgagcgcagtcctagaaagcgtgtgctaactgaatcaatgccctagcttaggcctgtgttcctgcatctgtttagaaaacctctttcatttgtttaagacatgtcttctgctaaacttttcagagcctctagtgactaatgttcagttgatgaacagtcctctcccactccagtgattctgtggtgctcttcataaataatgtcagaggacatctgacagtgcttaattatcttctgatttttatcctcttttttccattaccttttcccccaaggtgccctgagcacctgttaaacacttcaggagacgcctatgcctcaactcttatgcaggatctggtgatatcacttgcatatcttttgtttatcacataaatggttctcaaataacaccaaataaatggcagaagagggaggccatacacacaacacatgttgcagaacatgttcagatcaggtttagcctatcagaaccttcatttgctgagtgtttgtagaagtgtgcactaatgcagattgaccaagtgcagagaatggtactcaaggtagggctgaggtagagatgcacatacatccagatagatagatacatacatacacacatacatgatatatacacagtatgttcaatgtactgtaatagattgttttgtatagttttaagcaaaatatttaagagtaatagcttcataacaaatcattacttacaagacagcattaaaaaggaaggcctattgaaatttcttcattctagatcaagtgcataattgaaagggaggatggtttaaatttggtggtaagaatacctatcagcgttttggaaatatatctttacagaaacaaagagttttttgaaacacttctttggggaaaaatgcttactaaatcccactcttcgatattcccagtgctcattttcatgttaataataagtctgagtggtcctgtggtaaagaccactgaatctgtttagctttgattaattgtatatttccaaacctgtttgtacaggaaacttatgtgaaaatatacttatcaacatttcattgttgttctgaagaactcagttagaaaaactgctttagaaagacaaaagctgaactatgtaatagaaagtacacaaacttagtagtcattaaatgtgtgttttaggcatcacacctgtgctttaggcatcatagtgtgtagctgtggaagacttacttctctgagttttagtttcctcatgtgagaataactatgatattacctaccctttgtagttacgagatattgtgagcatacttcacagactgcataatagcatgtgacaataaaaaatttattgttcatatcattcaactttagaattttagattttaaaaaggtgatttataatcaaattattgatcttctgcaaattattatattatggttatatctgctaaaatatgtcccctgtcttctccccacccctactctaggtcctgggaaagaatgatagatctatgataactaggtcttcacagttaaattgaaaaaatgattttgaagtaaaataatctggaaggaaaagcctaaattatggaaggtttgagacacatctgtatcgtttaaatttgcctctggatttctcatgctctggttgtagaacttgagcccacagccatttctcagtggtgtgaacatgtcttggcttccaaagagacccttgtggaaagaaaagcaaccacagtcaagctcacgtgtttgctctagcaaagaagctttggaaataagattttcatcctactggggttaagagaagcccatgagagtaactgggacttcccttccaggaatcagcatgcatatacagacccaaataatgtgagtaaggacagtaagaccaacaggagaaactaaagagacccacatatgcatgcaaacacaggtactctgtcttggataagctcttgaactcatgaacagagatgagttctcttcaaggactatggaaatcactttgcaagagctgttctgattatgaaaatctgaaccttacttagatatcctaacccagtcatcctaagggaatgcaacaaaaagttgcttctcagtcctcttagcacatctgaacacataatcactgtatacatgccaactctcgcataaaactggaaatttcttgagggaagaaatcatgtctgatacatgtctaagtcccctttggagagctgtaccactgaggccagcagaataggtggagcagtaagtcaactgtgcattgacccatcaataaattgtggagtttggaacttcccagtcaggagttgttaaagagtcctcacacaccccaggataatggcaaagcatttgggcatctgactcacagagtgccagattacacaggcaccagtcaaataagaccttgtccatttcctatatagtccccttctctgccccctccctagaaacagcagagcaagtaatacaagagggaagccagcaggacaaaagaacgtattaccccctctccccactgctagattgaaatcctagttaaggaaagactgaattggtatagtggaaatttatatttaaattagactaaactttttaatatctagaaacaaccacttttctggtacctacaagtgacagaaaaaatataaatcagcccaagatatcatcttggaatggggaagggaggcatgatagagcatgtttgcagcagtgatgagagaataatgtagccaatactttgataaagtggctatacaaggaataataaaaaatggcatatgattcattcttaaaacaagaggccttggccagaattgctggtatgggtattagaagaaatccatgagaactggaagaggacaggggaaagtgatctagatccaagtcaccaatggcataggagaaactgggaaagctgacattcttccaaagaggtgctcagtagaagaccatgtacttagaaggcttacctatatcattcatctttggctgttagccaaaattgaattaatctgaatattgaaagttatctctaggctaggtctcaagagcaagtaaatgaaagcagaaatcatttatgccttctaataataatagctagcaattttgttaaaaaaaaaaaaaaaaaaaagcccaggcgtggtggctcacccctgtaatcccagcactttgggaggccgaggcgggtggatcacgaggtcaggagatcgagaccatcctggctaacacggtgaaaccccgtctctcctaaaaaatacaaaaaaaattagcagggcgtggtggcgggtgcctgtagtcccagctactcgggaggctgaggcaggagaatggcgtgaacccgggaggcggagcttgcagtgagtcgagattgcgccactgcactccagcctgggcgacagagcgagattccatctcaaaaaaaaaaaaacaaaaaaaaacttagcacgtacagtgctctgtgttggatacttacacgcgttacttcattacttacagcttttagaggtaagtgtctgcaaggttagcttcattttatgactgagaaattgtgtctctgagatgaaagtaatttgcccaaggtcacatagatattaagtgataaatgtgttgttcaaacccaaaaccctcttgttctaccaaactacaaccaatctacacacgtctttttattttttaatttttttattagggaaagcgtacatatttggagagaataatataataagcccccatgtacccatcacccaatgttaatcagtattaagtccactttgtttcactgccgtccccatccttcctctctctaatgggttaatttgaacgaattaagacatatcattttgtgtgtaatagtttacatatatccacaatagtattagcacagcaaaaaaaatcacttaatatcatcaaatataaagccagtgttcaaatctcctaagtattttttttaatctcctaaggatttttatagtttatttgaatcagggtgccaattaagtctatacatcccagttgttgaaaagatagcaccctgtttatatgagacatgactgcatctcactggagagaagtatattgtggattaaagagatgtggctttaaactaaagataggccttatcactctgaacaagttgtctaaattttggaaaatgaaaattgtactcctgagattaattgtaaggataaacataatgtctttgaaagtgcttagaacagtctctcgcatatacaagatcttcagtgaatgttaagtctcctataaaaagagggggagggggaaagagagaaagagagaacaagagggagggaggaaagaaaaaggaaaaatggaatagtaggccaaaaagcgtggccttcttattaagaggaaacttcttgaagtgctttggcaactgatcttttgagagcactcccattttgttcctggatggatatttgaccacagttgtgccaaagtagctaatgtctaatggctctgaatcttccccactgacatgtttatagttctgctgtttcccatatgaaaaggcagaaaatctgtaactttgaaattatctcaaattcagaaaaatgacagtattataaaatatctttaacttcataccgattaaaactaatagaaaaattaaaatatggcatacattgtattagcagtgattgctgttatgttacagaggtaacatagttttaaaaaacaaataagggcaattaatttgattcagatttgagtttgctttgttttcatatgaacttgagcaagttacttcactcctcaaagtctggttcttagggtgtaaaagggaagttttgaaaaaaaaatctaaatatcagacatcagcaacatgggaaaatggaaaaataatggactatatgtcagaaccaaatttgaattctaattccactacttaatgtcttcttggccttagccaaataatttaatctctttgagccccagtcttatttgttaaatgcaaattataacgtatctcacgaaattgttgtgaggactagaaataatatccattaaatgcttagcggaaccctctcttttatttgaaactcattggtggttattattagtttgtttttaataaagaagtagtagtatttgctgtcctcaattcaagagctcttaatttaaattgagaagttaaataaattcataataaagaagtagggaactgagcatagccaacagaccatcttttgcactgggtagatctaaaaccatgtatgaagttaatggacactttatgtagaacaatgggtagatgaattcaacacacagtatttataagggctcataatgcaatgacagtatactgcttatgactacttatttagagaatgtaaagtgagcagcttctatgttatctgagaatcacctcctcaaatgccaactggaggttgctggtaaggagtacccaaatcttcataataggtctataagtttatacatctgtaaatggaaactcaatgagaggtgaataatagagggaaggctaaaaatctacacagtattccagctatcttctctggattgtgattattggttcctatggtagataattaggaataaagtcatttatttgaatttgtttctagcttggataccaccgattgttatcatggtgactgagatcacctcattgtaacagtgagaatattcattttgtcattgtctaggattagatagaagtacagaactcttttttttataattaaatgaagaagacattactttttctttcagaacacttttttttctagttttttaaactcatttaacaaaactctaacaaccagaactaaagagggctgcgattgacattccaggtaattcattaatcagatacctggtccttcaagtcactactctatataacagctcttaagtgagactcagtgagggttgggaatttgccttttttaagtaaaaagagtaatattcgctcattgtgaaaatttggaaaacaaaacagaaaaaagaataaaaatcacctgcaatctattactaagttatattttcctccattttcaatattgttttctaatagagactgctcatttctttaaaatttatattctacatttttaataacattatagcagaaacatgatcttttcaattaaaattctttgcaaatgtatattttaaatacttggattacactccatcgtatatatgaacaaggtttagctcactgttctcttattgttttacattttaacttttaaaataccacttaaaggaaaatctttgtgcacataactctgactacaggctgcatagtgtcctcagcatagatttctgcccatctctggcagagtgtgaaatttgaatgtaagtttgctgctttttatggcagaggcttgggccctagaaagtagtaggcctgagaggtcataacacttagaagattgaggaaaattcacctaaactagttactaattctcagggccagcattatgagcagatggctgcattcctttccgaactgaaaagcctattctaatcaaaacctacctgcaattgcccaaaagtccattatttttgtcactttgttttggagcaggaaacagaaaagagagccaagtctaggctgagatcctggagcactgattaatacagtttttatgccatgctttgcctgtatgatcattgctactactgctaccaccatcatcattatcaccttcataaatatcatcttcatcatatccagtggtagtcttcctgaacagtctgtgaattcctacaacgtagactcagggcctcattaatctttgaatttctcaaaattctctatacctaaatagtcctcagggaacattgttaggtgctttaaaacagaattcactcatttatgttttagtttaaataaatttctaatcattttttctccaaagagagtattgttaaaataaagtaagtagaaggctcttgggttcccaggaggtagtgaatgacaaatttcatttgcttagtttgtcctgtctcttaccagccccaaccctactgtgacacttggaggaaactcttaaccataggattttttctcactcatatgaaaaacatttcttttgcttctgctatatgccagaaattgaatttagccccagagacataaagatccttaagacaaatatcttttttcaagaagctaatggtctaaagcaggagctaaatgaaatgggccaggtgttacacgagtgttaaaatgatggtattttgaccaagcagaatacctgcctcatttctttgccttttaaaacatggcatcaaacaaaataaccaatacgaacacatctatggttttatgtggttcaggatccatgagttttacaccccagaactaaaagaagaactcttggaccctgacttttacttccattttaagggtagtttttaaaagatctttgtaacaaatgcaggcagagtccatatgccagtgaaaatgtaacgtttatgaacccctgcttttacatcagttattataagaaccatgtttattcaactgaacaaccatatattggtagaatctaataaaaggaagtaaattattaaatatgccagttcatcacttcttaaatcaattggatcattaaaagtcattggtaggcagacatcatgatagaaggaaaattgtggctgtagtgtcacacagaccttaattcaaacccctacatcagaagctgcatggcttctgattccttgcctgtgaaacagaaactgttaagtctatttcacatagtccttgtacagattagataggattgtgcatgtaacatacttaggacagagcgggggatagggtagatgtgtaaaaccagatagttatcattgttcacagtggcatatgtataactaagtcccacagttctttccaggacttattcacatttaaatgaagctcttaggctgaacatttcttgtgtagttcaccagggtattattttcagagcccagttctgtgcttaccattctatagattctcaatatatatgcattgcatgaatcaaaggacaccaaatggtctctaagagatggaataggaaggtgagaatttctggccaaaggagaaagatatttcaggggcaaaaggagcttacatctgcctgagtttagtcattcaaggtcttttcacttttcacagattattacaccttagaacattcaggtgttccaaaagtctcctcagttaatccagcaaaggagaaagaggaagagatggctttttttttaaggatgccatgtttgtaaacaatcattagcacatatcatctctttgccaaggactctgccaagcgctttacatgcatactacctcactcattttcacaacaatccaatgaaatagatattatccctatttgaggtgaagaaattgatacagaaatgtaggaacttgcctaaaatcagaaaatttgtggtctctaaaatccaaattggatcgatgctctttttactcacttcaccttgtttttatattcactatgtagcttttgtatgaggtactatctctgtttcaccaattcatttgttctttcaacaaatatttattggacatcatttgcctagcactaagtgaactaaaacaaccataatccctgccttcatggagattagagtctagctggaggaatggatattaaacaaataatcacaaaatggcaccacttacaattaattaagtgctatagacgaaaatagtaatgctgtaagaaagtgtaacaaggagacctatatttggggctgcttgaaataatagactccaggaaaatccactgaggtctggatttccagttttgcctcctgagattgctactaacactcgtttaccattgctgggcctgacaaaggaggcttattactgcatttctttttgaaaagaggattatgggtcttcctcccaggatttaccatctcccattttattcctcactcacaaggctccagtaacagaggacaatagagcttttgatgttggtaaatctccaagggaagcttaccctctgatgcaaagttccctgggacggtttccagataaagaaatttacaagcacctgtgtgttacgtgctcttcccaaacccgtggttgctttcctgtggtgtagatgtataggtcattagatacgcccaagtgctcctacaactctatgtgcttctacaagtccatgaaagaagcagagggtgctgcaggagcatttctggggcacacagaaccaaactttcctaggatgaggattggaggtgagatgaattttggagatgtcaagactaggaattagatagacaaagggcagagggagtaggaatgctcttattaagaggaagcagcaaccaaagtatataatgagagcaggagaatactttgaaatgcttatgtcctgacataaggttttaaagggttataaaatcttaatcaaatgagcatagtatcatggaaagaaatatggttttataatcaagccaacattccattccagctcagtcacaaaatattttgagccttataaatcattttatctgtgaaatgtagataatgatacctatgtgacagtattattgtggtaattaaattataaatgttgccacataggtgtcatttgatgcctggcctttaaagtagtagaaatctggtgggttttaatgataagatcaataatattgcatggagctaatttttactgacttcattacatgtgtttatctaatgattacaacttcatgctaagaattttcattatccccattataaagataattgagacttagaaacagtaagtgacatgcccacagtcacatagccaaaaagtggcacatctggtagtctgacctaagccccatttcttaactgctctccactgtctccctgtaatagtcaatacacagctattattattgttatcattgtcattattatgatcattatttaaaattcaaaggtcttgaggtcataaccagaattctgatatcaaacatctatgatatgcttttttttctggagcaagagtttgcagattatctttaaggtatttccacttttgttgttatacctcataatttacatggcagatcagagttaaattcagcttaaaatgatagatgatcccagataacaatggcttaaataagagagaaatttatttctcactcatataaagaaactcagaggtaggcaatccctgacagggtggtttcagggacccagaacctagacttctcagggacccagactccttcagcctttttgcttggctagccgtccttagcaggtggcttgcacctcatgatctagtgtggcggcagccacatatcggctttctaaccagtaggaaggagaaaagggagatgaaggtcaggtcatacccttccctgttaaggacacttccctaagtcacacctgaaaattggcatacatgccattggccagaatttagtcacatttaatataatccttgctaaaaattaggggttttattactaaagaagaagaggaaaatagtcttggagaaaactagaagcttctgccgtactagtaataaaattttaagatacaataaatatttaatgtagatgttcaatttgttctttaaaatgtgatatttaaaaaccagcaaaaaaaaaaacaacaacagctttttaaattcatgcctaaggttctaatcaactatgtcttttacaaaaaacattgtcaaagaggtcatacaaccttggtattcttggctgggcttcgcttctagcttttcatcttattcaaatcactttcttttgttgggctttagtttcatcatatgtaaaatgagtaggggtaaactagaatttatctaatatccttccagttctacctattattactgaatgacataggtaaatcacattcatttacttacaagaattttaaagtaatttaagtgttatagggcaaaaatctagcaatgagccagttttctcaggagtagatacagatttatctttgtatatttatatccttcctcatcatagaaaagaaaaagacttctatctatccctgaaaaacactataataaaaaatgaaataagcagaataaacatcagaaaaaataaacatcagaaaagagattaaactgacatcttttgctgattatatatattgaaaatccaaagattcaagtaacaacaaaaattagtaaaaactggataaggagactagctatcagataaattacaaaaaaagtagccttttcttttagcttatcaaaaaatattcagaaattaaaattagaaaaaatgttctatgttcagtagcaaccaaggtaatatttaggattaaaaaatgaaagaaagacaaagtgcttatatgtaactgtaaatcttattgaagaacagaaaatacagttaaaaattaaaagacaataggaaaacatcatatatatatatacatatatatataataattataatgccacaagggtttttattttaggcatgcatttttaagttgttttacatggttttcaagtttgtctggaaggctgcattctcaagattagaggtatttaaaaaaagagtgagggtaagcttgcattaccaggtgccagaacacacaagcattataatcaaataatatggaataggcatatgaatagacaagtagaccaatggaacaaaatagagtattcacaaaggtatttcattgttataagattttatgaattatcaacaaaggtggcatttcaattcagcaggaagaatgtagcttatttaacagatggtactactggcacaactgattaaccatttagaaacaagcgaatctgaacccctatctcacattacataaaatgaatttcgggcatattaaagacttcaattttttaaagcctcagaagaaaatctaagcgacatttggataatctagatatagtgggaaataagcaatcaagaagctataaaataatagggatatttgactccatagaattgtaaactttcattatgtcaaaagatgtcattaacatagaaatttgccatatattttagtatgctttagaagatagatctctgtatcctctgtaccataatgcctggtccataactgagattcagattgcaacatatgaggtagaacagggtaagagctactacaaacaggatagactatgtactgagacattttagacatgggagaacaaatctgttttcaatagatttcttaagttgcttctttggtcctcaaaacttttttcagtaagagtatgacagttaatccaactcaacagttcaaacattaattgagtgcctattatgtgtcaagccctctactggaaaaaagatagaaacaaaaagagatagacttcttgatagagcttatggtagggaagggacaataaacagatgattaaaaattgatcagtctgaaaaatggggtgaagaatatgctcctgtggacatatataacaaagagaataacagcctatggaatctaggacagagacaaagtggcatttgtgttgacatcctaagtaggaataggagtcagccaggtgaagagaggcacagaaagagtgctccccacagaagccctagcatgtacaagggctggatttgatagtgaacctgttgaaaaactggagcttcttaaaaagggacttgggtgaatggcactagatactaggatgaggctgaagagttaggtagcaagctgccaggttccagattgtgatgaatcttccaagcagtattaagcaattttactccatcttaagagcagtaagaatctattggaagctttagaaaggaagtgatttgatcggacttgcattttcaaaagatacttttggagaatggattaagaagatgctagatggaagcagaccagtttggaggctattgcagttgcccagatgacagatgatgttccttttgatatggcacaaattcagagacttgtataaatctgagagaatttaggaggtagatcatcggggagcgtggctgtgtttgtaaggaaagaaaaagaggagagagagactgtttatgaatgattgggtaaatggtggtataattcttcagacagagaatccacaccaagtatctattcttttttttggtgactcttaacaatagccaagaagttaatccaaaaaatgacactccctttacattgttctaaaaaagaacttttcggaataaaaatgtgactcacatcaaactctcaccagccaacagggtctgcaatgcccccagactactgaattaccattcaattccactgaggtttcctcagggctacagtttttgtcaagtgttcccaatctttttcagcagcactgctttatacttctaagacttagtaatgccaacaactttttcaagctcccaaggttagtagttgatcgaaagaacacatagtgacaaatagctactataaatttagaaatgttaaaattaattcatattttattaatagtgatagaattgacatgaatttgaaaaataatgcaatatgtgaaagaaaccctattcagtttccaaagcttagtgttcatttgcattcacagactcttggcaataatttgttggattcccccaccttcagacttcaccccagcaatcgacagaccaaattttatttttcaagatgaacattttgtttgaaataagaaacaaagctaatattaacatgatctttttaagaatttcacattctttagaaaccaaagcaaaaagcatttggtccctaatgatggcattaagacagggcaatgagattatataagcatgtgttctttctgctcccctataagtatgcccttaggtttaaaaactagagtctatccataatgagggcatacattgcactaaggcagatgtacctacctctaaacgtcgtgattaaaagaggagttattttaaggataaacatcagaactagccctccagagccatcaggaaccagcagatctctagggatttattgtcttgtgagattcaagatgttcctctaactatagatagcatttcagcttttctctctgcagtttagctttgcgttcactattgatgaatgatctggtgccatctgtcttccattccaaatccatgaaggggcaaggctgattatttttacctctatttgcagagttcttccaactatccaaccctactagtcttatcacctggcctgtactgtgccactcttgggtcggtgactcaaccttgattgccatctctgcctaaaaacagcttaacactacctccttgaacttgaagtatgaatagagccatttctgctaacaacaacaacaaaaaaagggataggacatattaataaccaatatgctcaatatatttgacaagaaaccaccagaaaggtgagataaagggagaagggaaattacttcatcccaaaaataaatcaagcaccacttacatgtgttacataatgcattatcctcagagcaaaacccagcagggttataaaattatctccatttaacagaagaggatagtgaggctttgagagctcattaatgtgcttcattatccagcagattcaggcctgttggactccacagcatggcttgtttgcaaattcattgtagctgggggtgtttagctatgtgtggcatcagtcagtactgtatggagagaatacagaatatggaaaatattggtcagtcaccttgttcagtttatgtcagtcaagacagctcttcagatattaagtaaataggtaattgctgaatatttgagaattgcctgtctgctatctgaatgtgtaagtccttttgaaaaaaaaaatacagttttagctgggcgtggtggcacgcacctgtagtcccagctatttgggaggctgaggcaggataatcacttgaactcaggaggcggaggttgcagtgagccgagatcgcaccactgcactccagcctggcgacagagtgagactctgtctcaaaaaaaagaaaaatacagttttattataaagttaatattagataatgatcatgaatctagaaaaaaattaaagtagaaaaataaaaattatcatcctaatattcaaaggtaggtattgtgattatttggtgtttttctttctggtttcttatctatgttctttttttgttttgttttacatagtggtgacatagataaaatttaccttcttacttctaaatagtcttcttaaaaatcaattcctttaattacatgaaggttttttcagagtcacacctttctttgtctctttccttgtttcagaaaggatttcagttaggtttaggaaatgtgtcaagcatcgtaaaataaaataaaacagaaaaaatgaattagaaaggagaggtttcaaaaaggaaaacaaggctttcttttatttgttctggcctaaatttctttttttcacccccatttttttcacaagtgttgattggcccacacttctgatcattaagtagaagtttttctatgtggtctggcaaccactttgtgccttccttgagtctttccaatctaaaatgcattttcagagcctataagctgaaaggaactatgtctggatagatggccaaagattgtgtttcatttttgtaatgagatgcatatttatcattaaatgtacctttattacaccatctcattaggctgttcagagtggtttttaagaaattattccaatacttatgcttaggattctgtaaaaacaacaacagcagcaactacaaatgattatatcctcattgtgtgttcttagtacaatggcagaaaaccagatgactcaaagtgttactccccttccaactttgtttttttttctattttagaacctctaaagataagaatttctcaagttgctttacaaatttgtgttaaacggctgtgcctagtatctgaattcacagatgaaaatagaaactttataaaattattttttaaaacacttgctgaatgcccacatggtataattattgatgagcaagacagactcccaccttcaaagcagtcagggtctaatggagtcggacaagtaaacaaatagttgcaatgaacaaaaaactagcttgaaagtatcgcagatgcaattgtagtatcaacaaagtagtcgtaagattacggaaattaacctgaatttcaatttagttgaatttctataccaaatttgtatgtcatgaaaatgaaatcacttcagaattagcaatggagtatcagagaaatgtattttttcctaaacttaaaatggacatgctttaaattagcaaaatttttagagttatgggacaattttctttttagtattctaccatgtttcctttgagatgaacatgattactgtctatggtaagagctagaagaaaaaagattatctaaaatcatagatggccgtttgattaatcttcaacattgtaaagtacctaggacaatgttagtctggattagggagaagtctgaattacaaaatactttaaaagaaaatacttttttattgggagaaatttcaaacatacagaaaaattcggagaattatataataaatatccattgatctacccagaagttatgaatattaatgccttctcatattttgaaattattttcatttctattctcaatctcactcacctaccttcttcctcaaagcaatcattctatttaatttggtatgtattttcttcatgaacacttttatttttacttaatatgtagatctatacagtatcatttttgatatttaagtagctgacatcatacttaatgtatcattcaccaaattgcttctctcaaaagtacttttagatcatgtttattatgataatattatatgctattatcaatttacatgtgatagttagtgcctaatacaacaacagagaaagaaaaatatattcaataaaactgtgttaggataactgaatgtctacagggcaaaaataaaattagagttcatgtaatattattcatttattataactactatacagctgagatggtttggctgtgtccccacccaaatctcatcttgaattgtagttcccataattcccacgtcatgggagggaccaggtggacttaactgaatcagcagttcctgcatgctgttctagtgatagtgagtcagttctcatgagatctgctggttttataagggtcttccttgcttcaatgggcactgattcttctctctcccgccaccatgtgaagaaggatgtgtttgcttccccttctgctgtgattgtaagtttcctgaggcctccccagccatgctgaactgtgagtcaaataaacctcttttttttaataaattatccagtccctagtatgtttttattagcagcgtgagaacagacttatacagcagtatttcatcatgcaactatatcttgttatttattccctttttgatgaacatttagttatcttttctttttttgctattacaaagttagagtgtacatctttttcacatggcttcttgtatatatatgtgagatatatagtgaaatggaattgccagatcatgctctatatgcatcttctgctgtattaaatactgccaaattgttctctacagaaaatataccaatttatattcccaccagcagtatattagaagaattcatattgctctacatctttgcagtcatttggtatcataatattaaatttttaaatcaaactgattatataaaatggtccttcataatttttcattttcttaatctttagtggccatttaggttttcttctctgtaaattacttattcacaggccttgcctattttttaataggattgtttgtctttttcttatccatcatttggaattccttataaattctgaatgcaaactatttgttatatacattgcagatattatctctttgtctgtcacttatttaactttgtttatggttgcttttgtcttaaaaacaaaattttaaattttgagatagttggatttatcaacctcttaccatgatttaaaatactgtgttaagtttgggttttaatctaactgaaacgtatttttgagattggtgtgaggttgaaatctaattttatttttgccctgtagacattcagttatcctaacacagttttattgaatatatttttctttctctgttgttgtattaggcacccactatcacatgtaaagtcccaaatgtttagctctctgttctattgccattttgtatttttccattattttatcagtaccaaactgtattaaatagtgtggctttataataagcttagatatttaatggagtagaacactatccgtggtcttcctcaaagttgtcttaaatattactgaccttttgctttttcatttggttaaacttcataaaaaatatacttgggatttttattagaattgaattgagtgtttatactaatgataacagaactgatgcattataagatgatttggtttccaggtatatttaaaatttattcaaatttttaaaaataaagttctatagttttctccataaaattttgccacagttttatgaggtgtattcctaggcatcttacatgattttggtcttgatgtaaagagagtctcatagagtctcacttttttttttttttttttttttttttagaaggagtctgcctctgtcgcccaggctggagtgcggtggcgcgatctcggccccctgcaagctccgcctcccgagttcactccattctcctgcctcagcctccggagtagctgggactacaggcggccgccactacgccaggctaattttttttgtatttttagtagagacggggtttcactgtgttagccaggatggtctcgctctcctgacctcgtgatccgcctgcctcggcctcccaaagtgctgggattacaggcgtgagccaccatgaccggcccaagtctcacttttttaacgtcactttgctataggttttttggtatgaacctttatcaggttaaggatattcgttctagtcttaatttattgagagttttctttttctttttaaaataatcattaatgtgtgctgattttattgaatgcttttctaataaaaagcttttttacttctttactaataaggtcaatacctgtaatagattttctaatatgtatcattttgcattccaggaataacccctgcttgatagtgatattttaaatacattgctggattctatttgataatttgtaggtattttacctctcttttcaaaagttaaattagtctattctttttttagatgattccttacaaatggcatatagctggattttactgagatgacgaatgtatttagaattccatctatcttcttatattatatttttaatatatgctaggcttattttttggcctctcccctcattttctgttttctattgaattaaggtttatttattttccttcctttcttctatttacctagaagttataattaccactgttttgatacctattttgttacctttttaatatgtatacttaacaattcggctttgtttgtttgtttgtttgttttgacagggtcttactttgttgcccaggctggagtgcagtggtgcaatcttggctcactgcaacctcaaccttccagcctctggtgattttcccacctcagcctccccagtagctaggactataggtacatgccactatgccagacaagtatatacatatttttttagtagagacggggttttgctatgttgcctaggctacttaacaaattttaaggtcagtcagtatctttagttgtctttaaacaagtgaaggaccttgcatgttttaactccaaaacacaacccccatcattcatgtcattgcatcctagtatgtttgttgcaccttagtttttaatcccaaaacatcccttgttgttgtttaccaacttttttcatctatttctttactcatcgttgcttcttacaactacttcattctggtttcagtgtccttcgtcctgaagtacatcctttaataatagggtccataattagtattttctctaatttttatccagttgaaaatgtctttatctcactctcattttgaataaactttaactgggtatataattattagttgattttttttcctttagcattttgaaactattctgttgatttctggcattaaatgtggctgatgagaaggctgactttagactaatggctcttcctgtaagttaaccaaaattttctttctgatagattttaagataattttcttcaacttttatgttcttaaatttcattgtcgccaggtatggtggctcactcctgtaatcacagcactttgggaggccgaaatgggcagatcactgaggtcaggagtttgagacctgtctggccaacatggcgaaaccctgtctctactaaaaatacaaaaattagctgggcatggtggcaggcacctgtaatcccagctactcgggtggctgaggcaggaggattgcttgaactcaggaggctgaggttgcagggagtggagatcatacaactgtactccagcctgggcaacagagcgagaccctgtctcaaaaaaaaaataaaaataaaaataaataaattaaataaaataaattaaaaattaaaaaaaatattgtcatgtgcccacatgtggacttgttttatttctcctactctgaaatttgtaaaatgttttattctgaatttttcaaatctgaaaaactccatggtttaatttctctcctactctctgtcttatctcgctttggagctattaatagcttctcattattagaagctattaattggagcttctcattctagcttcattatctcttaatgtctcttccatatttttcatccgttacctcactgtgctccattccagataatttcattagaactaacttccaatttactctttcctcttcatctgtgtctcaactattatttaaactctatttaaaaatgtattaactttatatttttagaatttctattccattatccctcataattaattattctgatcttcaagtctctatttttaattctttaacaagaaattactgaaaacaggtaatgaaaacatccctttaagaccattttagaatttgtaattgccagagctccataatagttccgtgatgtttcttggcttagggttcttactttggggaaatagtacaaactcagactataactaggtaagcattccaattcaggattccaatttcttgttttaaagtttttattttggaatattcgatgaaggatcttttccgctcagtctatatacctggcataatgtaaaggagacattttgaaatcttgcaaatctccaaattgagtgtctgactggtagttttcttcatgaaatacagtgaagagattgacctcttctcttttcacttccattatcagcaggaggagatgtgttttttaagggggacattgttcacaaaataaacaaagctttttagtttttgctgtgtttttaaatcatttatgagactccctacatgcgtagggtagaataaagattaacaaaactgtacttaaatgcagatgcttgggagaatcacttattagggctacacaccagccctataccaatcatgttttgaacgtgtgctccaagaaacttataaaccacttgacttaatgagctatttaggcccattatgaaatacctgaaaatttaaatattaaatctattaacaccaaaggtttatagtatttggcatcaggatttttctgagtgtgagtatctatggattggtattatttgaaaacttatttccaaatgcaaatggaatacacagattaatacaatctgagaaaataaaccataaaagtagatactatttattaagcatctcctatatcagccactgcattaggtttattacctacattatttctaattttacaaatgccctttcagtcaggtggtagtatcataattttatagatgaggaaactgagccttagaaaggctaattgattgtcaaaaatggcaagattaggctaggtgcagtggctcacacctgtaatcccagcactttgggaggccgaggtgggtggatcatgaggtcaggagttcgaggccaacctggccatgatggtgaaaccccaattctactaaaaataccaggtgcggtggtggcgcctgtaatcctggctatgtgggaggctggagtcgcttgaacccaggaggcgaagattgcagtaagccgagattgcgccactgcactgtagcctggggaacagagcaagactccatctcaaaaaaaaaataggcaaaactaatttacccaaaataaactggtaatatttccctttttcaaacttggttgattaaaaacctccaaagcactttaaaataggagggaaagaaatagacttatgatctaaaaatatgcaaaataccaagagcttatgttttagctatggtttgggtcaggcaacctccctaggtgttttgtaaccctcaaccacactttcctttaggtactaggatgctatctagccggaacctaacacaactaataataattttttaaacaacattgtagcctttaatctgatttaaggttgttttttcagttcttccttgaggttgctaataattaagaaccctacctagtgatgcataaccctactgagctcatgagcaggcaaggtagctataggaatttaaagttgacgtttctttcaaccaagttgacagagacaacctctttgtattaatatatgaaatgaacacatttatatattaataccaaaagtcatcactatcaagatagcctatttttaaaaatgatcaaaaattaagatattcatagaacaaatatttattaagcacctactcagcaccagggacaattctaggtacaaagagtgctaacaagacagaccaggttcctgccctcttggagcttacattctagtgaaagtagacagtcaataaatactcatgtaaattaacaaatacactagataagttcagatcattttaagagctacaaagaatataaagcaaggtaattatatagtcactaggagtgtgtcatgggagagactagttgaaataggccagaaagacctgacaggtcacatttgagcagtgatctgactggcaagaagccagccataaagaatcttaggaaaagagaattctaaggagagagagaaaagttcacataaaggctgtaatatgagaaggaactcaatatgttagagaagaccacaaagtgagtatgactgaagcacagtaaataacagagagggtaataagagataaagctggagaggtagaaagaacgtgcaccctgattttcttaaggtagtcctgaacaatgcctgttgtcctggtgtaaataatagcacctcctttcactctcaaagtatgctttttggacaataaattatacaatctttctgtggagagatatggaggagccaaattatttggatatagatagcagatgaataaaaactttagaaactagatagcaagtggatttcttcttcttccattggtccttcctattttcatctgagttggaggcacttgtttttattttacatttgtctggcgcatgcagtaggataaatgagatacagatatgtaaataagacccggttttccacagagaacatccagggcagaggttttggggtttagatctgtgtaagactaggggtctctagtcttacactgtgactggagcagcccaggatacttatgccaaaacaagtaattaacactaaaaaagaagaggaggaagaaaaagaagaaggaggcaaagggagacagcctcttgtttcatgccatacaataaccattattcatttctattactccatgtttaatcttcatgtaagagaggttctatagcttgattggagtcatacaggtagtgagaattaaggctgggatttaaatctaactctgtctcaccctttccctcaggttatcctgcccacctcaggctttccagtggtattctcttactacttaatctctgaacataacatgctctttcacatctctttgtatctatcattcctgcctggcagtccctattcatccactgcaaaggttgcttctcatgtgaagcttctctcaattcccacaaatgtgtttgattgtcttctctgtccttccataatagccacatgaatctctgctgcaatgttttattcattcatcatccattcattcatctattcaactgttaaatactggacatataaaagcctacaggacagacatagtactcatcctcagaggagattatgactagggaggattaattagcaaagtaaccaatatctttaagaaatttctttattaaatctcttttgactcatttgttcattcatttggccattcgacaagtgcgtactatgctgacagaggcctgataaactattgacacattttggaaaatgcaaatttactcatgttttaagtctgggagcatgaagtgggagaagtaagagatgaaactgaagagaaaggcataaacaagatcatggtgacccctatgggtcttacaaaagaactgggactttctcttcaggcatcagtaaggcattgaatgcctgaaatggtcagatatttattctagtaaaattactatggaggcaatgtcaagactaaatttgaagggtacaggctacaaacaggaagactacttagtttttgcaaaaaaaaaaaaagtttctgaagtgaggtggaataaatgaaatggagaacagaagaggaattcatggttagaaattagaatttctgattaattagaactaggggaagaaatggagcaacataggctgactcataaatttcagactttggatttcaaactcatgacgctttgctgaattactgagacagagatgaggtcctgcccattgtatcctccattgccttatgcttctctgcaagatgagtaagctcatttcttctgacacctacttggtgtttttgttgattgactttgggtaaaagtggcaactgaagagaatattggatttggaatcaggagatgaggctttggaacaagatctgccacagatattttctacacacttagagaaagcttgtgtcttccctagacctgtttctcatctggaaaaggaaagagtttatctaagctaggatattttggttccctctcagttcagtgattctaggattctgcttggcagcagttgctttgtggttgaatgcagttctcaaaagccaaacatgcgttttgtacaagcaacctaactttagcagcaaggaagccatttactgggatttgacttcacattttctttgtacttctcatgcatctggtaatttccattgacttcaagtttcgaagcttgtcctgacacccattctattctcctgcaagtcataactgacccgtaggttctgggtaaatcctatcctatgtctttctttgatccccccccaccctgatctttatatttctatcaaaaagtcagcagagttcagttaacagataactttttctctacccctgagaatgattatatatgggccaaaatacagcacttttagccctatcatcacatgaaacactccttcctgacccactgtgttctttcacaaaagctaagctcctttctgcaccatggtttcagaagtgtctgccccctaatattttaaactgtgctttctcagatgagtcaccaatttaactcttgccttcatctttcttattcagattttagctaatattccagctgaaaattctttgagcgtattcaagttagtcctttcaaaaaagcaatcaaatacagtccatagaattttacaagtagtttaataaaggtgtccatacaccctgggatccttgccagtcactggctccagctgaatactcagggattttcctttgtttgtttctcttctgcccattcattttccatgctgtaatctttgggttggatgtggaaaagagccttgccacttatggaagacttcgttatttcatgaaaactaagctatcaaactttgttttttgagatagggtctcactctgtcccccagcctggagtgtagtgctgtgatcacggctcactgcagcctccacctcctgggctcaagcaatcctccttcctcagcctcccaagtagctggaactacaggcacacaccaccatgcccagctaatctttccttcttgctttcttacccttctttccttccttcctctcttttcttttctcttcttttctatgtattttttgtagagacagggtttcaccatgttacccaggctggtctcaagcttctggactcaagcaatccacctgccctgcctcccaaagtgctgggattacaggcatgagccatcatgcccagcctattaaactttttgtaggagatggccaagagctgaacctcttccttctggattgcaggtactgggaaggtagaaatgcaggctggttgctggtcacctcccaacccgggagggaagcagaggaggaattcagattcctaaagtcaggagaaaataagaataaaagggcatccatcattagcttaaaatacaagggactacctacctctgaataatttgaaggttaaatcattgaagacagtccataaaataattgaaataacacaatagtgggagttaggaaacctggttgtttttctaagtgtagttcgacctttgtcactctagactacttactctctttggacctcaaccttctcaaccttatatagggaaaattaagtagatttcacaaatatctttttttttattttttttatttttttttgagatggagtctcacactgtcgcccaggctggagtgcagtggcatgatttctgctcactgcaacctccgcctcccaggttcaagcgattctcctgcctcagactcccgagtagctggaattagaggcatgcgccaccatgcccggctaattttttgtatttttagtagagacggggtttcaccatgttggccaggctggtctcgaactcctgaccttgtgatctgcctgcctcggcctcccaaagtgctgggattataggcatgagccactgcgcccggcccgatttcacaaatatctttacaagttctcatatgttaatatataagttaatatgataacctataagagatctctatttaacattcacttgttaccatagaaacttgtaaattataggaatatgcttatcattccattattataacttaaaaataaatttttttgcatattatttgtccctctcattgggtcattggtttgtataggaaataagccatttctttttcatctccatatcctgatacttaacatggtttctgcatatagtccacactttttattcatttgtaagcagcaagagaggaaaacaattgtcttcattttttgcagtaactagttgtaattatagagtgtgtttaattttgcatctctgctttctccacttagcgtatcataagtaatttgccatgtttcaacattgcattcacaattttatgttccactcagttaatgtgccatgatttactatccatttccctagtgggaaatggttatagtgctagagtttctactattattaaaatgaaaatgcaataaatatgtgtctgtatgtaactttttcctcttgggttatttctttaagataccttcccctggaatcaaaagtttatatttaattatttatttctagtgttttctggtgggttatattaacatgcagttttgctgtatttgattatttgtaggtgtaaacttggccattgatatttaatattttgttcatattctattgatgttcattgctcagcctgccagcataatcctcttcccatttatttttaagcaatgttaatacttaaaagacacgtatgttgaatatatagtcccatgttgttatttttactttttctgtttttttagattccctaaactgtgaatctttatgtagttatatctatcagtcttatcttttatagtttctgtctttgcttttatttagagagtccatcttgaccttaataatcaggttaaacatacttctatcagtttactatttgtgtttactcttttctattcatactctttaatcatttctgtcttctgtctctgatggtttccttaataactggtatttgctttagatacaaatacagtcatgcatcacttaatgacagaaacatgttctgagaaatgtatcattgtgcaaacatcatagagagtccttacacatacctagacggcatagcctactacacacctgcctataggctacaagcctgtacagcaggttactgtactgagtactgtaggcaattgtaacacaatagtatttgtatatttaaatatatctaaacatggaaaatgtacagtaaaaatatattatacttttatgggaccaccatcatatatatagtccattgttgagtgaaccgtcactctgaggcacatgacattatatacacatacatagctattaaccttttgtctatattttcagtttctgatagttttctttgatagtttttgtattgaacttttgattccaaatgttaatgattttttaaaagatggcatatggtatggttcttactttttttattgaactgctatcaagaggtgattatgtcacttataaattatatttcctctatttcccccttgttctgaaaagcttccttgatcatatattaagtgagtctgtatagctggatctatttctagactctccattctgttatgctgatctatatgtctatttttgtgcccataaattctgcatgtatttgaggagacctcaaatgtcctctcttgagtctttgtttctccaggctaaacattccctgttctttcaatggctacccttctatttagcatccaagtcctctcccatctgccctggggaccaggggcaggcaactgtgagataactgaccaagcctcaggggaccccagagttccctcacttggggaaaaaaatgttacataaaggcagcacccaggtgaaaaagggagactgatgagctcttatgtggaaataacggtttttgtcacagaaaagtacttttttgtttctcatctctaatctgacagaatagtttacaatggctaagggtctgtcagggttcaaatcccaactctaccattttcttgttgtgtaaccttctcggtaagcctcattcacctcaactgtaatatgactatataatggtatctacttcataaaacggttgtaaagaagaagtgaggtaatccatgaacacatagtgagcacttgatcatataagctgttgttattactgctaaaatatcggtcatatagatttattattttatttaacattttgaggtagttattaatatacacaatttaatgttgaatgaacaggataagaaaaactcagtaaatttcccttcccagctagtagatgtgcttcagcaagtatctcaccttgtttgtctaatgagaaggcccgggtctttgctgtagacaacacaactccactgtgtgatggaaggcactgataactggctctttggattctgccatggttactaggtgaagctctaaattcttagacaaaggtaaatgtgaggttcaaacataggattgttttgaggttttcttttggtttcaacatggagggacattaggttaatggggagacacaatatggtttcatccttatttgcagattagctgatgtggaaacatgtcccttcaaactgagtatcacttcacataactactccaagtgaaagtgacacaggcccagaagcatttgtcatccccacagggtgccagaggaagcggcacttcctctccttcagcacatgctacctgtgctctcagaaggcccacggctgggagggaggcaggtggaggaggccatacaacttgccaagtcaaacacaccggaaggtctaattttagtccccctagccttggcattgtctctttcagcaaagatatttttcatgcactacaataaagtgctttgttccagccttgctggatacttcacaaaggcccagcaaggacagcataagcctaaatcagagctggaaacacatcaaacacagggacctcacagaagagggtcagcattcctctcgtaacctttggtaaatacgttctttccatccagcttccaaaaccctaagaaggaacacttggttgtgcttctccttctacgcaactcctcttcctccagcttcttttttgtgaatcttctgttggctcctcatcaacaagtgtgttttctccttcatgccagggatttgaaaacctactccctctttttgtccctgcctaacaaagcccccttctttctttctttctttttttttatttttttttttgagacggagtctcgctctgtcgcccaagctggagtgcagtggtgcaatcttggctcactgcaagctccgcctcccgggttcatgccattctcctgcctcagcctcctgagtagctgggactacaggtgcccgccaccacgcccggctaattttttgtgtttttagtagggacggggtttcactgtgttatccaggatagtgtcgatctcctgacctcgtgatccgcccgcctcggcctcccaaagtgctgggattacaggcgtgagccaccgcgcctggccacaaagcccacttctttctatatagtctaggtcttgttttcttttctgacattgcctggaaagtgcactagattaagagtgagaaacaattttacaatttgcaaactggctccagggtttgttcttacaatgacctggcaaattcgttgaggcagaaactttcacagaacttgtatagatgagaaaactgaagtgcaaagaggacacagacttttgcaaaggtcacacaggaaaacactggcaaagctgaaactgaaacctagctctggtgctttaggaaaggtgtggtccaatgaacttatcaaagcaccgaaaacccacacaggcatttgggagggccctgggatgaaagaatcctggaaaaggacctcctgtggtgctttcagttagagccactccctttacaaacaatgaattaacagcagtcttttaggattcacaggtagatcaaagacctttagttcttaggctcattctatttagctctgggtgatgaatatggaggagaagctcaggagaaccctgaggtgacatctcagcaccttggagaagttgtgatcgggagacacagtgctgggagtcagagtccctgaccatcagaatctgctatgtcaccaaacctctctgaggctcagttttgtcttctgtaagattgatgctaacaatgccaaggtttatgtaagatgtgagataggagagagctttgtaaatgctaaagcactatccactgttcattacaatgactcatattcaaattcaaaaaatagaaaattcagagcttccatagatcaccacttctgggtgcctatggttgggtctagagttgtccagtgaagtccagaaaggaatctacccaaaggacaaagtaaagatccgagaagccttggggaacattaacatctctggtcaaccttatctgctgcgtttccaggaaataaggaaatgatttctctgaaggtaaaacccaccattctgggacctcaacctgaaactgttgaccacaaaaccagctaatatcctcaggaagttttccaagcctcccaaaggcctgtgtgagttttctgtgctttgacaggttcatgggaccacacctttccctaaagcatcagagctaggtttcagtccaaactctgccagtgttttcccgtgtgacttttgcaaaagtctgtgtcctctttgaacttcagttttctcatctatacaagttctatgaaagtttctgcctcacctaattcaccagttcattgtaagaacaaaccctggaggcagtttgcaaattgtaaaagtgtttctcactattaatctagtgcattttccaggccgtgtcaggaaagaaaacgaaactcagactttatagaaagaagtgagctttgttaggattttattagtttggtgaatgaaatacattttgtgcatttatttgtttgctgaaataaaaacatttgcacattgttctgcttataaatgttatatgctcattataaagagttcagaaagatattaaggagagagtgaaatgccaccattataccaccagcagttataatcactgttaagattttgatataaattatgaactgaccaaacttcctgtgcacacaagctcaagcaagtgtgtgtataaagcaaaagtaagtggtgctacacttactgttttgtgacctgcatttttgacttaacaatttattacaatattatctctccttttttctttcatttttattcctaaagtgctgcttatgttaatcgtattcctcagatcatggttcaatatcaacattttttatataaagcccttcttgtgttttctcatatagttttaatttccctttatttgctatgctcccattcccttcctccattatattgtatttaatatatgtcctcaggtaagggtttatccttgaaaatatacagagtttatttgtacatttgtgtgttttcacttaaataaatgacattgagtcaatacccacccatatccatcaatgtagatatacattatcacttttaatggcttcataatttccattcattgctctaaagaaatttatttagccagtttcctgtgatggacctttaggtagtttttaaaagaggtttttaaaaatgattttaaacaatgctgaagtaaacaccctttgtatatatgtcttaacaggcttgtgtcattatttccttgagataatttcgagagaccactttataaaatattccttacccaatctctcaaagaagctttgttgctggtttcctagaaagaagcgtgttctctctctcttcctcatgacactgcttttctctccctaacagcacttagtacagtcatctttaagcttcgtttcatacgttctctcttatcgctcaactgataagctcttgctgttaatgggagggattacatagtaattaattaattcaacaacatttcctgggtatctgttcagcagtgggctctgaactagtgctgaggtgaagtggacaatcacccacccttgaggaacccccatctgtgagatgggagacatggattacagatactactgtggcaggtgatgcagcaacagcagttgtgtaatttgcaaaagaagaagtagccgtacagtgaagtcactgaaaatgaggtacctcctctacatcttgaaatatcagtgggagttcactagagaaccaacgtgtagctaatgagaactgccctcagagcaaaaggagcagcaaaaggaaacacagagaggtttggcatgatattaggaagttgtagcataggtgagaacatggggagagaggaaactaaagaggtgccaggaggggtgaggggaaggaggaaggtgggaggctggagggaaagtgtaggcccaagtgagcaggtctgggaagccatgctcacagttggaattcagagtgaggataatgagagaccactgaagggtttaagcagggcagtgacatgattgggttttgtgttttagaaaggtcattccagctatgatagtatggaagatggaattcaggagggtaagactttagatggagaagcaagttaggaagctattgtactactcaaagtgataggataatggcttgaaccaaagtagtggcaacagagaaaagtagatggaatcaagagttagaaagtagaacctaccaacttcttaacttgttgataggtttacatacagaaacacgaaatagagaagttcagaatgatgcccagactctgcatggaaccttgtgaagatggcgggccacttactcggagaggaacaaagaataaaaggatgttttaggggaaaaaggaggacaaattcatgtttgcatagtatgttgagtttgatgtggtggtagaatacaatggtggaaatgtctagcaggcagatgaatacattatctagtattcccaaatttttctttaggacctcccctaaagacctggaaagacctgtcctaaagaaaaatttgggaatcatatgataatactgagtaaaagtttgctgaataaatgaatgaattgactcattttcagcatcatgtttccttcaactagaacattttacttctataaagccaccttcatacgagaatttcaaagttgtttttaagactaaccaacatgaattaaagtatctttttagaattactgtagagataacaacttaggaacatggtgagtgcaaatggctctcagagaggaaagagtaccagcctaagagtcagaagatgagtgagttggaacttgtctactattggtggacactggtacatgccactcaccccctccaccaaatattcaagttctctgaatgcaaagacaggggttgcattcctgatgatcaatgcctaaccctgtgacagggaatgtgcaggtgaagcgggacactccaggtctgctcttctctctcggcagctccctgctgttctcagataagggccacagtccctccccactgggacttggcagcacaacctagaacacaatctgttggacagaaggctgtgattattaatgaaagcatttcctctgttacctcacagaactaagtgaggttctaacactgccaaagatggcccatttcctttcatagaaaccaattctcagaaacacataggatggtcagagacagtacacatagggaagtaaaaataaggtgcagaaaagtgggtggctgcttgaaacactcccagatgaaaggttaccagctattaatcagctcacacttctgttcagtgggtgagcaagaaattggatggaaacttcactcaatggttgatgcttagttggggctgtgaggtcctcagatgactttcctcagtcaggtcggatatgatgcacttttatgtaaaggaaggagagtcaacaaggccacagcaaaattccctatgtttcacaatttgtgtacgtctgtttacatgtgccaggctcggtgccatgtattgaggttaggatgactcctgctgtctaggcctgaatcttgaacagtccccctctccatcatttggagcagcccagttggctgggtcctgtgatgaggataataatagttactgttttttggacacctgcctcatggaaggcactgttggaaaaaagtcagcattatctcatttatcctcacaacaaccctttgagcaaataacattattttatttgaaaaatggggagattggggttccagtgggctaagtaacttatcaaaattcacgcaccttgtattaagcaggagcatcatttgaccctaagactgactccagcacacactttttttccctactacgctaagtccagatgaaaataaaagagacatcagaacctgacaaaaagaaggaaacccacaaaaagggatacaagggaaactgagtctgagtagaaacttttccaaagtcatagaatagcacctgggtatcaagtatggcttgggtctaagtcatgtttcccaggcactcaggaaatgttctttgtgccttggaaaggaggcagatggcagttgcatctgacccccaagggtcagatgccatttgattatgccattttgaccctttgcagatcagagcccctggacatctggcccccaagtttctaagtgggttttagcttgagaccacctagtgaaagccaaagaccaatgtccgctgccagcacccagcccagagtcagggatataccatttggccaaggctccagagccacttcaggctctcagcacctgccctgtaaaaagacagctcaggtggaaacttcactgggagcagctggggcaggcctaaggagggagtccactcgtcacaccctactcacatgagaagacatgattctgaagggcttaggaccttcagcctgtctcagtacccaaggatcacaggcctgggcactgcagcaggcatcagtcttatcgttgagacttggtagctagggcatggctaggccctaacatactaactcgctatgttttctggcataagtcccctagcctccttgggcctcctctagaaaacaaaggggttggatcagatgattgatccctggggcccacttctgctttcaccttcaggtgtttactatactttggcaaacagaactcttgttactcgccctaacattgccactgccactgctgtcaaaatattttccctcacttattatagattaaaaaaatatgtttgccttatcttgagtccccagggattcagtctgtgccccctcctgtttcatgcttatggggtgaaacctcaactataattccaggagattcaggttttgaggtaatgtcatcagaggatgctgtaagaagggatttctgttctttccagaagctgcttttgtccccagacacatcatgaaatgccagcttgtggtccacaccctccctgcccgctgggaaatgctgctgggggcttgtgagtacttggcttctggaggacaaagaagaggggaacagaaagaggcatagtgtcagatatttgccttcattataaaaaaaaaaaaaaacatacaatatgctgggcaattttaaggcatggttttcaaggctgtttttaacagtctctggaaaccagcaatccggtgtcagttgtttataggatccaagggggtggtgctgggggttgtttcaacatccttgcacagagagaaacatgggtagtggcttacaagctttgagtgttagacacagggacagcatgctgtgggggtggggagtgggggacacccatccaggtggggggatgggcttctcatcccagctctgccatcagctgcccatgtgatctgggaaaattcatcaccttcctgagcctcaaactctccaacctaaaaccaaagggcttaaagcagaggagcctacaggcaaatcttttcaagctttggtcttcccttgtgtgatcttggaattctttttttcttttttttttttttgaggcagagtttcactcttgtcacccaggctggagtacaatggtgcgatcttggctcactgcaaccttctccacctccctggttcaagcaattctcctgtctcagcctcccgagtagctgggattacaggtgcccaccaccacacctggctaatttttatattttcagtagagacagggtttcaccatgttggccaggctggtctcaaactcctgacctcaggtgatctgcccacctcagcctcccaaagcgctgggattacaggcataagccactgcacccggccaattttggaattcttaatgctagtccccagtacaaggatcttgaaagcacatcaggaatgccagatggggttagtgaggaatcagggagaccttgggttatgtctgtgctggtttggggtgtgcttcttagatcatgtacttcgatttttatttatgctttccagcagcatttcccaagttgactcatgatcatattcccctgagttgctttttaaatgtacagatttccctgcaagggatcaacccactaagctgtatttttaaggaagaaccaagggtgattcttgtattcagacaagtttaggaaagactgcttaagaggtttcacctggggaccggtgacaggtgaaggtgcctgatttggtcagtatttgtctgtttgtctatcctctgtgttatgtagctctctactatgagtattcatttcatcatgcttcatattccaagacttgtaaatgtctcctgcatccaggtctgagccctttaagattggtaccatgctttctgtttatatcccaccttacctagcacagagcttttctcctggaagattcttaaaacatctgccaaacttagttgtgcagagagttttctgcctgattccgtcaagttaattatgccatgggtcattattaaccacaatatcaaatacaaggaaaagagaggagtagtaacagttggcagagaagtatcatggagaaaacaggattggaatggagtcttgcagcaggagtaaggtttagatagatggaggaaaaaagcacaaggggcattccaggcagaagtctaagcatgagaaggccagtctctacaaaggcaattgtttcaggatatgagtgaagagcctagggctcaaagaaaagatttattcaagactgacctaagtaatctgtcactgaccagcccattgcagcctctttccatacttgcattacatgcaggtctccaacctgagcccctaaagccctttcttcctttgctctcggccctatttccaaggttgttttcccactgctgtgtttatcctgctatgtatttgcacatgtggtgggactgctccatttcagccactcagtttttatttaaatgaatcttgctaagattcagctaggctgattgctagattacctgggaggagctggatatgcagttctgtgtgcctcttcatactcagcagaccctggtatgttctggaagactggatttagatacagtaggtaagagacaggctgagggcaacacacacacacacacacacacacacacacacacacacacacacacatatattttgtttcaatcctctttaatacccaaagggcttatggaaaaaagatgctcatgggtgcttcttggctcccttgtaggccctttccacatccacgaagttctcctggtcctcttctaggagcattcttaaatcctctgcctcttctgctctggaacctgctatcaagacagggtaggaaatggatgagagatgagcgaaactcaagacaggaagaccagttgggaggtagttgcagtatctttgagatgatcctgcaggtgagagaagatgatggcctctattaggaaagcagtggggtgcgagagaactgcatgcattctttactaagcccttactagctggtttagctagggtaaattacttaatctctctggccttcaaagttctcatcagtaaaaaggaaacaatcataatctcttttttacagtttttaaaaatactgtttttaatgctgtaaaaaaggggtcaatagtttatatgggtcaatgttgttgcacaaaagccttttgtaaattagtgtacaaaagtgccatcttctctggacatcatttgccattaagtgaaactgtgctttcctccacaagggctctatcatttgaagttctcttgtccatcaaagcccttccaccagtcctgttttgtgcctagcactgaacttctctgtatgacaacacaagcagtgagaaattcttttggtttggggatgggctggctttaatattatagcttgaaatcccagcttaaaagtaatacactccggtttctgtcccctcccttcttcggtaataaacacttaaatgctgatgggttctcaggtcaagaatccacagagcctgcatgtgttgagacaagccaataggaggtctgactcatattttcatatttacaaaacctatgtgggaaatcagtgaatggtagagttggaaaggccttaaagatcatctggtccaactcctcattttttaaatggggaaatggagtaactaggaaggaaaggatcttggccgagatcacagagtaagttagagacagagccagcctgcttccccctcatatggtgtagcggaatctctttattgggaatgtgataaaatgtactgtttgtactctttctgttatgctggtcccataatgaaagatactgcttggcccatatcactgcagcccagagcaaaaggactataggtggagagtattaatctaactacactttcattcatttatcacacattactaaacaccacctttatgtcagttactgaagatactgagataaaagacatgggtcccacctgcaaggtattcaattttaatgatgaagacaatctccaggagggctgaatattttccatgcagttaaatgaaatatttctcccatctgccaactgcattttatatttatacttgtgaatgcattgactctccttatatatagattatgagacattttctcagaaaaaaaataccaaatatctcagaccccttatttattcatgtcctcaagaaatattatttgagcacctaataggagttaccaagaggcaaaaataaataaataatagtcctctctctcaagaaaccataataacaatccagtagagaaatacataatgatcatggaagcttttacaaggaaagggagatacctaagagaatgggtgcctaagtttgccatggagagtccacgaaggtttcatggaggaggtggtgtgtaaattgagactatttaaagaaggggaagaagtctgttgagcagaaaatggggggaagtcattctaggagaagagaacagcatatgcagagccatggaagtgtggaagcatgcaatcctggaatctataatagtttataatcactgacacatgagaaaagacagattggcagaaaacgaggatataagtaggcaggacctgagccacgctaaggagatgaggttgcatcatggagactaaggagaagtacagaggcttttagagagtagatcaatgaggtttgtattctggaaattcactcaggcagctgtgcagaaggagagtggttggagtcaggtagcccagtggggaggccaatctttaatcaaggcaagatctgatgaggcctatgagggcagtggcaatgccattctgagccaggccagaacctgactttctgtgtgattcaaccattgcccaacacacctgagtgatggtgcagacccatacaagaagcatgaagttatgcacttgagtctccaaactgtgattcacagtcctgacaatatttcctgtgcgtgtaagagaccaccctctccaaagtcaactggaacagtttaagacatcacaagtgacccatggagaagccaagcttccttgcctaacaaagaagctgatacgttgttgaacttctaaaggcacttgggggaggtggtttttaatacaaagtcacttctgagcttgtggtttggtaaatttaagtcttttccaaacaaggcagccaggctggcaaagtgatcctttttcatcccctctaggcactgattcagttctctgaagcctccctgctttcgctcttcctgttccttctcctgaaatgtctttcatccaccagtctatgattggacattggagtcctatagatccaggttcaaattctagctccgccatgcattaattgtatgctcttatacaagttaccataagcgttctgagccccagggagctcccctaatcctgattgctcggtgattgctgagcaggagatgaaatttgtgaggtgttccattaagtgccttctccatcgccagcactcaatattaaatagctatttttcttaggtgagattctagtttaagaatgaaggtttgtaattctctaccaaaaaaccaaagtaaagtactgaaaggtttcacaataatacatcttttgattttcaggataaccatgaattagagttttcttactcacattaattaaacctgacacctgagtacccacttgatttccacacccagctgtggaattccacagtaacttataattaatagacagttgcttataagagatttggaacttgaattcagagcaaaaataagtagagaagccccatgacaaagggaagagttgctgatactgggcccttttctcatgctgacgagtttggagggtaaatggccatcttaatggtatcatctgactgcattttgtgctgccgagattgtgctgagtggaaatttccctggaagtagcaagagtggcttagtttcattacagtgaaagaattggccaatgttggggcaggttactgacaatgggtgtggaatctgttttaggagaagttaaaaaatcatgacaataaagtatgtgatgagattaccccttccaggctattgcaagtgtagacatgcctgcagcttgaaagagagtttgtctcaagcacagtgaaggactaggttcacttggttaattcttcaaccctaactcagtatcttttaactgaatttgaaagatcatctggcactttccagattctggaaattttccaattttcaagtttaacttgactttttaaatcaatctggggttaatttatgtgttaattcttttattattattattagcaatagtcttattattatttattataaagcaactttaaagggaaaattttaaaattatctttaattttcctgcagttattttaattttggaattttttttggcctttgtttacctacttacttgttaatcagccatcacaatgaatctgaaagagcttcattattatgtctgctttattaatgaataagttgaagataatgcagttaattaacgttgccctaagtaacacatgtagtaattggccaaatcaggaagaaaaatcaggaattatctcaagcctgctctgtctccctactccctgctgtgatgttggccacacaacctggtgcttaatggatataggtaacattatcttatgcactattactttaactcaaaatcagaaataatagcagtctggaataatatcaacaaaaactccccaaccaatccctagaagaaaaccattaagattttgtcaactctgaagacaatgttgtacgaactttctaattatgagaggagaaatagagaattagtgtgactaatagaaatagctgtttttattggggaaaaaagctccaacttgaaccagaccaactgagactccttaatattgctgattggatattccaagccacttactgatcatttagttataaagtcttctcattgttcttgtcagtaatcccactgagtatcccattaaactaaatgtagagttaaacacctgggaggcaagtgttaataaagtgtaatttgtagaaggaaaagaaaaacaacttctatatgcttactatgaatagcataaaaagggatggttgccttccatttgggagtcaacaccatatgaaagatgacacaatgaggtaaagagtgaatgctacagcccttggaactgtcagaagagtctatttcactcatatatttttctagaataccaagtagaaggaggcagacttgggaagatatgcatcagccacactggagggagttccgaccatgggactgctcagaactctagcttggctcctaaccaagtttgaaatgatcacagccacagcgctaattgaattaatttgcttttcttcaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaaggtaagttgtttttcaaccttatttttattccttaggccagaaactatggccttcatgaaattgtaccctcacatggaattataactctaagtagctagtttgtttcaactctggctgttttccatccagaaagaaaaattaacatttaaaaatgcaaatgtatatatgttgttcccaaaataagcaatttctgaacaaaaagagtaattgttaaatcaaagcactgaatagagctcaaggaatgacagcatctggtgaaagaaccataaaaagctcagagaagagtgtttgctgataattattgacagtttgctaattacagcattatttggcctgttaaaggtatatgtacttctcccagttaaagaaaaagtacacaagagggctttttctctctctctctcttttttttttttttttttttttttttttttaccagaaaagatactcctgtatccagataagaacccagattcccacaacagaacatttagaaaaggggtgggggagtgtagcgtatctctggtcagcaatgtctacaacatagacaataactcaacactgtacactactcagaagctaaactttccctgaacattacacagaacagtcccataaaaggtacaatttctactgcagtggtattgttttggcttgtctgagtctacaagttgtattggttctagattgggctgatctaagacattccacttcgtgtatacttatgtaatgttacacaagtgaaagaaatacatttttaaaactttttctgattaaaataccaaatagaaaaatattgctttatatcatttaattagcaaatgttgatttgagcaatattgaatcacccagatgtatatatgtgtatgtgaaatgattgaataaaatattaagcattatcattatgtgctgaagctgaacattttctataacctatgatccagcaattccattcttgtactgtacaagaaggggcatgtgtaagaatactcatagctgcactattcacaatggtaaaactgggaaacaacccaagtgcccatcaaagggaaagtggaaaataaacagtggtatatttgaacaatataacattatatagcagtcaaaatacttgaactgtagcaacactaagatattaaaaaagcaagtctcaaaagattctaaaggaaatagaaatttttaaaaatgtgttttataggattaccaataaatgcaataaaatcatataaaaagaaaagcagggaagtgatgaacccaagattcaaacgaaaagttacttcaagtggggaagaccaagggatgaaattgggggtatggccatgtggttagatatatattgtgttcaaagtcataactgttgcaagtgtttattgcatcattaaaagctcactaatcaacagaataagtagtgtgcattttatacgatcactgtgacatttctaagaagatctgggtaatcaattattagcatgccaagatcttttctatagaagtgctgagaaagtgcatctattactcaattgatgtctattgcttttgcagagaagtgggatagtatgtatttcctagataaccatactactctccctagttttcaatgtcatgtcttctattttatcacctaggggctagtccatgccttggaactatctctattctcaaccacaaagaaagtacagacaaacaaggtttttcaaagtcactttcatatcactaaaggccatgcaagctgtcaccctatgattaagagagcaccgtgtgccacgttcctcactatttgtttaaaatgagaggggtattgcctttgaagaaatagttgaaatgcaggaaatgaggtattttatttacacactggaagtatgtagcactgaaaaagcaccagcctcaaggtgaggggtcatgtaaacattaagcatgccttggcgttttatggtacaactgatatatatgcaccaaaatcatctcccacctccccatctcactcctagagtgggttttttattccaggaggggaatatatgactttctgaacttaggtctatatttttggcaaactcttattccaactctgcctgtactcttatatcaaatagaaagcaggcagtctttttctccttctagagttgtccaaggacagaaaaaaaccgcagcagaaatatgccacgtacacagaaaaaagaaaggcggatctgataagctggaaaggagaagcctggaaaaagatgtggattatgtaataggcccagaagatgggctgatgagaaaaagcttctttcaatgtttctggaaaaaaatgcaaatattcagcaagacacggtcattatcctggtgaatgggcacattcagtgattccttctatctttggtgcagagattgaggcatcttgggatgcaactgagggagcaaagctgactgcagcctctgccctcctgtgtgtgcagtcaacctggcacatcccctcttgctaccagacccgtttccctttccagggggaagtcaactcggttgctaaaaaacaagttctgatgagtgtttaaggaggagcaggataatgggagtggctccgctgcaaggccaggggccacagtctcccaactttaaaagcccttgcattccaaatgtgaaggaactccttcagcagatatatttttaaaagcatttaaaactgaggtttagagaaatgaggcaatttgcccagcaacacaaactgaatgtggaacagacttcaaagacaggaatgctgactcccactgcagcacatagctctgcctctcagccaaactcccagggcagctcctcattaacaccctccagcccatccaccatacagctgctggagtgagatttgtaaaacacagatctgaacatggtccctcccagctagatgcaggcttcactctttagtcatgaagacacagtcacctcatttcaatcaatgttaagacccagcggctagcacagggcctgccacggagcaagtgtgggtaagcatttcttgcctgaatgtaataagtgctggctgtacatctccttcttaggcagccttgtgatggaggcatataaaagtgactatgggacagtcctgcctgccctcccgaatttcacaggcaagttgggaagatgtgattcaccacaatgtaatgtgtaatgacagaaatgtttggtggtagggcaagagtagaaagcagagaggttgatttcaaaatggaatattaaaacaagaagttaattaatgcagtgatgagaggaagacttttctattaaccttttagaaaacaaaattgtcccctagcagatagctctttcccttttcaagcttgctgcctgttatcagctgaataatattcccccaaattcatatgttgaagtcctaacacccagtacctcagaatgggactgtatttgcagacagatcctttacagaggtaataaagttaaatgaggtcatgagagtgggccctaatccagtgtgacgttctttaggagaggaaatttggacacagagacatacataggaaaggccacgggaaggcacagggagaagatggctgtcatctaccagccagggagagaagctacatttattggtaatcctataaagtgcattctttaaaatttgtatttactttagaatcttttgagacttgcttttttaatgtcttattgttgctacagttcaagtattttgactgctgtataacgttatattgttcaaatataccactgtttattttccactttccctttgatgggcactacttgggttgtcaacacattctcttggacttccagcttccagaactgtgagaaaataaatatcttgatttaagccccccagtctgtggtgctttgttatggcagcctgagcaaatgaatataattcttattccttctctgttgtcacatgcgttctctgtgccctctacatctgatagaaagatgccttctgtcccagatgtctggaactccctggacacgtagggatttctgtgtgtctggccacagaagtcatagcagatgtttcatcatccccaccacagcactgctgctgataggttgggaagaaagcgtttgaattttgtcaccaagaaccaagtacctgatcaccccccaagggaatttcctattttcaacaatcattttgattgccaatccatcacaaattaagatgggcagtttgcaattttaactgtattttcacagaattggctgcggtttaatgagaaaatcaacccaggggaagagcaagcaagtgtgtagggaagaagtgtctccatcccagggtcctctaccttggagagttggtgccattgctattttgcttagccactgtgacatcaaagccaaagaaatcaagaaacaaacctagaggaatcctgcaaagagccctaagtggattttaatttatgtttagagtttgactttcaagattattttcatcaggaaacatttgggttggtttaggttcagttgaaaaggcagtcacagagttgtttaaaaaaaatgggatttgaaatctgacagatgtgagagtcattcctagctgtgttacatttaccaaatctctgccggtttgaatttgtttccctgtctataaggtggaaataataagacccgttttatcacctcacatagcggagtcttaaaggaaagaagggaaatgaaaactatttatgacatatcaaaagttgtgtttgctgtcctgattgacgatcctctcatttacacttacacagccaggatgaaaataagtttcatttcacaggccacgtacagtggcagcaccaaatggtgcacagaggagggtgagagactctatgaaatttcaacaggaaaatgtgccctagtcaaatagtgatgtctaccgtgtattcttgtgggtttgggggcagtggtcatggcaggacatactatgaggcagtgtcatccctattcccatcctggattcttagacaccgaactctgtgtcccctaagcacaaacccttccccagctcccgctgccagataggatgaagatggcacttaaggccttctttaccatttcctaccaatctctcaatgtcctgaccctcatgcccctcctccagaaaggagacttccttcctcaattctactgcttattattttgcagatgaggggagaggtcctcagaggccactgagtacccaagggttgttctattgggctctggcccacctctcctgagcctcagcttgtgccattgctccaaattttcttcttagaaaagtcttaggccactgacaggtgcacctgagacaggtgagagagccctagagtccaatttgatcatcattgatttaacagtttgaattttaataaaatatatttgcatataacaagagttcctaccaagtcattccctgtccctctaggtggtcatttcctgaggagtttctgtattttgctcattagaaaacatgcttccagcttttctagctaagagcaggcttatccattggttcattcattcacttgagacccattttctctgtgctttctgtgggacagacagtttattgggcattgccttcaattgccctgagcaagctcagagcctggaggaattggtgtatcatcttatttttgagtaatgcttttcacttcaccaaaccatctttatttttacaacaaaatatactggtggaattcccttcaatgagaaattttccaggcctaaggcattgaaaatacaaatttactcaccaaaattttgttgatacaactacccaggaatatgtactaaaacaaaataagaataaatgttattataggaccagcacctaaatatttgatggtaaaaatcttttaatagaataagaaatatttttctagttaatagatattatgaaaacattctgtaattctctgtgtggttttagaattctacttctaaattgtgcccctgggcttaaaaacctactacgtggaataaaaggcattcttcctaaagttgtacacaaacatataataattataggattttaggtgcataacctctgtcttatagaatatgaaataaaatatataatcaaggtctgcactgtttgctgtgggatttgaacaagtgcctttgtttttctggttctaagttcagcatctgtgcaaatgaaaacattggtctatgtaggtggctttcaaactgtaacgcatctcagaatcacttgggttgactgctcagttggcagattgctaggccccttcctcaggttgctagttcactggaattagagacccaatatctgtattcttagtaagacctgccaggtggttctaaaggacaaaatctataagtgacattttgaaaaacactaatctaggtcttaacctggaagtatgtttaaataggcttcaggagttctgcccacactgaagtcgcaagtaaaattttatatataaactctcttggggtagctttaatcagattcattgaggattctgtagtcccaagaaaggataagagtcactaaaagtgtttctaaccattggcagacgtaacattctaggttccataacagtggttattgagtcttaattggcactaagacaaatgcagcaaaatccccttctaagttatactttcaaacaaacttcactggcataagaatacaaataaaagcttccaggctttgttttgttaaattggtttttactatgtagatgatgtttgactgattcatttatggcccaccaatcaagctttattttgtctatagctccacgctaatgcagagggagtctccagtgggataaaacgcagcccctgctttgcagtcctcctgagcacttctatgtgccaggggctgtgtaggccctgggtctgcagaggaaaacaccacaaatccctgcctaggtgactatggtctggtgccatccagaaacctatagtcaagatagggtaaaaaaatacatatatgaacagctatcacactgggttgattgtgatcaggaacaggaaagacaaggaagggcctggagggtcagagagggctggttaggaaggtgacattcaagctaatccacaaaagaaggtgaatttgaacatgaggacccatcagtctgtctagaaactaaaaaatctcattgactaagacaataaaaatttgaatttaaaaatgattattgtgtttttgagcccctgttcctattgcgttggcaggaggcccactgggtcaagtatgttaggttgaaacaaaaattcaaaaatcaaaaataatcaaaaacgtcttggcagccttgctgagatcaacaacctgaaaacaatctgtggaagaaaaagcttgaatacttctggggcttctgccataggtctctcccttgtttctcactccctcttttctctcttgttctctctctcttgtcttctttattcccttcctttccaattattctaacccctgtcagtctgaccagtggcttacttgatttcaccaaggcctatgaaatcgatcttagagatagcatttccttcactttaagccatagaggttgggaagtcaggagacttggctgaggttacaaagtggtgagtggagacaaacacctgagtcactcagcccagccttcttgccaccttttcatgcttcctgtgtcctgggagtcacattcaggagcaggcatctgggaggttctccagtttatcttgtggtagagcagaatgcacatcatgttgctccatcctagccatctttccaggatcagttcaaaagcttctccctgggaaatcatttcttgacctctccaattcccaaagccaaaagagtctcttccctctgtgttcccaagactttggtgtgcatctgtcccaacttttagcaaggacattctgttctgcaacctgaatacaggtaaatgcagtgtgattttaattagaagcctggatgtgcacctggttctgccatacactagcagtgtgaatatgggaaagtcctttatgcttaaggtttgttaaataaatccacagaccactctgcccctcagttttctcacctgtcaaatgagaataacactctgggccttgcttatttcgtgggctcttgttgagataggagggtggtgagagcaaaagtgcttcataagcattgaatcatcttgcacaggtgaggcttatcagtgacttggtgttaggtacctcagcatgggaggatatccagatgccaaatagtccagtttattgggctgtggcatcaagaattttctctcatcagatattttatcaaaagaaaatgtgacagagatgactactgcctcttctcaacatctgattcaaataattttgaatataaaacatttcaaaaaagatttggggatgaccagtttttagggattcagattctgtttgttactaagatgtggttaggagcagactttattaaaaattcattgggcagagctgtatatagaagggttttaattccttaaggaatagacattacatgaaatacataatgtcatccagacagggctagtgaggatgttgcaatttttagcatgtatttccacttggaatgtttgccaatatgattgaggctgcattcaacttgaattaatggggaagacaagagctggggtctgaaatctcaaggaaaagacaataataatctagagttctgagaaaacaaggtcccatgtgaggctccaacagtattttattatggtgatattgtctcagggaatagctagctaccagcattagagacagcaattaccccacaggggtcaaaatgataaccttcccctgtctccaagggtgtgaagttattttggatggcttccacaccttgggattttgctttcccatggtagggcaggtgtcatttagagagatatcagtggttattgtgactgtggcatcctgaaggaattgctcttagatggcacctcaacctctctgccctcaggataaggttggaaagagccctttagaagtctctcagtccactccctcccccattttacaaataaggacattgaagcccttgaatgagggtttaaagctagaaggatgtgctgtcccgttagttattctctgcagcagattgctcaaggacactccatttctaattgcaatagaagaaatgtcaaagcagccaggcatggtggctcacacctgtaatcccagcactttgggaggcctaggtgggtggatcacctgaagtcaggagtttgagaccagcctggccaacatggtgaaactctgtctctattaaaaacacaaaaatcagccaggtatcatggtgcatgtctgtaatcccaactactggggaggctgaggcagaagaattgcttaaacctaggaggcagcagttgcagtgagccaagatcacgccattgcactccagcctgtacgacagagtgagactccatctcaaaaaaataaataaataggccaggcatggtggctcatgcctgtaatcccagcactttgggaggccgagatgggcgaatcacatgaggtctggagttcgagaccagcctggccaacatggagaaaccccgtctctactagaaatacaaaaattagctgggtgtggtggcatgcacctgtagtcccagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtctgtgaatgaccaactcacctaggtgggagtcagttacccctgccctccagtggcccatggagcacctgcgggaagaaggctttctgtcttactgattcttccatctttggtgtccaattggaaggattcctgggccattgactgtttctctctgagggttgttatgaagcttgtggctccattctcatgactactgtgatatttctgtgaatctgaccctgccctgaactccaggtcagcttctcccctcacaggtgaaatccagtcctattataactgggggagtgatagacagattttgggctattttacgaccaactttccctgtctaaaatgtcaaagcagccgggtgtggtggctcacgcctgtaatcccagcactttgggatgccgaggcgggtggatcacctgaggccaggagtttgagaccagcctggccaacacggcgaaactctgtttctactaaagatataaaaattagccaggtatggtgcatgcctgtaatcccagctactggggaggctgaggcaggagaattgcttaaacctaggaggcggcagttgcattgagccaagatcacgccattgcaccccaagctggaagacagagtaagactccatctcaaaaacataaatataaaataaaataaaataaaataaaataaaataaaatgtcaaagggaggaatccctttgtagtaatagagaagctattagttgtcgtccaccttcaacaaacaactatagaatggcgtctaaaaggagtccgtagccaagagctatggagtgtgtggaatttgagtcagactcttaccctactctaagggcctcacagcctaggagaaactcttaacaatctgtgtaaatagctagaagagatacaaagtaacgtttgccccaacataggtgcagattttctagcctaagaaatttctgtataaataacttcactgaagatttcaagacaccttgaaatttaggtagatttgtagctgcaaggatgtcattcctaacagagagacaacctaagaaagggcacaagggcagagtctcagttcatttgagctgctgtaacaaaacaccataaaccaagtagtgataaacaacagaaatacacttctcacagttcttgatgctggcaagtccaagaccagggcagattcagtgtctgctgagggccccctctctggttcataaatgactctttcttgctgtgtcctcacatggtgaaagaggccagtgagctctccgaggcctcttttataagggcactaatcccattcatgagggttgcacctagtcccctcccaaagaacctatctcctaagaacatcaccttggggattaggtttcaacatgtgaatgttgcaggggacacaaacattcagactctatcaggcaggaagacagggggatgatgtgggaaatagcaaggagttctgttggctgaaatgtcaggtaaccaaagaagtatcagggggaaagtgagatgaagatatgggtagagccaggtcacagagggcatcaaatgtcacaaaagtcctaaggtcctgaatgtggtatacaaggcgatcagatggttttctgcatagacaattaatccacaaactgccaaacgtgttagaggacaatggaaattctggtggcctggggttgtattcttaaaacaacatgatggacaataccaagaaggaaaagttaattttcatttttcctcataaatgtcccagtgactcaagggatgaagatacaggagcttgcattgtgccttcaggagaatgacttagagcccaagatgactcaagttactcatgaagaatttattgtctgtaccttgtgtgtacagtactagactcaacaccaggggggtcagcaggtaggacatccatggatatcccaggccatctgggaagataaagccttcaaaactggcaactgcagcaacagcccaagagctaagtgtgggtgtaggtgagctgcggccttgggaactcaaagaacaggaagggagagagcaggttgagggcgtccagcagggcagagggtgtggtgcaggagctgaagctgacatccagaaaggacttagacaaacagggagggtaaaaacactccttgcactgagcaggtgatgagcaggggagcagaggagcaggcggtgggcagggccttgatcctggaatgccaggcccctccctgctcaggggcatgttgggatttccctcatgtggtctgtctgcttagtcagcctttatcggcagaggccgaccccagcccaccagcctagtcttgtggtgtcatcccagccagagctggcagtacagatcccagccagagctgcctgccctgagccctccacttgcttagggaggaggcccttccttggcctttgtttctgccactttccgcagagagaagctggtgatgacttgctgagtaaaaagtggattgaccaactttccgggtaaaaacagtaacacggtgttcccgtgagaaccagctgggcctggctgctacaggtggcccctggggtcagatccccaatattgtaggtgaaataccttcaatctgaaataaagaagcatactcaaaacattttggtctgaaagcaaagacaaatgggttgttttatcagtgtggctcacagtgtttttagggaccagtgcaagatggttgttgtcctatgtttgttcatttgggtggtttctttttttctcctgtatattttttattactaaatggcacaaagatgtgtggtgaagctatacatactatcattttgggcttggttctctctatccgaggcagagacaacagcttggaatacgtgttaagtaatagctgaaaaggcagctgctctgtggagagagcagccctggagtaagacacagggttcttacagggtttgaatccaggttctgccccttgggagctgtgagttttagggcaatggccttcacttccctcattttagattctgcagctgcccaatggctcttcatatctactttacaagtgtctgctattcaactgctcaataaatggtaaaggtcactctaattatgactggggatagagtatggggttgaggaagctggcactgctgtctgattatgcagcaaagatccttctctgcacagcatcaagttaggatctgctccaggggactatgcccccttggtggtatggaaactgtcttggcctccaatccatgtgaaccagccttcccagccttccccagaacccctacaaggctgacccagtcaccactgcttctatgtgaaaaaaagtttaaggaggaagtgaaaaggctgtccctggtgcaggcaccagggaatcctcccagcgactcggcgggtaagccagcagaggaggaaaccttctgctccttgagcccctccgcagcagctggtaacagccttgaaggtattacactgatgcaagagaaaggctctcggagaatacaattttccctcaacaaaacaacccaggcagagtgttaggggcatgtgcagagccccctctcagggctgacccagagggacaggatcacatttgacaccaagcatcctgaaacttggaaatattggagtgtaggtggcaggaaaggtgtctgttatccccgtgcagccatcaaatttactgttggctccaggcaggctgccataccctgggaatgcaggcagggagtctggttggctttaccacataaaacaccatagaaaaccagatactttacgtcctttctaaagtaaatcaaaggatgactagatgcatagatgaataatagacagagaatactagccaacattcgttgaatgctcagtgtgcgtcaggcattgttccaagcactctgcatatattaactcatttcatccttataagggtatttgaggttggtgctattattatttgccccattttacaaatgaggaaactaaggcacaaagtagttaagtaactatcccaaggtcacacagcattgaaacccagcagttggactccattgccaatgctctttacctggtagagagagccttgatggagatctcaggtgatcctcatccccactaataagagtggtttgtgtgctttcctttcctatagtcttcagatttaaaacattgacataaacgtctgatatggttccaagtggctcctaggatgaaatgcagagaagtgaagagtcgggggctggagtcagacagaaatgagtccaagtcctggctctgcactgtccagctgtttggctgtaggcaagtccttcatcctccaagtccgagttttctcatcaaacaaatgggatgatgacctgcttcacctgcttcccagagcagtggtgagggccaggaggctgagggtctgacagtgcctacacttctagcttaggttccttgttgacagcactggagttgagtcagaagaaaaccaaggtgggctatgactgtgaggttggagaagcccaccatgaggaattacaacttccctctctagcagacttcatgaccataagctgggatcataggtcctcatgcctggcactgaggagccagagagagggggcttgattaaatgagacaccagacactgttggttacctaccagatggtccctatcccttcctctctagtagtggcctacctctcaaaatagaggctaaaaatccagttacatgctttactggtctactttgcatgaaagacatatgtaagttacccaatcctggtcaaaagggatctgagaaaaggtcttctggggtgggaaggattctggaaaaggtttttctttcatccagacaagcctgctggattttatcgtgtctgtgtgatgcctggagttgccacagctaactttcaatggtgaggggagataaggcctccaagctgaacatggcagagtagaaagggactgggaacatccctgagctgcagaattagtcctgaaacaggacctgggccacatgctgtgtgggataattaaccctttgtgtcaaggcctgtcttagtggggtcttatgttccttgcaagagaaagcatcctacttaatatgaaggagaatggggctgagccaggaggccctgaacttggtgaggactgttgctagcgagttgatctgggccagttacaaacctgtctgggttatagagtctcaatttattaaagagggctagtaatccctgctctaccaccttcaaagagtatttgtgaggcgaaatgaaacattttttttgtctccacctcctactttgatctggagatacaaaaatgaataaaatgtggtacaaaggcagagatgggagtgaacaccctgttcaagggacagaatgaagttcaatatgagtgagaagagtggtcagtgagtaggagaggcaggtgtgacctcaatgtcttcctttgtaaagagagggagttgaaccatgtcacttcttaagttcccttccaacagcaagattctagaaatcacgtgcagctgtcactcaatctctgctaggcatgcctgtccctatagcacaggtcccttgacattgtggctatttttttgtccagctacccacaaggtcagggactgtgtcttagtcatctctgtatccccagcaatcaataacaaaaattagttggatgaaataataaattaacaaatgaataaaggactctgtttcatagcttaactgaaactcagttgaaagaataagtgaaagaaatgaaacatttaaagtgtgttatccagaataatgagctacagagattctcaatgaaccttttcaatacagaatgtttaaataagtaatatgcaacataacataacagaataacataacatcccccattctgagagtcaagtagctagctaattttcttatgactacgggaggtacttaccagcaaaagagagttgtcaatgaacttccttaaatactattttcccaaagaggaaatgaaaagataaactgtaaaacttgacatgcccagtatgaaaaggctatctgatgacttgaaattaggctgcttatgttggagtttgtaacgagatattcagagaaaaatgtgaacactgaaatgattttcttttagaagaaatgcaaggaagaccataaaagacaaagttggtctctgaaaatagatagctgtgtctgctttctaagtaaatctcactgcatagtcaaggtagtacttatttttatccatgttcttttaaaaaatgtgacatgtctaccaggagcacgataaatgatgacatcgtgttaaagctaatatgtcgtggcttcacagctcagccccagtcaaatctcttgcagacttcaaagctggtgcccggagacatctttcaagatgacacagctgggttgccagggtaacccactggatgaagctctagctggctttgggaaagattacataagaccagaccaaccaggaagagtcaaggggtatcctgggggtgaacagagttgtggctgttgtctgttcagctttcaggataagggaatggtggtgacatttggaagtgggtagcattagacacctggagcacctatctcaatacaaaagtcttcatggcgagactgatgatgaaaacattgggaaaatggggattctggttgacagagaataataataatacatatcaggcaggaatgaccatttccccaagaatcaatctcaccatttagttttacgatttccaagctgtcatagatgtcccattattttgtgttagggatgtatgttaatatgtgtttatcatttgaagggatgaatgactcccttaaaggactaaaattctattaaattcataacttgcaatggaggagatataaagaacctgctgactgtgtgtgtgtgcgtgtgtgtctgattttctacatacatacatacacacatgcacatatatatattcagttcattgatgtgggtgccttagttaggatctaagtttaactgtgacagagactcacatggtgtcgacatgactgaagattaattttctcatggggaaagtccaagccggtttggtagctgtgctctgtgagtcctcaaggcctcggtctctttctgttttcgtgctccttcctagggtgttgctgtgattcatgaccttacctggctcaccacagtgtcacataagctggtaggaaggagaagacagaggagtaggggagcatgtccttcccctcagggtcaagacccagaaagagtgtacatcacttcagcctatgtccaagacctaatctcagggcaatagctagccgcagagaacactggaaaagtagccttcattttggttggccacatgttcagttaaaagtcagttactatggaagaaaagaagactagataatggggatagctagcagtctctgctcagtgggtacatttttggagggcttctttctgtcatcagcctctcttctgaaggtcaagtgcaagatgtgcagctatgtcagctttcttccttgcagatgggatttgaggccctaacaagcaggaatggactcactctgtatgcttctgcattatcaagagtggttagtgctaaaataccctgttctgctgcctgggctggacctgacagcttccccagggctttgctctgtctgaggcactgaggactgagagaaacttcatccaaatagagagaattatactgtgaccataaaggtcccaccaattgatcacttcatatgctgtaggtgatggggttcattttgaaaacaagagaaactgttatccataagttgatagcttacacaaccccccactgccatcatctctacccttttcctgcacccactccccagcctttatccccacatggagcccggcaggctgtgccactggactggttgactgtaactactacttttgtttcttgctgtgtgtcagtctggcaacagaggtctttatttaatcgcattacttgaatatcacataatgagcaggccagcaggggcatcaggcagtgccacatagggtaagggacaaacacctagcgtgagagatgctgaaacacaggggcttgggcctgcagtcacactcatagtcagatttactgatacagaatgactgtttgatctttgtacttcatccatccatgtatttgttgaacattattgagcatctactctataaaagcctcaaattaggattctggaatgaaccaacagccatgactcctgccctcaaagagctcaatcaatgagggagtccaccaagtggactggcaataataatacagtgagacaaatgtggcccaagaggctgtgaaaaatgggtggtgctggaagaggctccaggaaggcctctcagaagaaataacactcaagccatatctgaatatagtgaaccaggtggtgatgaaaagaaggaactcccagcagcaggaagcacttgcaatcttttttttttcttgctaagatttatttcttcccagtcctagtccgcaaaatcatcttgcaaggcaagatcctagatatttctcagccactctaaaaatacatccataatctaatggaaacaagcacactggcaagacattccccttcctgcccattagtcagccttttatcagaacagccctgttgaggacagagaacatgatgcggattgcgatgtgtcagtgacatgggactggaagcatccagatgacaggggcttggctctccatctccagggaaccttcctctgaactctagccaggcaagggccacagttcaaggccctgaactctgcatgctttgatccagtagtgccagggttggctccttttcccaaggaagaagaaaatctttgcttgatagatcaagcagttgtggcattttctgatcctgctggtagttttcagaaaaataaaggaaagggaaaaagaagggagctaatgtttattgagaccctactatgtgttaaatagatgctatgagagaaacagagaaggagataggatcccttggaaacagtattgaacaaaaacaagagcaataattacagcaaatgcttatgtagcattcgctgtgtacctgggtactatgctatacatgttctctgtgttatctgtttaattcatacaacagccttctgccctagataccattattatccccattttacagatgaggcaatcgaggcacaaggagaggaagtaacatgtctaaggacacacaactagtgaatgactaagctgcgcataggttctaacttcacatttcccagctctgactcttgctgtgtgacaaatgacataaaccatttgagcctcagttacttcatctgaatgatggagacagcaatgccttacacccagctctgtggtgagggtgtcagtgattatgctgaaagacaaagcttgaatagagataagatgaaggatgatcatgccacatcactaaatgtggggtagtgcactcacatatgactgctgtggggataggctccatccaggaagggggccttgaacttggtcaaagagtagactaagaggaggtttggaggattttcccaaactccccagactgggccaactccagaactctctgaagaggacagtggtggctcaaggtgcgaaaggagccagctccgtctccagcacccccacttccactgctccatgccttgctctctgctctgtaatccccaccccatgccccactgctatactcttgtcctgccctcacccaaacctgctcccccaaatgtctctcatcaatttattgatattaacatgtcagtgactgattatatttaatgtgtacatcctgctaagggatttatagtttatcaggaaaaccaaagtaatagtgatgaggttttagggcctgttcaggggactttctttatgttctcagattaatatcagaatatatgatacacacagaggtgggcaatgcaaggcaagactttgtcatttgtcagggagaggactttgacaaaccatgttcttcatgcactctgtgtgtgtgtgtgctctcactcacacacacgcacgtgcctatgcataccgtgagaatgaggagagggatagatgtgttttgaagttctggctgtccttgattttgacccccttcaggaaaataatctctttgccgcatggtcctttttggaggctgaagcctctcaaccccaagaagggaagcagaggtggccccagaggctgcctgatagccatgtgatttctgtggcttgtctcggggactggccagcaaagctgctgagcagggagcccccctccctaagtgctccacagtgtaaaggccccttccgcctccatgtacatccatcagttctccatcagaggctgaggttggggctgactgtgggacgctgggtaatggttcttatggttaggaaaatacacatagacattcagttccatcaaaccttactaaatggatgatcccagctatgacaaagagatgaacctgcagtcaatgcaaggtcatctacagaagaggccagggaaggaggaagactgtgacagaatggtccccaaccacaggagtatgcatttttgattcacctgatggggcccatccctccctcttctgattcagtgtaaaggaggtgagaccaacatctatactttgaaaaagctccaagatgactctgaaatgcatcccaggttgcctctgggctttaacatgttgctggaaggggacaggcagctctgagtaacagcaattccttcgtttcccagacggtggatgtgcccattctacagtacattcactccctcaaggaagagtttccaaagcccttgtctgagtcaggcccagggctcagtccccagttctagggatacagagatgaataagatacccaaccttgggtgaaggtgcttccagtgcagtgcagtgcagtgcagtgaggcaactttcctctcctcagctcctcctcaccccatctcctcttcattcccttaactccctaggccatcctcatccttctttgtcctcactcccaaatccaccccatcactgttcccatcttcccctctcttttttttggagctcagacttcatactgcagcatcttgccccacaattcatcaccatccaccaatagccaggaaggccaatttcagtggaacaagaagggctatggctgtgtgaaggtaccattggcaggagtgatttctcaaatcttcagcaagggattatttagcaagtgcatggaaaatactaattgagataggaaacaggaattgttgaaagcaattttttaagttacttggaaaaagtacagtgaaattcctggaaaaatatttgatgaattatacatgtacctacacccctgagaccgtcatggccaaattcaaattatggccacaggacagcaaacagaagttagccctgggctggacctcagttctagccccaccactggcccctgtgatgcatcctcataacagatgtttcccttctctgggcctgtttcctcatcacaaaagatgtaagagctaaataatctctaaggactcttgttgggacagtcagtccagtgtcttctttgtgctgagccctcttcgctcatcattacgcccagatttcttcctggagtggggagtggagccatacacaggggaatgctcagctgttccctgtgctgcacagacccactggtccagacctcaatcacccatctttccacgtttcatcctgttgtccataagcaaatgacacagttgttcatctattcatcccatagaaatgtaaatagcttcttccatttaaatggttgcatgtagggagatcaataatgagaaagcaatcagacagatcttgctccagaagagcccccaagtcaagaggagagagatagacagttcgctgtattaggcaaattgtgctcagctccctttgaaagggaagtccaggaaggttggggaaatgagctgagggctggaaacacgcatggggaggtggctggtcggaaaaggctttctggaagaaatcagatttgagtggggctctgaactgggatagaattccaggagatgggccctagtggggagggcatcacaccaggaagtccttcagtgtgggcaaggccctctgaggtatagctgagggcactgtaagactcgggggcccctcttaccactgttgcttgcatggcaacgtagacctggcagctcttaggagggggcactgaaggcacacttgcctgtcatccccagttgggggaaacattggcttaacaatgttcagcaaattacacattcataatgaatcctgttggcagaacttccaagcccttagcaccaggcagtgcatctgacagcatcattacccctcagtatgagttttgccagttgtcattttcccaagcactttggagccgactccgcctttgcttagcagtcacagggaagccagcccattgggctccacatggcacttcctttggttttcttgtcctgtccccattttcctccaaacccattccagtttgtccctgcctcactcactcagctgtggccaaccccaaggagggcatttatcccctcagggtcagatccagggcattttgtcttcttagcagggcccaccaggaagagactctctaagcaatcactctgcattatgcctttcctaaggcaattcaaatatttgcatttagcagtaggaaaccatgggcagttatggtggctgccctgtggaaaaatgcaaaaccactcatggatgaaatagagagaccagaagctttgggtcagatagagctgggttccaagtttcagtgagcctctgtttcctcatttgtaagatgagaataatctcacagaggagtttgaattaaattaaaatgcctagcatatgcctgcacttaggaagttaccaatacttctgtttccctccgcttctttccagagagagcggaagttttatgtaatacagttttgggccagtttctagactactgaataaatatcttcacctttcttaactacagctcccatgatatcctacctttcctcaaaaacctcctgtatccatgacatgtcattaaataagaaaagccaattgcaaaaccctatatattaatagaaagatgtgcagaataatctgatttttgtaaaatatacacacatagctccctgccccctctctcttcatagcgtttacttccaggaagtgggattggtgagagtgagggtgcccctcatgccttatttttttatttttttgtcacttaaagttttcacaacatgtatggagtatcattttttaaaaatattttgctgacacatggtaattgtattcatgaggtgtaatttgatgttttgagctgtatatgcatatgttgtagagtgatcaaatcagggcagctcccatcactattcatgtaaaactaaattctaaagaataacaaaagaaacctcctctaactccctttgcctctggaaaaggtaaaaattccatttccttgcactgggcctgtctcagatatttggctacaattaactgaatccagcaaacagtggtttaaatagacaggagtttatttttgtcacatacaaagaagtttggagctggacatttgtttagcattggatcatgacttctgaacatctctgagattctcttggtctctccctcgtgaatacaagatgattgctgcagttccaggcttcacattaccattcaagtctgccagagatagggaaaaggttccagctgcatcagtcctttttaatcaggaaatcaaaagatttccaaaaagtgccttctacccacccaccttcagaagactgactcatctgtctctttggcctaaactataccacttggacaggaaataataatgaaaagcaagaaacaagatcatcatgattcattttagtccaattatcatctatttcctggaaaaggcaagggaatggatcctcccctgcagggcttgggacttgaacaaaagcacagttgttacagaaaggaaaaactgggaaggtggagtagaaaggtgactaagactgtctgccaaagggcccactaactttccttcctcactgctgtggtctgtgcactagctcacatgggtggctcacagtccccagacattctgcaacattgcacctccagccttgtactcaagctgttcccttggcctgtgacattctcccttgggaggctgtggtgacaggaacaaggcactcacatactgtgaacatcatcacaagagtgaagcccagcaggttccatgtggcttcttgactctgcgtggccccacagccagctctgtggctcctgtcgggctctcatatctaattgatgagctccaatcggtgactttctttatcatgaagggttatgaaatggcatagtgtagccttgatccagtgacacttctctgcagcactgtgacgagtcctacaaagaagaggtagaatagagtgtacttctccaaacactgatggatggcacaatggtaggtggtgtgagctgatggagggaaatgaatttgcttcctaaacagccaagcttggccacccacagtgagctcagtgtcaccctggattgcagttacttgtgtgtatgtctccacttcctgtaggtcaggggctagctgagtattcttgaaaagttaactggtgaataaggttggtttgaggatttcccttggctttatgccatctggaccccagagtccctcctgcccagtggcagaatttcagagctatacagccccagaagaatggtaaaggaagaaaggccctcaaagctcaacagcagtgagtcctgatgaacaggcctcagggggtgagctggtcatccattctccctttactcatttcagaatggacactattctgagaaagatggggagtgtaacacagagaatggcctcctttgacacccactcgtcccttggggggttggccgtacagtgaaaaatctggttgtcactgagaaacagccatcaacctgaccatttttgagctcccccctgttccttagtctaaatttatgatctctccatgaacttaatctcatagctgtgagagaggctcttacaggtcattctggccaacttcctgtccatcagacagaagaggaacctggagctcagcggagggaaagaccttcagcaggagagcttgagaggtcccaggcgaggtggctcatacctgtaattgagcactttgagagcccaaggtgggcagatcccctgaggtcaggagttcaagatcagcctggccaacttggaaaaaccctgtctttactaaaaaatacaaaaattagccaggcatggtggcatgtgtctgtagtcccagctactttggaggctaaggcaggagaatcccttgaacctgggaagcagaggttgtagtgagccatgatcatgccactgcactttagccttggcaacagagcaagactctgtcttaaaaaaaaaaaagaggtcttgagactagtactctgtccactgtaccttaagcctctcatccttgttcccaaacctatttcctggcttgtagagttcattcagttaagttaaaaagaggtgaacagcagaagtgccccagccagggtgggaccctgccagggtgtggtgctgccgagagctgggtggtgaccgcatcacacagtgaggagcaacactaaggaggcagcaagtggaagtaagggatgctgtctccatggcaactgccgttcatcctcagcttgtcaggctgggcatgctggaattgaacagggctgaattgttgcccccatcatgtggcacttttccaattttgagatgccttcacctgcatacatgcacatgcacatgcacgcgcacacacacacacacacacacccccaccttacactttttcctctacctttctccagggaagaataggtgtggtttccagtggcacagttcaagcatggcagcacctttcttaccccagaaagcagcagtacccggggaaagaatatggggagggggataagggaagtgtgagaggaccagctcttgtcctggtacctgctaagcagaggaggagtttggtggtcaatgttgctgtctgtgctcaaggatgtagtcacctggtgtatcagtttcctactgctgctgtaacaagttactacaaactgatggcttaaaacaacacaaatgtattatcttacacttttgggggccagaaatctgaaacagatttcattaggcttgggtttcttttggaggttctaggagagaatccattcccttacctttctcacctcctcaaggctgttctcatttggaggcttgagacccctcctccatctttaaattctgctgcttagcatcttcaaatctctgcctgctttgcttacactgtcacgtccccttctctgactcttgtaaggactctgtgattacactgggttcatctggataatccagaaataatttccacatttgcaggtcattaacttaatcacatctgcaaagtcccttttgccatgtaaggtaacatattcacagacttcaggggttcgaatgtagacatctctgaggggagagcatcattctgcctcctctgcccaggttctgtgaatatgggccctcaataaccattattgtaagagtaataataatatttccgacagactgagcacctaacatgtgataagcactctgctagatttttacacatattaactgatttaatcctcactaaagctctacaaggatgccttaattatccacatttacacatgaagaaattagacatgaggagttcagtgaattgggccagtgggcttaggtaaggaaggcagaggagggaatggctccaggcatatgttttttccatatgtcaccagaaaattcccccagcactttggtcctactgctgcttgtaatcattctctcatgatccagtgaatcagtggtggggtcggggttgggaagagaagcttccaaagagaatctgacagtcaggggcgaaggaagagagccaatactgaataaccactgtgtgccacacggcaggggctctcccaggatgcttcacaagctcctcacaaggtccaagaggctgccatctccccagttttacagaggataccaccagtgcccaaagaggttatgcagcttatttgaagtaatacagctaataagtaacacaactgaaattggatctggtcttctctgaatccagaatcagcattcttccttcttttatctgtctttaaccaagttacccacatggtggaggcctgggtataggtagagagcgggcaatcttggtccatcttctcagcaggctaatttttcttggagattgaggggtggttttttaagttaactaactgatgggttttgcaaacacatttcagtttttaaaaggagacattttagggcacataacacatattttacatgaatattaactcaaatgcgaaacttcagactcagcagcccccgagccttctgaggtctcaggtattttctactcttaagggtgctttggtggaaagtttgggcactggacctcaacttgttcaattttcccttatttgcctttttagaaaaggcagcttctaggcaggaaagtagagaaaccaggtcacaaacagtattagaactcatggtcctgactccccatccagggctccctccttgtgctccatcatttgcctccctccttatgcatttcctcacctgaggaatgagggtaacgtattcattcactgaataaagatttattgggcatatactatgatcaggaatggtactagacaccggggattcaaataatttgtttgttacagtcttaaaaaaaaaaaaatgcaatcccccctcaaaaggcccccagcaatgttacagggccattctaagtgattacaataatgtgtggtggagtcatgcccagggtcttgagagggcataggggaagggcacttgccctagcttggagttcaatctttctatatgaactgagtgctagagcatctgtaagaaaatgccaggagatagaaagcatttgagagggaggccttcctgcaatggggaaagcatggaggtaagaaattacaggtcatatcctggaaggcacattgggaaacacagaagttcattttgctcatgcctaatgtgtccgtcaggcagagagggtaccactgtatgaacgggcgaaaccctggagacgtgagccaggcccttctcatggggatccaactccagaaagtgatgaaaaaccagtgaagggttttaagtagcatgggtaggatggcttcatggaattttctaagtggttcattctggaagcagtctggacaagggattggcaaagcgagaagggcaggctagaggcagaaataccagcaggaacctggagggtatccagatgggaggtgcaggggccccgcctcctcattctcagggaagatctgctgtgctttcagtgcgcctcccacgtggaaggcttctggatgggggactcgagctgcctccagcccaggattcctcacccacagacgaagcctctaattaaaacaaaggggccacagtagaatgcagtcatcactcttcccctgagaaagtgggtgggaaggtgagcattatgctattcatgatattatcttttgagaaaaagaattccacacccactattgtcttttatcgagtgacgctacaaattgattctaagcctcagaaataaaagagggtataatatagtacaaaaaaaaattgcaaagatcatacaaccttcatctgctagtgtaaaacagtacagactaaccccgataaattcagaaaaaaagtagaatgaaacctctcaatttaaactcactggggagggctaatttgaattttacattgtttcaaaggaatgctacttcttcctctcacatccaagcataataaaaccttaagagaatatttgtgtaatcaaatgctgatgagtagaataaagaaagttaataggaaaactataatagacttatggttacataatggtgagtcatgagcagtatggtcatttttatatacaagaatgaacttgatgaaggaaagctactttaaaaacaatacctagcatatcacttaacagggaatctcaccaggcagccctataaaaatcagcagtttctttctctaaaaatcaacagtttcttccttccttcctttctctctctctttctttctttccttctttttctttctttcttttctttctttcttcctctttctttttttctctctctctttttctttctttctccttttcttttctcttttcttttctttctgagacacagtctcactctgtcacccagactagagtgcaatgacacaatctcatctcactgcaacctctacctcccgggttcaagcaattctcccacctcagcctcccgagtagctgggtctacaggcgcacaacaccacacccagataatttttgtatttattggtataaacagtgtttcaccatgttggccaggctggtctcgaactcctgacctcaagttatctgcccgcctcagcttcctaaagtgctgggattataggcatgagccaccgtgcctctactcttttgttttattttttaatagagaggagatgtcattttgtcacccaggctggagtgcaatggcacaatcatagctcagtacagcctcgaacccctgggctcaagcaaccctcttgtctctgccttctgggtagctgggattataggcacttgccaccacacttggctaatttttttgttgttgtttcaaatatttgtagagacagggtcttgctatgttgaccaagctggtatggtactctgatcctccagcctcagcctcccaaagcaatgagattataggaatgagccaccgcacccagccaaaactaacagttccaggggagcgtcctgatttttagactggattcttctgggctgctgggaagatcctggtgagtcataatgagagaggctgggctgatagtgaagtttgcctcatgtcctcattctcctcaatttttctgagtccctctccttgccttccttttccactcatctatcacagacatcaaatccagaggtattccaaagcaggcagccttctactagctcatcctacaaattttacctctgaacatgaacataaaaatcttcagactctatctcaaaaaaaaaaaaaaaatcaggctgggcatggtgcctcacgcgtgtaatcccagcactttgggagcccttgaggtcaggagctcgagaccagcctggccaacatggtgaaaccctgtctgtactaaaaatacaaaaattagccaggcatggtggcgggtgcctgtaatcccagctacttgggaggctgaggcaggagaatcacttaaacccaggaggcagaggtcgcagtgagccaagatcgcgccactacactccagcctgggcaacaaagccaggctacatctcaaaaaaaaaaaagaaagaaagaaaagaaagaaagaaaagaaagaaagaaagaaagaaagaaagaaagaaagaaagaaagaaagaaagaaagaaagaaagaaagaaaagaaagaaagatcttcaatgaatcctagtaatgttgcagcactttctccttagctcagctaaaaccaggctcttgtcatatgaccaggaaagattaggctcatggacacatagaagtgtgaggaaaatggaattcactgggtgaaaaggaaaaagacataaaaactcagcaaagcaacagggggccttgccaacaacttcctgcctcacagatcaaatcccaggtccccacacaggaacaggagaggccaggctcctccctgctgcaaacggcgtgaacttccagctggtcctcccagtgcacaggagggctccaatccactgtggccatgtccaaaccaccctgggcaggttccctcatctacacaaaagcatctggtataaacacttgtggggtgggttagagattctccagggatccttttttatctgtctcagtaatccatagctagtgcatattaaagcaatcatccaccacaatgagataagcttgttagttggccaggagtttaaggacagtttaacattacaaatgctataaatacttcataattatatcaatatcttaaaaaaaattgaatagatgtaattaaatatgaatttaaaatcattctaaagtccacttcgaagagtaaagagctgagagagaccagctgacttgtaagtaagtgggatacttgttctgtcataaatgaaaacatgctttacaacttcagtaattaaaacagtacggtattgatgccacaacagaaaaatggcaagaacagttaaatcagagcaaccccggctgggcacggtggctcacgtctgtaatcccagcactttgggagaccaatgtgggcagatcacaaggtcaggagatcgagaccatcctggctaacacggcgaaaccccgtctctactaaaaatacaaaaaaattagcagggagtggtggcaggtgcctgtagtcccagctactcgggaggctgaggcaggagaatggcgtgaacctgggaggcggagcttgcagtgagccaagatcatgccactgcactccagcctgggcgacagagtgagactccatctcaaaaaaaaaaaaaaaaaaaaaaatcagagcaacccctagcatatataagaatggaaaatatgctcaaatgctatcatagactaaaggctgctgggatatccagttgaatttttgtggagagtggaacataaattcagatcctctccttccaccagacaccaaataaattccagataaattaaagaattaatagcttacattaaataataaggaaacagaagtgactgttaattgattccctggtgaggatggcttctaagagtaaacgtgatgggaaatatctgttagattcatagtgtcgctagctacaacttaaggtagtgtaggtccaaacgtgccacaggccaaattcaagtccaagaaccaactggaattctgtgatagaaacacattatggtgaattatcatgaggactaaaggagcagatcaggaactctaatttctgcaaggaaacttcaaggaagacacagagcacagtctcctacacttgtttctgtgttaaaagccagggttgattttggctgatcaatttcagcagtgcttttagggaacaatgcctgtgtggacagctggggccagtgtgtgattatctccaggtctgaggctcactcgctgggaaaccatggattcgtcacctcatctctctgtgccttttgtctcatgcataaaatgtgaaaaggaacaaatgtaataggcagaaaaatgtgtccccccttcaccccaaggtatacatgtcctaacccctagaatttgtgaaaatattatgttacatggcaaaggtcatttatggtagtagatagaactaaggttactaatcagctaacctgaatatagggagagcattctgtattatccaggtgggctcaatgtaatcacaagcgtccttaaagtgaaagagggaggcagaagggaaggttggagtgactcaatgtgaggattccgtctgccaccactgcttttgaagaaggaggaaggggccacaagtgaaggaatgcaggcagcctcttagagccagagaaggagagggggtggaatccactcccctgaagcctccagaagggagtgtagctctgccaacactttgatggtaacccagagaagacccatgtcagacttccaactcccagaactataagataatgaatgtattgctttaaaccaaaatggtcgaggtaatgtgttacagcagcaacaggtaatattcaaataattaagataattaaatgagaaaacgcctgtgtgaaatgtctactatggggctcgatatggtttggctctgtgtccccacccaaatcacatcttgaattatactcccataattcccacgtgttttgggggacctggtgggagataactgaatcatgggggcagtctcccccatactattcttgtggtggtgaataagtctcacgagctctgatggttttatcaggggtttccgcttttgcatcttcctcattctctctttgcctgctgccatccatgtaagacaggacttgttcctccttgccttccaccataattgtgaggcttccccagccacgtggaactctaactccaattaaacctcttttgtaaattgcccagtctcgagtatgtctttatcagcagtgtgaaaacagactaatacagggctcagttcaaagtaccctggttaccatgccagtagcagctggcgtgggcttgatattggaaaccaggtttcctgaaatctctactcctgaacatacaaatgtgaaattattttttccttataattccatatagcaattgtgctatgatgaactattatctcctttgtaatagttgctttgacagcatcttggcaagattccctaaattagcgacactctctgttattggttatcagaacagactcatttcaggtatttaagacagtcttactcattttaaaaaattccacctccagctcagttcagtgctctccttccctccccagcacaggctgccttgtctgtggctgcagttaggaggcaggggctgggggcgggacaatgtgtcaaggatcagcacttggcacccaccccttcctctactactaagcagctcctccactccttcatgtattgaggcagggaagatatagagaaaagggaatttcagtaagttccttacggaactaggccaggttacagcatctccttagctgattttttttttttttttttttttgagatctcagcgcactacaacctccgccttcccggttcaagtgattctcctgcctcagcctcctaagcaagtcgttgggattaggattacaggcaggcatgcaccaccatgcctggctaatttttttgtatttttagtagagatggggtttcgccttgttggccaggctggtctcgaactcctgatctcaagtgatccgcccgcctcagcttcgcaaaagactgggattacaggcatgagccaccaggcccagccccttggctgatcttctaatctcctcactatctctgggctccttgagggctagccatgaccccaatatgccccacctgcaaaaactggtgcccttgcagcactatcatgtctctgcagcacccctaagtattggcagactgttgggagttctggccgtagctagcgaatcacaggccacgttcccctgaggactcgtgtagtaccccttggggcctgagccaactacaggccagtgagcacatgtggaagtcttaggaactgggaactggaaaaggtgacaggagtagggagcatctggcctcagtgcccagagcctcggtgcacaggggccactaagcgaagtcctaagcgacagccagtcagggagcaaaatgcccatttcctgccattctcatagatgaactcttttggaaccaccaggggaagcactccccaacccttcccacccaccctgcccctgtgtctgcagaggagcaaagagaacattgtctctaagctggcctgggagatgatggttggatgcaagagtgattcttaaaggtacacctttattagaccctatcaacttatggctgaccccaactgccagcagctctctgaagttagaatgaagtgcttactaccttttattttcagtttggagcattgtccacaattctaggacaaaggaaaaatctgtcactgggtagaagcctcactaagatactcagaagaggctctgggaatattcaatgatgaagaactgcgcctctcagatgccagccccactccagcctggcctgaccatggccatagcctgctgggtgcagcttgtctgctgcacagactctgggtggggttgccccaagaaggctttttaacagcaatcaaagcaataaaggactattttgtctaaaatctgttcctggactatcccagcagtttcaccctcatttcaacaccacatccaaacagcttcaggacctaaatgcaaatccacgccaaggagacaccacatacccccatctcaccacatcacagcccgtggctgcctcagggccctggaggaggtaagataagcaaccctcaaacaatcctagttcatttgcatgcatagcaatctgtcattgcttctagggcttactcatttattcatcctttcaatgaagcacctatcttgtgccccctctgtgttttcaggtacacaaagatagataaaagatgaccttttcaccttggtagtttgcccaatctgtaaccgcccaaggggttcaccttgcccactgcctagacagaggcgatttatcaagacacgggaattgcaatagcaaaagtgtaatacacacagaggtgtctatgcaggagatgagttttattattactcaaatcagtctctctgaaaacctggggatcagagtttttaaggataatttggtgggtaggggtccagtgaatcgggaatgttgattggttagctcagggatgaagtcacagggagttgaagccgttgtcttgtgctgagtcagttcctgtgttggggccacagaactggttggcaggtccaggtggggccatctgttgttagaaatgcaaaaatctgaaaagacatctcaaaaagcagatcttaggttcacaatagtgatgttaccttcaagagtgattgaggaagttgcaaattttatgacctccaaaataatgattggtaatatttcaaattccagcccctctcatcttgatttggtggctggtgacctttcatttgctttacaagaatagctttttgggaagggctattatataactatacactaaattcctttccaaagctagttcggcctatgcccaggaatgaacaaggacagtatagaggttagaagcaagatggggtcagttaggtctgatatctttcactgttataattttctcagttacgatttttgcaaaggcagcttcacatctagcaaggtagacacagacacatggccagaaaaaataacacaatagtgtaagtatcttaatagaagtacaaataaaaggttaagaagctcaaatccaggctggagattgtagccagcaggagcaaaggcataatagagtgtgagttattgaggacagcagtccatcttggctctttctggattcacctgggtctggcacatattggatatctaacagttgttaaattgacctagcattggaggcagaggagtgtgaagaatttgaataaaaacaaataattttttctgtctgatatatagtgtagggaggagggagtgcatgataaaagctcaggacctaattttgaaggtccttgaatgcccagctgaggagtctacactgtttccactaggtaccgaggggcaggaaacagagaagagtgacattgtggtttttttaaggccttattaggccactggattgtggtttaagtccagagttgtgggtgagttattttgtaccagggagaaagatttgtgaggactgcagtaatctgagcattcagatgtggtttccaagttgttagaatacctccctctaaatggtgttagagaaattcaaagtcccacagcaccttaggcaggctgcccacatctgagatataagggaggtcttactctgtacatgtaagtccttgagtttaaaagggccacagggaggctgggtcctggcctgagctcagccacctgcctgttctgtagcccctgctgggatcttcagggaggcagggctccaaggaggctctgctctctgcatttagttgctgaagagcacagctcttctctgaggtgatctcattctctcctctgccccacctgctttgattcctgcctcccacatagttaccaagccttaggtctctctgtgcttcaaaactcctcactctagtggcacaaagagaatgcctgccttcaacacagggctcagagccaaggcaaagcttcagaagcccagccacagctaaatcgcctgtctctgcatcttccttgggtgtctgtcccacctggcccttctgggcacccagcctggggctctggagctgtctccacccacacccagactgagttttcagggctgttataaggtcccttaaggctcagggttgtttagttgaagggctcaaaggcagacacatctgagatccaatcccagagcattagctccaagaccttgaggcaggtgaccaaaccatatgccccttccgtgttacgtagggcaacactagccacttcacagggttggtgagaaaatgcaatgagaagcttctatgaagcaactatcctaggaggtgcccccatatcagcagtccttcacttaactcatgaaaggtctttcctgccacccctactgagatctaagctatagcaatttctccagagaaagacagttttgttcctggggcaggattgttctaaatcccctctctgtgtaagcccttctgagttcagtggacttgacttacttggcaatggtttccaactgccactggtgatgcagaatttttctcagccactttgccaaccagggaactccatggccagcaataccccctgccatgcctgggccttgcttggccccaggcctgctggaggcacctcgtccactcggcctgctgtgttatagattgtacctgcattcaacaattcctgagctcttgtccctcatccaagaagaataaggttacactgacaattagaagggtaaggatgggcagagaagaattttattgagcaatgaaacagctctcagctgagaggggacacggtgggggtggtcccccacccccacagtcaggtgatttctctctcagtgtggctgggtcccaggctttttatggactcggaatggcgagtgcatgcagattggtttgtgagtatgcaaaaacaggttaaagtgaagacaacacccaaaggtgggcacgatagtgtagaaaaacaattaggaaaggataggtaaatgtaaaataggtgaagggtggggcttaatcacaagaaagcaagccaaacgagaaaatagcttctcaatctcgtccgtgtattttacttgtagcttggatttcgggctttcaactgtctttgccttgtcttctagtaattaagtatgtaccttggaggtagggtttcaccatggacccacctcatctgcctaggcatttggctgcctcctgccactgtcactggaattttagcccagagtgccctcttgagtcattccctcaggctcaatgcccttactccaaagctgcagggcttgcagctctgtgagaaagggaggtggcagttcacactgcagaagcctcatcagttgagagacataaataagcaagtggatgttccttgttcttgaataggaagactcagtgctgcaaagatgccagctctccctaatgaatgtagcagctcaaagctatctcaatcaaaatctcatcacagtttgctttgtttcattgttttgccacttgatctaattattttaaagttcctctggaagagtatattttcaataataaaagaagaagagagaagatgataacttccacatattaaaatattttataagcttgcaataattaagatactatgccgttaacagaggaataaattgacaaccaaataaagaaataataactagttcaaacatatcaaacatacacccgcatatatggggcaaaacggcattttatttttttttaatttatttttttcaagacagagccttgctctgttgcccaggctggagtgcagtggcacgatcttggctcactgcaacctccgcctcctgggttcaagcaattctcctgcctcagcctcctgagtagctgggattataggcacacaacaccacgcctggctaatttttgtattcttagtagaaacggagtttcaccatgttggccaggctgatctcgaactcttgacctcgtgatctgcccgacttggcctcccaaagtgctgggattacaggcgtgagccactgtgcgcagcccaaaatggcattttaaatcagaaaggaaaaaatggacttttcattaaatcttataacaattgtctagccattatattcacaaattaaatgtgaatattcaaaggtaaatgagagagagaggaaagtattagaagaaaacatagggaaatattctgaatctcggtgtggggatggactttcaaaatgacaccaaaaccaaacaccatttaggaaaattctgatgccttgatcatataaaaatctaaacttttgcacaggaaaaaaaaagcaacttgtatatgatttttccaaaggatataaaaaagatagtgaacctcactagaaatcagagaaatgcaaaaatggttggataatattgtatcattgttctggtatcagaggcaatgtaaagggtgcatcacacattagcactctggttaactattggatggtggtttgacaatatgggtcacaagtaagatttgtgtattccttcacccatagtccatgtttaggagataaccagatcaattttataaataaaacactttaaggtattaataacagtgaagacgttttaaaccattgtcagagtctctagatttgattaaataaattatagaacattcatataatggaatattaatcagccactaaaaagggggtcatatatttaaagccagtgacctaaaaggttttcatgacgtagcaccaaatgaataaatctagagttataaatatacatgcgtgtatgtgtaaacatgcagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctcccgcgtagctgggactacaggcccatgccaccatgcctggctaatttttgtatttttagtagagacggtttttcaccatgttggccaggctggtctcgaactcctcaccttaactgttccacccacagggattacaggcgtgagccaccacacctggccaggtaaggttttttgtatgattcactgctgtatccccagtgtgagaaactttgtcagtgttcaataaatacacattgaatcaatgaactcctagaacaatggtcattgtttttttttgtttttgtttttgattttgtttgtttgtttgctttgagatggagtcttgctgtcgcccaggctggagtgcagtggcgcaatctcagctcagtgcaacctctgcctcccgggttcaagcgattctcctgactcagcctcccaagtagctgggattacaggcatgcatcaccacacccagctaatttttgtatttttagtagagatggagtttcaccatgttggttaggctggtttcgaacttctgacctcgtgatctgcccaccttggcctccaaaagtgctgggattacaggcatgagccactgtgcctggccaaacaatgatcactcttaataataactctgagtggtaggttttcggctaattattcctttatttgtgttttaaattttttcttcgtaaatgtgtactatctatagagtaagaaaaaagcattgctattttcattaaagtgccttaaaaaatagacacagcatatctccttcagttatacattgaataaatcaccctttggagaagaactatgaaatgcagaaataagcattaaaaatacttcttggatgatttggtattaaaagtaagaaaagcaccgggtgcagtgactcatgcctataattctagccctttgggaagccaaggcaggcagatcacttgaagctgggagttcaagaccactctgaccaatatggtgaaaccctgtttcttagtctgttctcatgatgttaataaagacatacctgaggctgggtaatttacaaatgaaagaggtttaattgactcacagtgccacatggctaaggaggtctcacaatcgtggctgaaggcgaatgaggagcaaagtcatgtcttacatggcatcaggtgagagagcttgtacaggggaactcccctttataaaaccatcagatctcgtgaggcttattcactatcatgagaacagtgtgggaatgaccctcccactgggtccctcccaggacacataggaattatgggagctacaattcaagatgagatctgggtggagacacagccaaaccatatcaccccatctttactaaaaatacaaaaaaaaaaaaaaaaaaaaaaagctgggcatggtggtgagtgcctgtaatcctagctactctggaggctgaggcacaagaattgcttgaacctgagaggcagaggttgcagggagccgagattacaccactgcactccagcctgggtgacagagtgagactctgtctcagaaagaaaaaaaaaaaattaaaagtaagagccgaatgtgatggatctagcagaggccaccttcacctatcgagttagtcaggaaatacttattgaatatccattgtgttccaggcactaagaatacagacatgagtcaggagtgacccttccctggaggatgtcagagcagagttgggggcaggcataaaacagctcgtgacaagacaaggcccaagtgaccctgtgcatcgatacagggtattgtcattgctcagaggggaagcccttaactcagcttaggcaggggagagagttggaatatggggtggaaaggaaagagcaggctgagaagacaaggggctcagagaagtgccccttgagctgagtgataaaggactaacaggagctagcaagaagtgaaggggcaagagaaaagcatgggcaaagcatgcaaaagcactctggaaagatttcccatggatcggcaccagcttggagtgtctgaggaggtgagggtggtggagaaatgaagctggagaggtttgcaggacccaagtcgaaaagggccttgtgggactggactaagcagagtggctttcatcctggagtgtgggggagaaggtggaggagggcatcaaagagcgtgcagtagagaggttaaggcctagacttgcagatgcgctcactcattgtaacagcagtgtgcaggcgagaatcagggctggcaggtgcccagggccctgtgctcagaaggaccccacacttggcttactgctctgctgctgccatcttgattcttaataatttttaaagaggaagccctacattttccttttgcactgagccctgcaaattatgtaagaggtcctggcaagacttgaggcaaagtttgttatgcagttgaccaggagagaaggcaataggaacttctgtccctttccatctcagcctttgcatttagcggtcttctcaacacgtgtccagggaagaagcaagaaataaaaaggcaatgtgtgacatttcccaaggtgcagacaatgccctgcgatgtgtttgttgtacaaatgaggctgaggcaaagcttagctgtgccccttcccgtcccctgacaccctcatctctcctctgagatcagcaaagtaagaatgagcctctcaggtcgtagtagggtgaggaggaaaacaggtatttttgtatgttcgttttttgttttgctgagatcacaactgccaaagaagagaaaatggttagctcattcccatagtcacacagttccatcccacccacttcgtgctctggtgctgcttccactttctcctggaacccctcaaaccccagccagagcctccttgtcccatgggtcccgctgcagggagttactgctcctgcttggttctgactcacggtcaggctctaactggcagctcgacccctagctcgtttgaacacacatacacacgtacacacacatacatgtgcacatacatacatacacacttggctcagggcacatgagggtttgtttttgtcaccatgaggttttccttccacacatctcagggtgcaccagctgcttagcaacaagctgttgggcagaagtgggaattaaatatctccctggttgctgcaaacacaggtgccaaaaaggaggaggagaagggtccgccagagggactgggctgaaggacaggggtgtgtgtctcctagacgaatgctcggagatggaacactcagggctctggtcctgtgccaggaatctcagaggcctgctgggaatggtgctccagaaaatagaatcctgacagcaagctgtgggcggtggggaatctgcagggatggctgatgacaggtggaaggcaaaatgtaagaattcctaaatctctgctgaggggacttgccttagcaagatctgggttcaggtcatcatcgtggccaccctaaaatcttccatcctggcttgtggttcttgcttttggagtttaagctcaaaagctccttctcctaggagttctacctctcatgtagcgtcgaggcaaagaatattagcaccaggattctgcagttggattttctaggttcacaatttagctcctgccgttgactttgtgatcttgagaaagttattttgaaggtctgtgccacagttttctcatctatgagccccacctcagaggactgttgtgagaattacattaaaacaggtaaaaggactttttgtaatgtcatctccaaaacagacatccacaatgctgaggacagaaggaagcaaagtaagctacctttttaaaagtgtctcccatgtgcctgacactgtacaaaatgccatttactcatgggatttatcttttcacacccatggaaactgaggcttacaagcaaagtgccctactcaaggccatgcttcagcaatgggccagagtttgacatggtcactgtggctctgtagccctcactcattcctcaagccaaactgcctccactattgcttttcagagaaaggggaaaaattactaatttatctggcatggggtgggggcgggtgtcaggatttggtggaaagagctcttccccagagtaacattttagaattatgatatgaagccagtataattaccatagcactccctggcatatggtacctgagatggggaaatagtaagccagggtcttgggaaaatgaaagatgtcatcaaggtacaaaggcaatagacacctagatttggagtgaaaacatggattccaccaagctccaagcaagcagaaggcctcatctctctggccacactcactggcctagaagactggggagtccaagggcaggaaaaggctgcagcctgtgctcagaggcttatggttttccaggataacacacaaacccctgcttccttgaccagtggatgctcacaccatgacatgcacatattcccgaagatcttttatggcaacagctcatacacgccctttcacactgtctgcactgctgagagctgcagggttcagtatggtagccacgggctgcatgtggttttgagcacttagaatatggctagcaggaattgagatgtgctgtgagtaatgacacatgtacctgcttcaaagacttagtccaaaaagtcaaatatctcactgataactttaatagtgattacatgttgaatgaatgatgtaatttcgatgtgttttgaatataatgggttcaatggaatctattattaaaaactattttttttttacctttgtaatatggctattagaaaaattccaattccttatgtgattggcatttgtggctcatgatatctttttattggacagggctgctctcaaaggtactcacagtaggctttgtgtttggagagtgctttagcagtcacaaaacattggcctctctttatgacagaatcacagaaagccagacctggaacaagtacccttaagctgttttgttcaatctcctgatttacaggcagagaaactgaggcattgagaggagaaatgattccagtgttccaggtgccatccataggctgtcgcccacccggatctagtccttgctgcctccaccctctagagctggctgtccggttccttccggcccctcttgcccagctcttcccctcccttccccttcccacagggaaggctgggagaactctcccagtggaggcatctttattcatgaacctggcccaggggagcccggagagcctgtctgaaggctgctctgtgctttccctgcagactcagagagataaatatggaaatgtgcgagaagagcttccccatcaagactaagggctgctatgacatctaatacatacaccaggaggggtggaggaggcagctccagggctgcagccggcagagtctcctcagccccagctgggcccttgctcccccttaggcaggcttggctgacccctggacatctgcccaggctgggctttgtttctgtttcccacagcacctcctgtacgctgcccccacaacaccacaaaactgcacaggtgctggcccatctccagctaccatccagcccccaaccccaccccaggatgcctcccctgacttctccaacctgcctgggcttcctccttcaaatcccaagtgcctggaggctacactcttgctttctgaggacccattagcagcttctgcatcagagagtgtgcgctatgcaaaccccagcctcaacccaaacctgctgaagcagaatttgcattttcatgagatccccaggagatctgctctggcccacaccagtgagagcagggcactgtgtctggtttatactgtgcccactgcagtgccttgcacagcactgggctcctggtaaatattccaaccacagacagaatgacctttgctgagtccttgaggttgacgcagcactttcccggacgtggtctcacataactcccccacggccctggataatgctgagcggtcaagtcaagactctctaagcaacttggactatgggggttttggaagaggtgctggccccacgtgctcagtttctttgctgcctctgtctcactagaatgcatgcagatgtgatactagtagtagaattgagatgttgccctcttgggggtctgtgttcctgtattaggtagatgagaggtatgtagagtctatacagccccaaggccaaattgcctgagttcaaattctgccactaactaagtatgtgaccctgggcaggttacataatatccatatgcctctgtgtactcatccatgtaatagggacagcagtggaacctacttcataggattgttggcggattacacaattcaatatgggtaatgtgcttacatagtgcctgacacatagtaagtgttacaaagtttaattaaaccagtgtcttttttcaagtgtaatgttgaagactttgcagatttagaaccacaggagttggtagaactcctagggctcagagggagccaactccctcgttgcacacaagaggaaacaggcccagatggttgaatccctctcccagcatctcacagccagtaagtggcatgattggaacctggactcatgcacactgagcctgctcctccttcccacgccctacaggacacgattagaaagtagagcgagttccagacctggcgctggagtccaagctgcccacacaggtgtgagcgcctgctcttcattctcagtaggatgggaggaacctactagcaaactctccagagatttcccctctgccctgagatctagtctctaagttggtccttcttgaccgctgaggcaagaatcaggtcacattagctgcagttactccttagggaaaggaataatcaaggagttggggtttgggaggagagagcagcataggagggccccttcccaggggagtattttgccagctccccgttatccctcaaatgctctgcagtgaggataaggaagtgagaggtctctgatgccctggtgtggccatccttttgtgtgggttttatgttcttgctctttgtgcccatgagttctgactcttgttgcatcttgtggcaattccaaataagccctcccagattcccgcagggatctagtctttctattcttttgctaaggggctggtggggtgaagggatctattgccccagttgcccttcaggggagagggaggcctttaactcctcataacatctcatgttgcaaaatgcattgcttcgatggaaatattggttttgagcaaatttggactccagatgaccaaggttctgtttgggtttgacggtaataaaaggaagatacaggtataccaggatgcatcctacacatcctgcaaggtgaaatccaccttcctctcactggttgtctcagccgccttggctgggtttgcactgctcattaacattgggtgtgcctctctctgcctccctaaccacatgcagatcctggcctcagtgtctgcctttctgcatctctctgagcaccttgcctagtatctgccacatatggtgcacatagtggatgatgattgactgatcactcaatatattgttttctataaaagaatgaaagaagatcatttcctcttctggtcatttcctttaaagaatatatgtactctttaaatgttccttagttttcgtattattggctcatacacagaacacagccttgctgaaactaaaataataacaacaataataatagcatctttcatcggctgaatacctattatgagcccaacactgtgtgcacatcatgtgtgtgctttacacacatcatcctaatcctcacagctttgctaccagggtcatccaaagaagggaagcccaatgcccctaggcacactactgttcaatagtggaagaactggaacccaataccgggcattctgactctgttccaatgtcctccccattaaatcccaaaggtcccagcccagcagccaattctcctctatcctgtcccattttttgtatgaagaaactaaggctgggtgtgttggcttgcacctgtaatcccagcacttttgggaggccaaggcgggaagatcacttgaggtcaggagtttgagaccagcctggtaaacacggtgaaacccggtctctactaaaaatacaaaaattagctgggcgcagtggcacatgcctgtaatcccagctactcaggaggctgagggaggagaatcgcttgaacctgggaggcagaggaagttacagtgagccaagatcgtgccattgcactctggcctgggcaacagagcgagactctgtttcaaaaaaaaaaaaaaaaagaaagaaaagaaaagaaactaaagctttgaaaagattaaaaatcctttgcccgagaccaggtcccacatgtagtgaactgcagaactgatattcaatcccagacccatccaaccccaaagctcacactctccaccacagcatagcatccttacttctctacatgatgcatttcctttgtttgtttcttagtctgcaaccagatcttatcctataactgtggtggcagagatgggatcatgtggggctcatataatttggggagaagttaaagatattgcagtaacgcaggacaggaatacatttaggagaacatgttagagttggtaggaagcttcctctcctccagaaaacagaagccccaccttcttaggcaatgatcctgaacttgttcatttctgacaaatgtgttccacttctttttttttcttttatttttattgacacataacaattgtacgtatttgtgggatacagatgatattttgatacctgtaaataatgtgtaatgatcaaatcagggtaattagcatattcatttcctcatttatccctgtgttgggaacattcaaaatcctctcttttagctatttgaaatatacaataaattatggttaacaatactcaccctccagtgccatagaacactagaacttattcctcctatctagctgtaattttgtatcaaatgtgttcaacttctgcagatagaacatgcctggctctggctgccattgctgtcaccagctgtgctataatagctctctccccacgattccagacctggtggccaatggcattccagtagggttctaattgagatgcagccaggctcagtgttctcatcattgtcaccatgacgctgtgaaatgagttgggtgcagggtgaaatgagaatcgatcttggatagaccactttattctggaggaggtagggagatcaaataagttttagaaccagttgtgaaatctgctgttctacccacttcagttggagcgagtgaagacagtacgaagggagtggtctcattctagctttccccacagcaaccaagctactaccaagcaccttcaaagatcctcaccacttgcctagtttcaaattcagtgccatttaaaattaataaaaacaatctttccggtctagcagactggctctaaatggaaactcaccacaatttccaaagtgtaatttgttattgacatcctagtttcataacaaagagtaataggttggtggttcaatatttaccaggaagagaagtactagaataatcccctacccaaaatcaaaatgccattgacccgatttatagtgcaaatggtgtattagacagaaataaaaagagacttcatttgattttaaagtctgagtaatcagtaagtacccttcagggtctgtgacatttccaatggagatagaaatagggatagagagaccagagatagatacttaaacttacttataggtacagagatggaaatagagaaacagatatgatctagatgtagttgtatagacatagacttatgcatagacatagggatagagatagaaatatgagaaagggagaaagagaagagagagattcacccttcgaagtttgatcctgtaattaggacattagatacaaagggaatggtaggtgctttggtcaatgacaaatccaaagtcatgaaagtaacatcccttcttttttaaaaattttacttccagaatcagaaaaactaaataaaatattatagctaaatgaaatgttgaagcttatctgatttatccgtcattttatatccagggaaacgaaagtcccaagagacaagatgacgtgaccttagtcacacccagatactctgtcactcaaccagcatcttttcctctgcagtaaattgcttcctttacccatccgaatatagtagcacttataaagcacctacagcataccagagccttattcgagagcagtaaggatacaatgaagaacaaaatataatttcatccttaacatagagatgattctggcttttccggatggtgagcattcacttttttttttttttttttttttttttttttttttttttttttttgagacagagtctagctctgttgcccaggctggagtgcagtggcgctatcttggctcactgcaagctccgcctcccagcttcacaccatcctcctgcctcagcctccagagtagctgggactacaggtacccgccaccatgcccagctaattttttgtatatttagtagagacagggtttcaccgtgttagccaggatggtctcgatctcttgaccttgtgatctgcccgcctcagcctcccaaagtgctgggattacaggcatgagccactgcgcccagccggtgagcattctaatgtgaaggagatctggaaggtaaggaggttggatttctactgcctcattctcattttttataaaaaagcagaacttctctgggagttcatgacctttctggggcagtctgtgtaaacagagagatctggcctaagacataagtgaaaattgcttatcttgtcccgggaggcgaaagccccttctctagaaatttagttcaagagtaattttattctcaaatagatgtaattatacgagaatcacaggctaataatggctaccttttgtaataaagactgtaatgttgaagaagcagtgatgatagaaaatggaagttgtcacccagaggacaagggatggggcagctctgagaagcaaccttaggatctgtgagaaccctttgagggtgggggtgggcgagggtgtccttaacctccttctggagagcctacatgtggaaggagctcatgtgtcaggctgcacctacctttggcttatcacatctgcttgagggcagagaccagaccttctatcttcttatgcgtggttgcctctcctcactctccctcctgccctcacaaagctcagcatggagcccagcaccagttgggcttctgtgagtatctgttgaatgaaaactttggcagaaaacagtttttggactcaccatttctaattaagggaaaatgtctctcgtcttcccatccatgtgactaaagtgcaagtgctgctctgggctgattcatctcctcatgagtcatctgcttaagtagtaatgcgaatgggcttgcaggccaagtggtgagccttctgcagcacagccggcttcaggcagcttccagagcacatttcaacccttctactggtcagtgggtagatttgccctgtctctcaaggcctcgaaacgatctgtttgctgagtcacttgttcatttagcagacatttactgagcacctactgtgtgcctggccctgtaccaggcaccagagattacagcaatggcaaaaccaggtcattctcggccccgtttagcttacagtctactagggaaaaagggcacgaatccacaatcctgtgaacatttcttcacaattgtaacaaatgttccctacagtgacatgcatgtgtgtaacaggggtctgacccagaccaaatcaaggtttaaagaaggaacaggggttcactgggccaaggtcagcaaaggaactttcagaccacagcagcagcacggcaatggtcccatgactgtggcaggggagggagagccagcaaggccccagggagtgaaagcggccccgggacaagggagccgggggaccagaagctggacacagaggtggggaccagacacagaaaggtctctgaggcctggaaacagtctcgttccttcttctgagaacaattagatgctattgtcgggtgtgggaaggaaacttgaccaaacatgggtgtgcaaatttcccctggagctgtggtgacgatggatggaagggcctcagtgtagggaaagttaggaagcaatgaatgtaccactacaatggggtcctattcctgggggaggcctcatggatgtgaagagctgaaagccaaaaccaaatatcaaatgacctctcaaaggcatatggtcagcatctaagggcacatgagaccccaacactaaccttctgcccatcggcaggaggtctgctggaaaggcccgaccaccccacgtgaaggcctcagcccccaggacaaggagttagaggtgagctcatctgaacagctcctgtccttggtggttcccacagaaggtagacaagcccagtaggcctaaagcaaagagcagcctgacagtgcacgaggggccccttagggagcctctgagatacagtgtagccaaggaaggtcaagaccccggaagagacaggccgagggtctgtctgcagggctggtgtgggaggagaaggagactgcagttggtgctgggaagagccaaggctttgactcagatggcactgagtttgatcctcctgcaccccttagtgatgtgacctcatgccagttacttaccccagaaaaatgaccctcctgcaagtcctacccttgctgaaagaatcagctggggtggcctgtgagaaggacctgcttagagccttgttccacgagacacactcatgaaacaataactactgtctcagtagcagggcctgaagaggtaggtacaagaccaggtcatccagaacaggctagaagccactagctaattccagcagggtaaggggagataaccttggaggttgagcaactgtatttcagggtgattgtatttgtatattcataggccaggcaaaataggcctttgaaatttgagaacaaaagaaacaaaactgacccaagtgagggtgttttaaaagcaactatgtcttctgcgggattggatggcagacctctccaagactgtgagcagcggagcagtccaagaatactcttctggttttttgaagccctatttcctatcaagagctctatttccagcagactaatgggcagaaatctattctgaggtctgagggctgcccagtgttagccaggagctgggccttgggcagagccctggagagaggcatcctccgaagtagccttgctgccacccctcctgacacagcacatcagctgttgcatgggcaggggtgagtcctggccaaggccttgcttgtgcccaccccacccccacccaaaggttgggctggagaacttcttggggagctgcctcctccatcacattgaggcagtgaaccagggatctttggaggggagagattcatgtgggaaatgctgcaatattttctctggaaggataagctatccaggcagcaatggtgctggggagggctgggataggggtgcagaggaaatgtgtcactggagagaggcacagtgtttgtagatcatcactcagcctttctgtgcccacgctgggtggggccctggaggcccagaggctaatgtgtctggttctcatgcaccacctcttagaggaaacaaacattttgatattcacaactagatagattactgaaaagaaagaaatgcagagtggggcccactgtctgtagaaaaagctcctgccctggccaggaggaagctggttaaaccatgcaaagactcctgttgtctgcctggggaaagaaaagacctcaagtgtttcctggggttttcttctgcaggttgttcggttcagggacagggtatggagtacaaccgggagcagtcaaggtctgtgtaatcccaagaagtctcagactctgaaactctaggctatgatgaagaacaatgaattgtcagcagcctgtatattaggatggggggaaaggaccacatgcgaatattttaaagcttcaaactgacaatatcatgtccattacttttgtttgcagctccatacacttgtaatttatcacagtaaaattttatacttctttatatggtggtttgattaatgcctattttcccccactccttaatgctctatgtctttcttctattttattgccagcacctaacactgtccttgacacatagcagctgctctcaatgttgagttaaagaatgagtcagaaaataactcagttagaatctcagtaatttccttgcagtacatatgtgctgccagaaggtggcgaaaatactcagagcagagaatttcaagcttcagaggcaatggatgctaagaattacataatgcaacacatttggttgcttcatcaaatgtggagttaagtttatttcctcggctaacacttgattaagataaatctcaaggtgtggcagaaacggtcagacagatttgcattcaaatccagcctctgctgcagacagccaggaatcttaggcaaatgcctttgacctttctaggcttccacttcctcatccacaaaatggaaagtacaatgtcagattttgttatgaaaattaagtgagagaacactaatacacatacacacacacatatacatatacatatgagtgtgtatatacatttttaatttttcaacctcaaagttctttgtatctgtcatattatttatagattattactgccatcgaatattacttccatgtcaaaatttaatacaagaattgaaacaaaatacattgagttaaaaagaaattgaacaagagtacgcaaaaaaagaaaaatactgtgcttttcaggccctgttgtcctccaggagaagtaaatctgagttcaagaccctgaattcttcctaagaaattgaagggaatgcagcttcatttctctgtgatgatccatctagagttgaattattttgtcaaaataaggagcatgtccctagttagaaaaactcaaagcactcagaacatgataggataaatttcctaaaggaaacaacccctccagaaatttgaaggctcttgagcacacactcagttctaaagtaaacatgttggttgtaaaagtcagtatatagaccttctgcaagacacatgtaacttttatagctcaaaatttacaattgatttttctctcaaggttttttagacctaaattaatttttaatatactgacccaaggtgcccagttatttttagataaaactgtcaactatcccttaacctaaaagtaggctgtgagacataagatagttaaagcattacagtgccagaaacctacacgaatggaggtttcgtgcccactggtctcatgccaactgcacatagaaatgctggcgggtaaacagcactaaggggacttgggaacctgtccaggggctcgctctgctccactccaagtcagttcacaggtgccagccccacccaggcccctaatcacaaggcagatgaacacatcagccaaagtaccctctagaaagggaccaggaccactcatgcataaggcacaggaggagcaaacttgcctatttagaagttttcagattcaacattgtttagttcaaaactcagcgcctggcagcctgtcctcaggtaccaagcacctaagtagcattggggggtgaggggctggggtcatgctgagctgttcaaagaagaaggaaagtccttccctctacaactccctccttgaaactaacagctcatttactgagctttagtaatactttgccctctcctctgttctagttcttatcaagtaacatgaccaagtcaattttgagtaaagtccccccattaactgtgcagtctcggaacacagagacctcgaggtattgctctctgagtccatagcacccaagacgaggcccgacatgaataagaacgcagtgaattctgacgaataatgaaaaatgaaggataagagaagtgaaagatatgtttagggaatgagggaacataagagaacattgtcctttgtaaccaggaaaagatatgtttgatgaaaaaaagaaatgggtctcaaatgtttatttcgtgagataataaaatgattgttgtcattttaagccactagcttttggggtgatttgttatataggaatagtctctggaacagatcattgtgcctagcaatgggtactaccaaaatataagtaatgggtactttccttctcctggaatgcttggctgttccctgggccccatgtatagaatccttctgtgttaaagcatatcttatgtctggagggaaattttctaccttccaatgtgcttctaggtgcaggaggagtgggcagcagagctctgcaggacccaggtcaggatgcacagtgagaaagacggaccgagggctcctcgaggtagatagcccagagtgggcaaagaggccatctgtatgaaggctgctcacctggtccacttagcaggtgcaaaacttacgaaggaaaagggatatcaatgagcaacctcagtaatcttctatagaccttgtagtgcttgcctatagagcccagaacccagatttattcatccagaaatacatacgtaacttctctgctttaaaatagcacatggtttgtttttggttgtatttggggctttgcagttcttccttgttaattatcagaactacctgctgtttgtgactggcctaggcttatgtccaaggggactgaggccaccacctactgattccccatggccttccctccttgtggtctatgcttccctttcctccttgtgtccattctctgcctcccacacacccctggtgacagttggctctgtgaagaaacctctttatgtctctcaaaaataagcccagtcatgttctatttttaatgagttttaaatgtctgttctgcaaaagaaaagtccctgcaaaaagaagttagaaactggaacctcacccagggaggggataagtgtgggcccaggacgagggctggtggcaggagaaaccaggtctgggcaccctccctctggccctactgggcagcgatgaagccagattctcatatctagaggaacattgaagttcgtgtagcaccacctgtgtggggagagaaactgctgtctgcctcagtcctgttcctggggggagtgagctgagatgctgcaacactagcatcaggtggtgcttgttgaccgattccaagccccatcaactgaaagccacatgtcaccagcctcacccacaggaaacaatgagatgcctgtacctgagcacctgctgtgagaaagcctcccctaatgcctgcccttgcccttgacagtcaggccaaactgctctccaatgggtgaggctccgacaacgcccaggagcacctgtgatgccgtcattaggaacctacctcgtcgccccgattccatcccctcccgacacctgactgcgcgtgttctcctttgcagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggtgaggcccggggtgtggttggcgggtggtgggcacagaaggagaccccacggcagcctcctaggtgcaggccttagtggcttcttctctctctgctcgagccctgccagctgcacaccacgcctggacttctcctgcttctgtccccgctgcagcacagtgctggggaggtcccagaaccaagccatggggcccgtactgtcgtgacggtggcattgtcatctgccattcactcactactggatctcccacgaacctgtcttactgtgcacacaggatgtcatgggctgtttctctggcacttggtgtatctctgctctgcctcactccagctgcgcctagtggggacccgaggctgtcaggggctcccgggacatccttccaggttctggtcattccacagcaagcaggctttgcccattgtgtttgtgagtaacccaggattcctctgccacgccacccactgcgtactgcattcccaatgtgaaggtcttcttggttttcttctaatgcccggttccacttcagggccttccacttcctctctctctgcccagcatgccctcccctggcctctgggggctcctccctcactttgctcccatctctggtcttatcccatctcccagagaggtcttccttcctgcataccttcccaaatatgcccactccaccctcacaccaaagcaatctaacccttaccaagaggggttttgtcccaacatttgtccctgccccagattaacttgttgagtggaatatatggcagaatgcaagctctctgaggaggctctgccctcacggctgcatgcccagaacccagacccagcctggagcctggcaggcatgcaatagcagatgcatggttcggtagctttcctttgattgactgtcttagcatgggttcccacccctgcaccagccactctgaccaaggagagaaaggtatcacttgctgaaggtagagccaggtgctccatcctggagctggggggatgccccatccagacaccaagagctgagatcaggcagggtggatccccacaagaaaatgggatgattgcaagaaacagaagccaaagccccaagttcccctcaggactctcactctcctcccagcctcagagagaagtcacccatcaactccctgcctgggaagctggcctcgttcacttgcacaccctctcattccacatcttcagtctcttcttctccgttggcttctccccttctatcttcaatgcccactccctttcaaatatacccagcaaactaacatcttagttctttacttgtgttcccttcattcaattgaatatatattttttccagcaggttatcagaaaagatacagcacaataattctgaacatgtggcttgattttctcatctttctcactctttaatcttttgtccatcttccacacttaacttggctccctccaaggtctctctataagctccctacagagtaggtttttccaagttttttctcctctttgacttcttgtcatttcccctcattggccaccaaaacccttcctctccaaaacttttctctctaatccttgtcaatgcccttcagccaaagtccccaaggacatacccacacttacacaagttgactttattactgcttgcagtgagggaatcttggggcaattcagcaggagggtgttagaaaggacttctaggatctggactttgggagggtgatttggggagggttcggagaagcagaggtttactgtggattggttactgtcagggagtggggacacttctatgattagatacctaggaggagggcacacagaccaatgcaatgctcttaacgggtgaagaagcagtggtcactcaccatagcaggaagcagggatgcttggtgttttgtgtctgtgttcagacttaatgacagagtggtcttgtttttgccttgctccatcatggtcactggcattttgtgacattggttatgtttggtgtgagacctgactgtgagggctgggccagctcccggcagcaccaaggcccggtgggcagtccgggccatttcctggctgtcagcggctgcttttctttctcttagttcttccacgtttctccccatcacttctagctcttcctttcttctattcagagcttttatggattgatttctcacctgattatgggtcacattttcctgcttcgtgacacgtgtaataatttttattggttcctggacattatgaatgttgcattagagtgtctgtattttgttgtcttcatttatagagtgctgagattagttttgacaggcaggtaagttatatgtaaattagcgtgatcttttcgaggcagttttataattttaagcttttagagcagatggagagtaggttttctgtagtaagttagcccagtgcccaatttgtgaccattttggggttcttactgattttctcatacatttagtgaggtttctctactctggctggtgggaaccagccccatgtgttgtgatacttattcaggtatttaagtgaaagaggacatatcagagtataactagacagagaatataaatagaaaagaggtttccagaggactgaggtcctggggcaacctgatgtttagaggtgaggaacatgaggcacaatcagtaaaggagatggagaaagaattgccagaaaggtcaaagtaaaaaaggaaaagtgagaagtcctggaagggaaacacactgttttgtggggaaggaatggaatgtgcaatcatgtcaaatgctattgataaaagaagtaaaaggagaaaagtaatcactgacaattggaattggaaacctggaggccataggtgaaccagctgagaatagtttcagaggagttggtggcaaaatcctaaatagagcagcccaggagaatgggagaggaagaagtaaagacagtgactgcagaaaactcttgccagaagctttgctttaaaaagaagaagaatggacaacaggcttcctgaatgccaaggtatttagcaagctctttgcattaagaactagaatgctctgcaagcctgtgtgagcaccaagagttgttcagcttattgttcagaaacttctttgtgaacttttatcctctgtgtgcagcctagtttccagataaacattgaggagtcctcctaggcagatttctgaggctttctttctgcctggctccctctctggtcctctgccccgaaatttctggctatcttcaccttcctcctccaattgttgtctcctccagttggtgagtcagccctgcttgggacccttctccttgtgctgcggtccaggaaggactctgggctgagatcatagggttcatctactttgtttcccacctcttaggaattacagtcttgcactgtcagttgtaaagtctgaaaacagctatttcttttatttttatccagttttctagtttacagtgaaaggcaagtcagtacaggtccatcagggctggggaccacaggggcagtttcacacggagttccgagtctggcatgcccggcctttgtgatatgtaaaagtctgcatctgaaatggcccttcttggttgtcgtgttcacagtcccaattgtagggctgtgtcatggatacgattaatgagatcctgccattttcagagttgcttcctgaggtccaggagggacttcttgtgtttacatttcttattaccctgactttattaatagtgcacttgttttgctgccttcatacccactgcctcatgtaagggcttttgatttcgccttttaaaggccagggtgagagtggcagcttacatgtgtacgggccatttgtctctttttaaattccagacagtacacattccgtgcttttcctttgtgcaccactctggctactagactaatcaggaccttgtctaccaattatccacaaaatgaaatttcggaaagtctgcctcttttagagacaactttcttaaagtgttccatgatacatcaataccatctagctacaaaagtaaatacgcacaaaatattttatctcagtggacattttaacttgttaaataaagcactttctagttagtggtttgctctgattggcatttctaaaaacaactttatgagttataacttacagaccataaattcacccatgttaagtgtacaaattaaatgatttttactaagtgtacagagatatgcaaccatcaccataatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacatgtctggcttctttatatttttgagatttatccatgctgtagcatattcattctcttttgttgctaaaatagtatatatttttttaccgtatagctgtatcctatttgtttacagttgatgagcacttgtgtcatttccacattttggctattaataatactgctatgaatgttctcatgcaagtctttgtatagatgggcatttatttttaaagcacttttctaagaaaggaaataatttatactttggaaatttcatatcaagaattaattgtatacagttagttggtctggataattgaaatcttctcactctattctttaacttataaacagagtccctgctccacaactctccctaaactaacttcttgcagagttcaattttaatggtacaactggcttggttgtcttactagattctaagtttctaatcagttggccccacaattcttcttttcctaaatccccaaggctagtgctttttgactgtttcctgcacctagatgcagaatgtttaaaactgagcccatcatgttcctccctgaacctattcctaatccattatttctaatctcaccattgagccaccctttctaaccacttcctccagccaaaaacctggaagccaccccaaattcttctatatccagttggtcacaaggctcacccatatttgattatgtcatctcttattcaatagcatttaaggacttatttgaaataaagttaaattctttatcttatcctaggaaaactcggtgatctgcttctcatttccctctctccagcttcatctttcaacacttcacctggccctccctcctactgccccttgccccacatcccacgctccagcagctaaagctttttcatttgatcagtatttattgagacctgtgatgtgccaggcatcataccaagccctggacttacaggagcacgtgcttcctagctccatagaacatactctttagtggggaagacaaagcagttattttaataaaggtgagatgtattctgttgggggaaatggtatgggttgtcacagaaacttgcagcacaaggagtgaaactcctctggggaaagggaagctgaggcttggaggatgggtgggatcccgtcaggtgaaagggaggcaagaagagctctctgtcctcctgggtttctggtaatatcacctacaatgcttttttccccaaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgactttggtgctaacaacgtatgttcagtgcaactacgtggagctgtgcacacacagcaggtaggctgcaggtgtcccccaacataagtcagtaggaaagaagacatctgtcttcccaaatctaaagtaggcaaaaaataacagaagtagctatttttaataacagaacagaactctgactcttttgatcttgaaggaggcagaagagattccatcaaaacctctaaaagcaggtttgcattttcagaacatgcccccctagagagttgagttttttacacagcactacccggtagtactttctctgatgatgggaaggtctacatctgcacagcacgctagctataactgcacatatggctactgagcacttcaagtatggctagcgtgactaaggaactgaattttatactgtaattaagtgtaatttgccacatatagctagtggctttagtaacagacagtttagtgctatattatttattcaagtactttttatcaaattcgttttttaccgaattcgttttttaccattctttatttgtcttaggatcattacataacactaaactagggtctaatgattctattcattcatttaacaagaaatggtgacctcattacaaacacttaggacaccagtggtcctgaaacactgatagaaccaaaattctgccctgacaagatagtcctacaagtgaatagaatgtcctaatacccttcacccttgtgcatgttgagcccaaactgtaggcagggagagatcagggaggctcagtacatctcaagactccttcctcactaagtgaggacgggtaggtgaggagatgtggactgcttcagaatggcacccggttaaaccaggccctgagtaattcattcataacaattcttcactggtcacctactgtgcacctaacatcattcttgtgtggagagggatacacactaaatacacacacagacaaatggcgaattataatacctatgaagaagagcagggcaggataacagggaggagagggatgggatactttggtggcccttccctataggctggtgaggtgacatctgaagaaagaacttcgtgaaacgaagtgaactgtatctggggcgcttatggaaaacaaaccctctagcagactcactggttgttttta

SEQ ID NO: 15747 - DNA, 8108 bp, Human
gtctttaaacgttatcatcatgaaacgtcctttcatagcaagatgttaaggtggtgggggcggaccacatttcccttacccttgtcagcctgagtgactgtttttattttatttatttgagatggagtctcgctctgtcgtccaggctggggtgcggtggcgccacctgggctcactgcaacctctgcctcctggggtcaagcgattctcctgcctcagcctcccaagtagctgggattacaggcgcgcgcaactacccccgactaatttttcatttttattagataccggatttcaccatgttttgccaggctggtctcgaactcctgacctcaaatgatccgcccgcctcggcctcccaaagtgctgggatcacaggcctgagccaccgcgcatggccgtgactgcttttaaacgcctttcgatggaagacgatgacggtggcctctcgatgtcagggccgcgctgccaccccctcccgccccaggcagcaggactgggctctgagctgagggcaggagcagctggcggctcgcagcgcgaccgtgggaaccactgtgagccgccgcgaccctccttgactcgccgtgacccatcgtgatccgatgtgatccttcttaacccgccgtgacccgctgtcacccacagtcacccaacgtgattcgccgtaactctggtgttgtttgctgcttgctgcccgagcctgggcgtacccatgggcgcgggtgacagtgcaagtgcttgggacgacaacccgggctcctcatcgcggccggaatccaagaggctgcggcgcgaggtctgcgtattcgggggcggaaccctgggagggaaggggagcaaagggagacgccgcagcgtaagcccgcctggccccagcgccggcgaggctccttccgacgccgcgggcatcccgcgcggcgctgccggctggccctcgtctcgtgtccttccgccgtcccaagcagggcctgggcccagcgccccgcgggctaaagaggttgcggcccgggacttcgtccggggacccgcccgcgcgcggccggcggacgagactgcgcttcccaagcggctttgcggccgcggactccaagtcccagctgtgcccgggacgctgcgcgcccccgggactccatttcccagagtgccccgccccagcctcccggccccgccccccacctggctccgcgggcagccggagcgcacccggccggaagccgctgtcggggagccggcggtggggctggacgcaggtgaggtggcaccggactcagccgcgccctgggccctggatgctccgtgagagtcagggagcgctgtgggggtctgggatcgaggggcatgggggcagcctggggctgtggtagagggtctggctgcggtgaggtctccccgcgtgcttgggagccgcgcgacgcctgcgcagggccccctcccctaagggctggccctggggccctgccgggggagcccgagcaggtttccggctcccaggatgggatccttgagggtggctgcgccccgaggcctgtcctgccctggaggaatctggctcgccagggctctccaggaccagccagcctcgagtgggcgtgggctgcacacaggcgccgtctcgtgcctgtccctagcatgcgggctttagctgcgaaccgtgttaacgacctgtgccaggagcccccgtcccaaggttgtctgcctcccctcttgtcagtcagaggggagtagaatgtaccttttctcggcctagtggggagtcgtgggttgggaccagctgctctgggctgggtggtagctcaggacccctgcggcgctgtaggctgagagctcccaggggaacagggctgcgacgagggagtgcctcggtccagctgggtctttctggttgccagtggactatgccccactctgagggcctcactctgtgccagttgccacagaagagtggggctccaaaggatgagagcgtgatgacctcagcctcccactgtttgacattacaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacgtgagtgagcccatccccagatcagcccttcctctccatcctaccccccaccctagaactaagagttccaggctgggcatgttgctgagtctaacagtagctgtgtttctgggtccttcctgccaggtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctgggtaagtgagggtggccccagcaagcactggaaaccaggatcccaggttctgggaacttcctggcgggcttcccactctcacaggcccacattcccaccccaggaagtccctgaggatcagggcttggcacagcctggtgggggcagcccctgagggacccccagtcactcacacttggtgctgtggacagagggccatgcagggggcctggaggcacttggcccagtaggcaaagctgtggagctgacttgcagcattgggaggctgaaaagagccagcggccacgtgggactgggagctggttcctgccccctgagtccccagggcctctggagcctctggctcccaggactgtgctggcccagctccccttagccgggcccaccacacactctggggtgcaggggtgtgaaccgcactctgtgcatctgctgcctgtgtctgggggaagggggcgtggtgtaagggccctgccgtggctagctgtgttccggagggttggccccaccagtcactgggcagcagccttgccttagctggctttgctaagcgtaggaggcactagcgtgagcagaggctcagaggagattctgcccaggagccctgtcaccccagagccctccttgtcggtgtctcggccttcccagcaggctgcctggccaccacctctcccttctcccaagaccagtcccagggctccagccatgccgtgtctagttcatgcacgggaagtggggcccgcggggtggacccggcaagcgcaggctccattgatcctgggaagtagagccaggtgggagctcctccagggtggggaagtagaccgccctgttccccgtgtagtgggagccccagcccagcccagggccagactgggctccttcccagcctccagtggggtcctatgccctgacctcagcagcctcctgggtggggcccagccctgagctgggggtgtggttctcctcatagtggaaggcagagccagcccctcctccagccttggtggggctggagagcaatggtgtctgtaagcccactgccttgtccggaaacggttaggatgggcaggcttgggtcctcccagggctgaagggccagggtgtgtctccacttctgcgtctggaggagcaggtaagggctgggatctggcctggggagcctgaactgtccccgcctcacccctgcagaggaaaaacgtgcacatgaacgacaacgtcctgcactcggccttcgaggtgggcgcccgcaaggtggtgtcctgcctgtccacctgtatcttccctgacaagacgacctacccgatagatgagaccatggtgaggggcagggcctggctgtgggtggggccggggagccggtgggcagggccaggaagtagcggcctctgcctctcccacgcccgcagatccacaatgggcctccccacaacagcaattttgggtactcgtatgccaagaggatgatcgacgtgcagaacaggtcctcgcgcccatcctgctgaggcccagccaggagtcggggagagggcccccaggggcgggtggggccggctggtcgggtcttcgtgccagcctcagtaagaggccagcggcagcctggggtgggatcgcgggcccaggacgagggcaggagacgctgtgcctccgcagggcctacttccagcagtacggctgcaccttcaccgctgtcatccccaccaacgtcttcgggccccacgacaacttcaacatcgaggatggccacgtgctgcctggcctcatccacaaggtgcacctggccaagagtgagtgcgtccgtccgatggggtgcccgggctcagctcgggaggaggtgacccagtgcctctgacacctgctccttccccaaatctgcaggcagcggctcggccctgacggtgtggggtacagggaatccgcggaggcagttcatatactcgctggtgcgtaaaggaaggcacagctctccccagagaacctgccctattgagccctgggctggcccctgctgggctgtcggggaggtggtgcaggagggaggctcctaccagcagagaatctgggctgagctccgagaggagccatctctggtcctcgtggaggccccataggctcctgtctccaggagtcactggcgtagctctgagctccaagggagaaaggagggacccctgttccccaggctgagcccccactgaacaaggacagcagtatggactccccagcaggggcgtttgggagagggttggctatacccatggtctctgaccctgcctgtctgacctctaggacctggcccagctctttatctgggtcctgcgggagtacaatgaagtggagcccatcatcctctccggtgggtacctcagccctcagcccccttcctccatggtaggacaggatccaaggctgtcctgggaggctggctgaggggtgggagcaggaatattcatgggccgtcgggtggcaccaaggggaggcctgacccggtggctccccacagtgggcgaggaagatgaggtctccatcaaggaggcagccgaggcggtggtggaggccatggacttccatggggaagtcaccgtatcctctggctccagtgctgggggttgggcgggggccccttgggcgggctcagtggccacccggtgtagggccagcgtgggtgggacactgcggagggaggatgctcaccctggcaggcggaggagctctgctgtggctcccctgggaatggcagaggttcaagggcaagctgcgggggctggggtggaggtgctcttctcgctgtggccttgacaaagcctccagtttgatacaaccaagtcggatgggcagtttaagaagacagccagtaacagcaagctgaggacctacctgcccgacttccggttcacacccttcaagcagggtgagccctgaccccacagccctccacttggtggaggcctgccccagcccctccctcatgctcgctaccagggcagaggtgaggtgccccctcagagcctgtactgccctggaggtgggacaccaaagctctgaggggtgacttccctgtccctgggcctcctccccccacttcctcccatgcggccccgaccctccctgtccatggccctcacctgcctgcctctgcagcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggcctggccttggcagctctgtgctgagccgtcccccacacccagggactgccccctagcctggccagtcccaggacccactatccccctggcttactgttcagcccccaagagctggtgactccctggggtggaaaggccgcagaggctggagatgggaaggcacacgtgggcaggcagcaggcaggcagcagtgagactggtgtggactgtcagctggacaaggatgtgcagggcagggccagtcccagcccctccacatgtggccacctgcaggcctgagtaacttgagctcacccggacctccctgcctcagcctgagggctctggggaagctggtctagtgggccagaaacgtctagtgagccagccgagctgagcccatggatggatatgaggggaggctgatgattgggtggctcgggcttcccctggcctggcccctcctctctgtggctctcaggcttgggcgtgggtcccccacctggccttatcccatggagagggacaggtgcctgctggacaggtcagctccagccaccagaggtggggtgtcattgctcgccgcccccgtccattctcagaggggagacagcaaagtccagaatggttcccgggccagtgcctcagccaggcagggtggcgctggggtatggaccaggagcactgggctccaggccccggcttgcccgtcgccccctttctcagtgcctcgcacagagggagcccctatgccagaaccctctggtccactgcatccaggacccagatgccctccctggctcctggcccaactctgggcccacgtcctcagggtccctctcctgggcgccctgtgccgtcttcacgcacatgatgccttttggctgcaggtaggacctgctgcttcacttcttcgttcattccggcagcggtgatgtgtcctccctgtcccggcactgagtccagaccggtgtgtcctgcacccagccaaccgctcacctcatctctcactgtccctttgtgtccagcaagccgaggtgtcctccaggcctcccctgagactggccccctcttgggtcaaggcctccctaccttttaggcctcagctgaggtggcccagcctccaaaacaccttccctgatggcaccttcacagcgcctctcggagcatccaccctgccctgctgggattgtttgtctggaaacctctgggagccccgcctcaacccctaaccctcccgctgacaccccaggacctcgagctccaggagacgggttggcctcgttcacagtgtatcccctggccccagccctttgtggataaaggctctgcccatgtgggggttcaggaaaggcctcctggagagggtggcgcctatgtggctgcttggatccaccaggtgaacagtgggaagaagcccagccaagagcagagaggtgccctggacacaagccttggctggctgggtgtccacgtcagctgagggctcccagctgatgctcagaagcccagcccggcatgggatggagaagctgaacggggctgggcccctgggcctccttttacccactgtggccctgggcactcagccagcaatcctccttcacctcgcctcagtccacttgtttatgatgagctttgtccttatgtatgatggcatggcactggatgcctctggcccctctcacctccccacagccttggtcctgagccatcactggcccagggggcctgggagaaaatccagggagtctgtgggaaggggctgggaggatccgaggtggcaggagatacagctgctgacgctgtgtgctggtgcaaagtgtccaccacccacatttctcggctgcagtggccgaagcagcctcctggtggctttctgtccctttccacctcatttgcttcagaaccttgacacactggctgtcctgcgtgtgtgctgactgtagtctgtctacactgccaccaagcagggctgcagggtggggtccagcctgtcccatctgctgccgtggggtga

SEQ ID NO: 15748 - DNA, 21691 bp, Human
  misc_feature (1)...(21691): n = A,T,C or G
cagcagctcgcgcttgtacagctgtttgaaggcggccaccacgccctgctccagcggtgcggggatatgtgcccggctgctgcctttggacaggaacagcacccgcacagcgccatccggtgtctgcagctcctccgggggaccgaggggctccggcctgcaccgcacgggggcatcctcgctgtccagggcgggcatactggcagctgggcttgggcagggcgggtgggccaccagcagcacggccttctgctgcaggcagcttcggcgcaggtagcgtttgacgcctgggacaaattcctcaaagaaccagccccgcagcagcgggcggctgagccaggcgtcggggctgtagcggtaggaggccgggaacttgtcctggttgtggtggcgcaggctgggcgggtccggcagccgcccgatgaccagcggcttcagcttgtggctgccggtcaggtttgcggccagcagcaccgttacgcggtcgccccgccagcgccggccacagccccccgccccggggtcccctgcgcccgggggcgcagcctgctccggaagcagcttccagtagaggccggtgacgctggcgctgtaaatctgctcgtccccgtagccgccctcggccgggggcggcggggccggggcgcggtcgggcagggggccggcgccggagggcagcgcgggctcctccttgacgggcgggccgggcgcggggctcggggctgggggcccgcctcgccgtagaagcgctggctggagatgccgtggcgcttctgccagcgccagaaccagccgtggctggccttgaaggtgcactcgggcccgtagatctggcgcgcgaaggcctcggctgcgcctggatgagcgggccagacagcggcaccccgtcgtggcgcagcgccaggaaccaggcgtacacggcgcggtcgatctcctcctcgttggccagccgcatcttcttgcgctgagtgcccacctcaccgcccagctgctccaggaaccagcgcatgtgggcatcgtccttgagccagccgcgcatgcccgcgccggcacgctgaatgtcgcggcacacgtctgggccttgcgctcgccgcccattgacgcggctcgatggcctgcaacttgtccttggatgtagtaggcttttcggaaggcaatgtttcatggcgacgcggtgcggggcggtgtgggtgtgatgtgcgttggtttaagggtggttaagtgtgagttggtggcgtaaggggggatgtcgtgcaggatgaaagggttacggttcttaatgtggggttttctgggggtgctcttgggatatatttcattctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctgacctagcccggcccggccccgccccgctcctgcgctgcgccgcctcgtgcgtcactcggcgcttgccgctgccggacccgcccccaccggcgacaccactggccgcgaagcaggggggcggcgcgcgcctgccgcccgttcccagcacttgtgcaaactcctccggggaagagcggcctccgggtgcatctccaacggaattctgtctttgaagcgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgtactgtgactgggtcaaaatttctgtctcttgatttggatagggtggtcgggcagtctctgaagggggcggggatgctgttgctaagaagtagtactttcagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgtcctctgaggaagtagacgctcaccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacaggtgggcacacgtgcttgatgatggacaaagagtacctgggctgtgccgtgcactggcgtcagccttctgggggctgaggacaggaaatgtggcattgaggatttgtgggtcatcatcctgtgccagtgtgttaaggtgacatcagcgtgttggaagctggtggcagtgagttatgctaagtgctggtgtaggagcctgccacaggtctccagctctcccacctcgctgacagccaagggtgccgtgtgaggtgtggcgtgggtattgtctggggttccagaaagcctgtgccgtgctggagtcacccaggaggcacgggggctgcgccgggcgggcaggtcggccagagcccctcaagcagggctggccatggagctggcctgcagtggcatttaagaaaagacgtggttggggcggggcttggcctggggcagggtgggttgggtagctacagtgagtgctctgagatatgcaggacaggctggcgtttcccagtggggctggaatatccaggggtcagacaggaaagtggctgagtgggaatgtggaactgtggagttttttctcttaaaaagaccaaaggcggctgggcgtggtggctcatgctggtgatcccagcactttgggaggccgaggcaggcagatcatgaggtcaggatatcgagaccatcctggccaacatggtgaaaccccgtctctactaaaaatacgaaaattaggccgggcgcatggctcatgtctgtaatcccagcactgtgggaggccaaggcaggcagatcacctgaggtcaggagttcgagaccagcctggcaaacatggtgaaaccccatctctactaaaaatatgaaaaaaaattagccaggtgtggtggcacacgcctgtaatcccagctacttgggaggctgaggtaggagaattgcttggacccgggaggtggaagttgcagtgagctgagatcgtaccactgcactccagcctggtgacagagtgaggctccgtctcaaaaaaaacccaaaaattagctggccgtggttgcgcgtgcctgtagtcccagctacttgggaggctgaggcaggagaatcgcttgaaccggggagttggaggttgcagtgagccaagatcgcgccactgcactccagcctgggtgacagagtgagactccgtctcaaaaaaagaccgaaggcctcactcccgcaggaagacattgatctgtcctgtggctgctctgccgtgcggtggttttgcctaaagacccgcttcctcaggggctccagcctcttttaagggctagtcgtcgcgccctttgggcactgaaggtactgaaagttctatcaggcagtgccagtccacagactcaggccagccaggtgggccggagaggggtgctgctgggagggatgggcgtgcacaggctgagccggtggctgaccccgtcccctgcccacctccctgacttctccctgtggagggtggacaatctgggagcctgtctgtgtgtgcgactgtgatggggtggcgtggagagcagggcctgggagccagctcctcccagaaagcttccgtttgcccagatgtgtggagacctccaggccgtgcagcaccttggtggccacagctctccaggatgtcctcaccttcctcagggccctgccctcctgacctggagtgttctgggtaggagtctttgccggggctgctcccaggacagggacaggggaggctgtgagggccatgccgctgcagtgggtcttgctggctgccacctgtgtcacaggccctgttagctgggtggagccttccagagccaggaccccagggcactctcaaactctgggcagctgccagaggctcaggtgctcggcagacactgtctacccctcagggaagagccttggtggtgagcctggcctgcttccaggagcagagtagggacacttgggccacttccccctggggcctggctctggcgtttccaagactgcttctctggcagccagctgtctccctgtgttctctttagaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagcgttgaagctcagacttggtctctgttaggagagatggtgcgctgcgtccggcaggtcctcccatgcttgggaacgcgggaagcggggaaatgaggaggtgggctcggacgtgtggggggctgtgctggctgtcctgggaggctctctgcccgctgttagtggccagctccccaggtgacgggcctggcctccaggtctccagcatggcttactgtggtgtctcctgagggcttcctctctgcagggaagcccacccaagatccctcttactggtcccatggggcagctgcctccgtagcatcctcgtctccaccagacccctgcagggtgcccagttcctccctgcagggtgctccctgctgcagtgtggggtgcacagaggtgggcagggccctggggccggagctcccgttggtgaaggaagacggatcccagccagggctctcgggttgatcagcagtaggaggtggcccctcctgcccagtcccacccaggacatgggctggtggctgggctttcagctgtgcccagctgcccttcgcagagcttgcagggtttatgaggtggctctggtgagattaggggcaggacacctagtgtctccagccgaggagtgaactgggtggaggtcctgtccttgtgtgcacattgtgggagagtcagtctgggaggcctttgtagcttgtgctggggcccttgggtgccagccctgtcttgacggtggctcctgctgagagagaggccctgtattaatgtgagccctgggctgcctcccccttgagggtccttgtcatcttccgggcctccttcagcagaccggacacaggggcagtgcaggtgaggggcttgggggagctccttggcagctccaggggatgcttgtgggcgctggcttatcttgtctcaggctaccttgctcaggtgacgacagggtgggtggatttgggaaaggttggctcagatagtggtccctgcttgtcccccagggcctgcctaggctccaactgacagtaatcccaagagctcccctttcaggggatgacggagtgatgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaagtaagtactcgcctgtcctcatgccccattccccttcatttgactggggaacccccagccctcgctgcacctgagggaacccagcaccacctgcgcatggcccagtctgcccagagggcctcagtttcccatctggaaagtggaggaattgggttttctggatggggcagcagcaggtgggcaccctgtgtggccgtgagcagggtcctgtcctgggctggcgggtcagcagctgacatgcggctccctgcagggaacgggtggcagtgccaggtctcggtaggagccttgaagtggcttaccctccctgagcggcggcttctgcccggagcccccaagaacatagtctgaggccactttggccaataaagtctggtagggcatcaacactgggggccagctcagtggcactgctgatgggacctgcacggctccatgggagcagagagactggtgggggtaccaccgcacgatgtcacaatgccctgtctcctgggctcttgctcccaccccacccccaacccacaacccctgcctctgcccatcagcctggccttggtaagtgctgccccagcctggggaaggaatgagcaggggagcctagggagcgtcttcatgggccctgtggcctcccatgggccccggttcctcgttggtgccattagaacttgttgctgggactgcgggattcgggccacatgcccgcaaagaactccatgttccacttagaggcttcagagtgcagtgccaggggtgccttcccaaaagtcctccctgcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacctgcggaggcagcagactagcagcggtgtctgtgaggggcagctgcacagccccctcttgagggtgctcctaggcgttggttaggcccatgcgtttctgcttttggggagcagagcctggagtcgggcatggctggggaggaagctatcgcaggctgagcgcgggctggggtgctgacctgcatcccaagagcagatttgcccctggccttctgggcctgtcctttctgtaacaccacactggacacctgggagcagagcgtgcccccggcaggatcccacatggctgctggagcactggggcagcaggtgactgaggtcgcccagagcttgagggaacacctcatccagggaggaggctgaggctcccaggccacagtagcaagtggggagtggagcctcacaacctgcctcccaccaagatggtccctcttaacattacacagaagcaaaaccttagagggggccctgatgtcctgggactgtgagagccccatgattcccctttagcttggatggacccaaaggtatggactccagctgggaggcgggggcagctgatagagagcctagagccgtctcagtgctccaggcgcttggcccctcctttctacacagtggtcaccagcatcctccctggcgtctccttcatgagtgggcactccaccctctgcccggccacctggccccctcctggggaggacagtcaggcccacaaagaagctccctctttttttttcttttcccctgctctgttgtccaggctggagggcagtggcgccatctcggttcactgcaagctccgcctcccggcttcacgccattctcctgcctcagcctccctaggagctgggactacaggcgcctgccaccacgcccggctaatttttatttttatttttagtagagacagggtttcaacgtgttagccaggatggtctcagtctccagaccctgtgatccgcccgcctcggcctcccaaagtgttgggattacaggtgtgagccaccgtgcctggccgaggctccttcttttgtaagaactttgagggtgctctgggtgtggcagtggtgtggccaggacagccacagagaccgttctgtagaatgggaacaccagccaccatggtggggtggccaggcctggcctgtggaaaaatgcagggaaagctagttagccagttaaagcttatttcagataaatgacgaaaaatttttagtgtaagtatgtctcagatacttcatgggccatacattcactaacaaaattatgtattgttcatgtattgggaggcacttggcctcccagagtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaaggtggtgctgcgcttgtgggttccagggacactgcttgaggttacaaaattccaggctgcctggatgagggcagggaagggctcagcacagggcagaatctctgccttgcccagggtccctctttggctgggaagctccccaagtcccctgtggctgtcacatgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtgactggtcaggtggcctccatcccagggtgccccgtctgtgtgacctccctctgggtgctgtgggcttgctccagggtgcaggtgcaaccccagcagcggtctctggggccaggcaggtgggtggacgattggacttggaggggaatacagagggcatggaagtggcgaggctggcctgttggcgagggtatcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagcaattaaaactgagaaatgggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtaagccgagatcgcgccgctgattccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaatttagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggtgagagctgcacgtggggcggctgggcggctctgctgcccgacaggagtggccggggcacacaaagcggattcagccaggccaggaaggcagaggcaccctggcccagtggctctgctgtgggtgctgggagtggggtctcggggcaggcggccttggccgggcccccgggccgggtctgctcagggccctcctgccggcgcctgtgcacttggtgtggggccaggcctggcactccttcccccgcagacatgggcgcctttgcctgtcgtcacagcctcaggcatctcccgcttttctggcccgccgagctctcgttctgtgcagtactttcttgctgtctctatgtgagggttcatggggttttttggtttgttttttaattaaattcttttttaataataaaaaaaagactggttctttctgcactgtctgcaggagaacggcgccagcgtgatcctccgtgacattgcgagagccagagagaacatccagaaatccctggctggagtgagtacccgcggcccacggacctgcgggctcctgctcggccaagcagcatgtctgatttttcctgatgctgctggttgttttggcttcacagcagagtcagggcagggtgcacggcgctgtgctccttgggacgtgtggctctgtgacctccatgcccggactgccacggacagtgttcttattctcgcgtcccttccgtgcttacctcgtctgccggctggcggtcacactggccgctcctgtggggccggctgggagctgagtggtgccatttgcagggtgtcctgtgggcacctggcatgagagcctgtgcctccctgcttgctccctgtggcaggactgtgtgtctgctgggccttcccacattccctcttagatcttgcctcactggggagagagaagtggtggttctgcaaggcgcaaggagttcagagcctagagttggcaccgtcttgagttggagacccagaaggagccctgtatccctgcttggcctccaggccccgggccaagatcaggagttggaggcagtagctgtggcctgacaggctggctggggaaggggtgtcctccgggaggtggcagccctggtgttcccgaggagttgggactgcgttctccccgggacggggtggtgtcctggccccaagaacggggtcagtgtttctgtggctgctgctatggctttccacagcctcacgctggaaacagtacatctgtatcatgccgggtttccaggccagaaatctgaaatgtgtctcacgaggctgtccccagtgtcagcaaggtcgccatccttccaaaggctcaggaggagtctgttcctttgcctctcccagattctggtggatgcccacgttgcttgtttcaaggtgctcagcaggcagcctcatccccgccccgcctccacttccatctcgcgcctctctcgaacctcctgcctcgctctgtcacttacgtggttcttgtacttgctttgggcccccaggatcccaggtccaggatgttcccacctcaaaatcctgaatttaatcgtgtttgccaattcttctttttgccatgtaaggtagtggatttgcaggctctgggggttgggacgtgggcgccggagattctcagtgtctcatttgtaaggtgcattgctcctcaccaacatctgcagaagcctgggtcccccacagtgtccctccaaagtccagaatcccatccaatcaggcatgggggattgcgtggtccatcctgaggcaaaattcctctccatctgtggaccagtgaaactggaaagcaagttatctgctcccaaaatacaattgtgggacaggcattccctttcaaaatgggaaaaagaagaaggaaacagggcgtcactagtcccaggcagtttcacagtccagcccggcgggtcacgtgaggtttgaagggagcgctcctgtgtggcccatggtcccccccgctgtcattttttaacatccctattcctaccaacagcaagttcgtggcagtttaggtttaggttgttctagaagatgacgtgttttctctgccctgctcctcacctcctctgagtcctcaccgagggccttagcatctgaattctgccaacagggtgctcaagacaggctagggtttttcttttggagggggtgggtgagttgtggacagagtcttgctctgtcgcccaggctggagtacagtggcatgatcctggctcactgcaacctcagcctctggggttcaagcgattctcctgcgtcagcctcccgagtagctgagactgcaggtgtctgccaccaagcccagctgacatttttttttcttttttttttttttttagtagcggcagggtttcgccatgttggccaggctggtcttgaactcctgaccttatgatctgcccacctcggcctctcaaagtgctgggattacaggcgtgagccactgtgcccggcccagtctaggggttttctgtcacgctcctcaaaattcttcccgcctcaccactgcccaactccaaagccatctccacattgttaggcattccagcagcaccccacttcctgggccaggatctgtgttggtttccacttgatgttgctgtaacgttgccacacttccgtggcttaaaacagcacaagttcctcaccttacagttccgggggccagaagtctgagatcatcttatggggcaaaatcaaggctgtggtccttctggtgtctctgcggggagaatccgcttccttgtctcttctggctgctggaagctgctcacggtccttggcccaaggctcccaggcagctgtcttgtcactcagcctccctctcccctccctcgctcctgctgcctagtgtgggcccttgtgatgacagtgggcccacctgggtgatccagcatcctctctgccgcttaacttaatcttatcacatctacagaatccctttgccatgggagaccatatttacaggctctgcggactcgtatgtggctttgtgggggccattgttctgtctgccacagccacagccacctaggggtgtgctggctcccgggccataagctgggcatccctgggtgggtgggcccaggaagggctgccactcctgtctgccaggtggggtgctcctttgtgccttgcgttctgcccactggcttgcacccctggcttgcccaggcacctgaccaagtccaggctaggcagacatgagattaagggagcacagatttttgcgcccaagtcaggcatattgcactccagtgcccagaaggcagcggtcgggggcttggccctggggctgcaggaactcttcagccctggctgtgtggggtcaaccctaaggtgtctctgggacaggcaggtggtcgcactgttagggcttagggactggtttgctgctataacaaaggtccatagactgggtgacttaaaccacatgtattttctcacagctctggaggctggaagtccatgatcgaggtggcagcaaggctggtttctcctgaggcctctctcagcatgtagaccgtcttctccatgtcttcacacggtcatccatctgagtgtgtgtgtgtcctgatgtcttcttattggacaccagtcagattggattagccccctgcccctcagtgacagttacctctgcaaaggccctgtctccaaataaggtcacatcctaagataccgggggataagactccagcatgtggatttggaaggacattattcagcccatggcaggggcccagtctcatcttggatttggggtgggagtgctcagcagacactggggtttcagaactgcagggtttctggtagcgtggtgctggcacagggttacaggcatgggtctggctctgaagtgtttgcctttggcatcccccaagtccctgaggggctctctgaggcccgctgtgactgcactgggtgacctgagcctgcccgttgaagctgtgctcagggattctgatgcctggcatccctagtccccccgagtcagcatcaaaggaggggactctccctgtgtcctgagtgctgtgggctctggcctagtggcccgcagagccaggcagtggtgaaacggcccccactgctcatcatgcagcccggggccagtgctgacttagtgcctcttccagaggggaccttttccctgtccttgggcctgctgtgtggggtgcatgaggcctcaggtgccactcacagactccggcctcctcaggacccagccccactcccgcgggaggtctgctgtgattctccatgccccctgacgccccaaagcctggccctcccgtgctccagcttctgcccccgagtttgtcagtttctgccggtgcctcccgtacccccaccaccattcacgcgcctctgccagcctggcctttccctgtccatttcctcctggccttgctgccaggtgggcctcctgggccagtttggctcggccttgcccatgatctgcggggcttagctcccacaccctccagatacataaacaagcattccccacagcatggtcccaaggacggtggcaggagggccccagggatgggtttgcacgttgggcaaaggcctcagtatgtccgcacctgctgcaaggagcggctttgcctgcccggctactccaggcccctccccacagagagggagccccggggagctgccgagatggggtttgctgagagctccatgcagccaggtgcaccctgtccttcgagccatcctgttggagggtgggcaggctaaatggcccatgcgtgcaggtagatgcttaaggactggctagtgttaagggccaggaggctgggatcctgtctgggccccgaggtatcagtctcagctatggcagagtatgaggtgggcttggggccctggatcacctagagactggcttgctgagtgagatggcaggcgtgaggcccagggagacaaagctttgggtggctgctgtccacacaggtgggctccttccttcttcccccactgggccctcagctgctcccgcctcccatttccagtgctgcctggtcccctgaggcgtgtcccaggttgtccctaggactgtgagtccttcagcacctcccacccagcctctgagcctggctgctcagcaggattccgccgggcagcagcagccatggcccagctccccacagcctccgtctctggggcaccaagagcctcctgtcctggactttgcctggctgagaatttcactgtggtctgtggtggctgccacctctgaggtcataagtttgagctgggcatcagcggggggcacctcctgctctcccgagctgtagttttccttccgtgagttcctgcagtcctgagcatggcagggggaccctaggagcaggctgggcactgagccctcccctcctcctgccttgcagagctcaggccccggggcctccagcggcaccagcggagaccacggtgagctcgtcgtccggattgccagtctggaagtggagaaccagagtctgcgtggcggtgaggccccgggccagtgggttggggctgtccctggcccctgccatctaaccgtgctccccttgcccccccagtggtacaggagctgcagcaggccatctccaagctggaggcccggctgaacgtgctggagaagagctcgcctggccaccgggccacggccccacagacccaggtgaatgctctccccacgcctgacactgcaggggaccacgtggccctgctggcttccacgtcgccctgtgggctggccccagcagcagtgatgagctggcagccaggatactggagtcctcaggtccccaggaaggtttacagttagccctgggcaggtggaggcagtttttgtctttcctggggccctgcatgtacacagctgcggtacacaggggctgcccttcctccagtcaaaggagggaggagggccaggaggtggccaggcagctctgggccctggttggggcgtctcagccgtgcctcctgtcccttcccctgtggcagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcctgtgagtgggcggggtggggcttcagggggccaggcactgccctggtgcccgcctagccggctcagcctgtgaccctccccctgccctctgggttctggggagactttaaagccgagtttagaagtcttgggataaacacaaacttggaggcaggaaggtgtgaatttggattgttttctgtgggccctttaaggaaacagaattgtggacacacagtggttgagggtagggtgcatgcaggtacttcctgggtgttctgagggtggctgaccccagcttttcctcccctttccccacagtgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgagtgagccggccggggagaggaggggagaggagactggggaccctggcccataccctgcactccaccccacggcagtggggagcgagtcccagagtgaaccccacctcagaggaggctcctggctccgagtgggctgtaggggaacagccctgaccgtcaccctccgcctctcctcaggtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctcgtacctggcctgtctccctccctgtctcagccccatctctgccctgctgttcccacacagtcatcctggctgctgccaccctctgtggccatgtcaccttgcccccagcagacctccgcctgtccctccatctcctggccactccctcccaaagctctggccctccctcttctttccattgcaaaagcaagtccagttcagggggtttaaaaagccagaaacagaaactgttaggtcactatctggagaggccaccaccccaccactctgcctcctgttggcattgtccccatgggagcaagcgtgcaagcctggaattgtccaggaaagaagtcccagtagcacccggccctgctgccatgccctttgtcatgtgctgtcccggccctcccctcacctcattcattcctggaatccctgccccttgctccagggactgtgcccctcccatgatgttctggggtggccagagcgtggctgcctgggctctgtggagctgtgcctcagcatcctgacagccgtatgtggtcagcatgggtggccacactccctcccctggaccacccgtgtttgcattggggtgaaagaggatggggtgtaattacttgattacttctggtcagactctgtcctcggggccccaagccacaggggaatggattctccctgggtagtggcccctgactttgccctcaaacctttagaaagtttcctgtggggcttggactgcaggaccccataaaagccaccactgagggacactgggccttcatagccacaaaaggtcttttggtgccagccgacagtgggcatgcgcccccctgccccacgccgccctttcctgggtgccaagctctttccaagcgacatttgcgtccatctgggctgcctcgtcctagcctggctgctcaagctctaactaaggcagcctctggcctccctccccaggcccagggcaggagctggctgctggccagcggttgtcttctgggtcggtgggggtggagtctggctggtctgtcctccaccctttccgcctcctggcaagtcctgagctgcacctcattgcccggccaaagggcagagacacgagcgactgggggcacctctggtgaccaagaccgggctgcgctccaaagaggccgttgggcctggagtggggttggggggtccgagaggagttgggtgacatcccccaccccatcccgggtccagctgtttcagcccctctcggcgcgccgatactattagccccacccgtcctccatcgagtcccgtgccgctcccaaaccgcacgataagccccacagggagtgcgccataggccggggcgcgtcacggggccggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccggtagtcccccgtccgcgcgacgagccccccacgcccggcagaaacccccacctatggccggtggaagtccttgcccccccgtggaaccccccatgtcccacgaccggtctgtccccgcgctggtctcagcgcagttacctcgtttccagacgtgcagttcctggcctcggtgctgcccccagacacggatcctgcgttcttcgagcaccttcgggccctcgactgctccgaggtgacggtgcgagccctgcccgaggctccctcgccttccccggagtgagtaggggtaagcgggcggcgcggcggccacggggtgctgggccgagcgcggagctgacttctctccccgcaggtgccgctcctgca

SEQ ID NO: 15749 - DNA, 24639 bp, Human
gaggatgtttctggaagagattagcatttgaatcggtagactgagcaaagaagatcaccttcatctatgtgagtggagtgggcatcatccaatctgttgagggcttgaatggagcaaaaagacagtggaaggcaaatgtgttctctgctggagctgggccaaccagcttctcctgtccttggacatcagcattcctggttcttgggtctctggactcagattgggccttatgtcattggctctcctgctcttgggccttcaggcttggactggattacaccactggctttcctgggcccccagcttgcagacagcagactgtgggacttctcagccttcataatcgcatgaaccaatccctcataatctcaattactccccccaccctctctctatatgtatgtgtatataaaatttattggttttgtttctctcaagaaccctgactaatgtagggttcaaaggctttggggatcattctaaaagcaagacgaaagacaaatgtccaccagagcttgcaaatactgtatttatcaatccctcctcttcttggcatagtttctttcaaacttcttagtgtcctcttcccattattacaaacttctcgtttcttctaaggtccttctaaattggtgagttctcagtgggagttgagtgaccttttccctcagtgtgactatcactgcccaatgtcattgatacattatacaactccccatccccacttcccctcagctcctgttaaccaccattctttctgtctctatgaatttgactactctagattccccatgtaaatggaatcatacagtatttgtctttttgtgactagcttatttcacttaacataatactctcaaggttcatccattttgtagcatctgccaaaatttcctcccttttaaggctgaacagtattccattgtacgtagatactgcattttgcttttccattcacacaaagagagacacttgggttgtttccgcctcttggctattgtgtataatgctgctaccagcatggggtacaaatatgagaagtgaggtttaggatcgtgtgaggaggatcacttgtagagggaaaatagtgaaataggacgaccagataggctctgttggaactcgcgcccattgttttaagacgcagctcaaatgtcacctggttttagaagtcttcctggtctccgcaggcagtcagtatctctttcctaaatccaccacattcccgtagacagacaccacatttatgcaaatctccttctcacagacagtgagttccatgggggtcccctggcagcctccagccctgtaccatgctaactcttccggagaggaaatggggcctcgggagagcctttgaagcctgtgttggtacaggctgtccttccagctaacggggctctctggggaatgtatgtttgactttctattcccggtaatataagttcaaatgtttgtggatatttgaagctcggatgaaagcgtttctattcatgcccctagaatctgtgaggccttttctttctttttttttttttaaacaagagcccacagcaaaacttgggttacttggctgaggaaaggaatgtagagctaggagcagggtttcatcttcagccccagtcgggcaaaccagtggcagaagggaaagcagagcccaggggtccccatcccgtacctggggcgcaggccccgctggggtgggagggagagtggagggccgggcaggctgcagccgcggatggctgccccccctgccccggtgttactgggaggacggaggttgcgacagcagccgagcccacccagttgcagccggctcggggcttagggcaggggcgggaggtgaccaccgcgccgctggccgcctcgcccagacattccgtttctgccgctggaatgcgcggacaaggctccttgttggccttgggcggggttcgccgggccggcctggcgctcgaggccccggggcggggcgggcccgaggccgcgggacctttaaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtacaggcgggcggcgggagggacgcgtgagcatcgaacgaggagaagcccagggcatccaccaagcgcgcttcatcccggcctcaggccgaccgtggtgcgggggaaagaggcccctcccggatgaatcctgtgggggaaactgaggtccagagaaggggagggagatgcccaatatcactcatgtgtccaggctagagatgtgggtctcctgaagctctcactcccctgtgattcggccaggagcacagggcagctggggagcgcaggggctgctgcccagcggctgctgctaagctccgtcccagtcctgacctctccattcagtgagcaaacccttcctgagactctgctgttagttctcttggaatctctccatctccatccaatatcagggcgtgatctttcctcccctcccacagtcctcaggctgcctcagactggaaggtaagggatgcgggtgtgagaccaggaggagatccgaggagccgtaggataccccaggatcaagacactctgggtctttggcgaacaattctatttctctttttggtcagcaattgattcctgaagcagagcaaagctcatagtgcagcgaagcgggcaggtcgtctgacacagcccctgacagcacatgaagggaaactgaggcatatcaagttgaagggactctgtgaatcagtatcagaggccacaataaaattcagggctccgaaatcccaagcaaggtctctttccactgccccagcctaccaacctcttaatatggtttacataagattgtatcttcatttccaaaaagcgcagcttcagtcttgctaaaaagagtctgtgccaggccatttctgggtatgcagtctcatttggccagccacgctgcatgcctcaggctgatttcaattgtctatccccttctgcatctttctggataagctgagaaggagctcaagggactctttcctgactcaaatactcagtccccgtatttgaagtggcagatttgaaatggcaaaagcattgctgctaaggcaggaggtaccggggtccacagggctagattcagctggtggctggttgctccaggccgggaattgagggaaagcctttcttctggaagttaatcttactctagtcctgacctgcctccctctgggatgggactggaagaggaaggagagattcagcaccaggtggccatgtccccctaagctttactggtctttcattacctagagtccgaacctgatcatgaatgataacccattaataaatgcgagattccaccctgttccaaattatctccttttagcaaccagaaattgctaagcttcgctatggatttttatttctagcaggactgtaaggactcagtggtattatgagtatgggaacattttaggagattcagattctttctttgttcttgggaatcaaattgctgctatttagtaaatgggagtgagattcaaaaacaactaatgattgatgcggagtaccagtcaggaaggaaccagatgttcacagaattttctgccaccatggtcaagcctcaggtattagttttctatggccactgtaacaaattactgtgaatttagtgccttaagacaacacacatttattacctgagagttctgtgggtcagaagtctgaccctggtctcactgggctaagatgaaggtgtcggcagggctgtgttccttttgggaggctctaggggagactgcatttcccttccctttccaccgcatgaaggctgctgagttccttggcttatggcctttttcttccattttcagagccagctaaagcaggttgaggccttctcccattgagttactcacatttctttcatctgcctccctcttctactttataattacattgactcactgaataatccaggataacctcttgtgtagagctctttgacttaatcacacctgcaaagtctctgctctttgccacgtaaaagtaacatgtctctggaattaggacgtggacgtctttggcgggggacattattctgcataccacaccccgaatagaggattcggtgtgaataaccaagtggagaaggaaagaatcatgcacgtttagttataagaacatagccatgatatttataaggacaccatttgggtgctggtgaaagcactgtcaattacagagttcatatcttcatgttacccccaccttttctttttctaattatacaaaaatactttgacccatctccaggaaagattttcaacataattcttcttcctagctctagatctatgggactttccaggaatgaagtaaaattctggaggtttttttttttttttttttagtatttgaagagatttattctgagacaaacatgagtgaccatggtctgtgacacagccctcaagaggtcctgagtacatgtgctcaagatggtcagggtgcagcttgtttttatacaatttaaggaggtatgagacatcaatcaaatacatttaagaaatacattggtttggtcctaaaaggtgggacaactcaaagccggtggtggtgaggggcttccaggctataggtaagtttaaatattttctggttgataattggttgcatttgcctaaagacctgggatccatagaaaggaaatgttcaggttaagataaaagactgtaaagaccaatgttcttttgaagtcttatagtggctacccttagagacaatagatgacaaatgtttcctattcagatctttttaaaaaattattattattttactttaagttctgggatacatgtgcagaatgtgcaggtttgttacatagggatacatgtgcgctggtggtttgctgcacccatcaacccatcatctaggttttaagccccacatagattaggtatttgtcctaatgctctccctcctcttgccccccaccccctgacaggcgctggtgtgtgatgttcccctccctatgtccatgagttctcattgttcaactcccacttatgagtgagaacatgtggtgtctggttttctgttcctgtgtcagtttgctgagaatgacggcttccagcttcatccatgtccctgcaaaggacatggactcattcttttttatggctgctggagttgttttttttttttttaaagaaagaaagaattttgattccttttttttttttttggcttttagagactgggtctcattctatcatccaggctggagtgcagtggtgtgattgtggctcactgcagccttgactctctagctttaagcgatcctcctgcctcagccccctaagcagctgggactacaggtgcctgccaccatgcctggctaatttttaaactttttatagagatgaggtctccctatgttgcccaggctggtctagaactccggagctcaagtgatccttctccctcagcctctcgaagtgttgggattacaggcgtgagccactgcgcctgggtttaattccttttgacttaactaaatgcatgacatacagcatatttcagggcggtgacttaaagtcaacaagcaggatgtttactgaatacatgagagaatgttgatttttgtggaggaaaatgttgcctcagagagaggtaactgggattcagtagcaagctcccagggactgggagtcaggaaacctggagtccaatccatgctctaccactttctagttctcacacctccttgaacctcaggtttctcacctgtaaaatgaatataaaaaccacctctgcacctccagcctcacaggttgatgtgttggtaccttgcgattcctaaagtgttactgaaaggaagattttctttttgttaattaaatacctccaagcagcaggctaaaaacaagaagataattttctgcttttaaaagaaaactagacagagacataaggtaggctgttccaggtaaggctttaatttttttctataaactgcttagtctaggcattaattttgaatcacctttttttcctactaagtattaccttcctagagtagcatcaacttctgcctccttattaggaaaggaaagagccttgagtgacacttcatgccccaggacctcatttccatttagggctgcatgcgtgtgttgggtgagaagggggaatgacttgaaaaagaagtttagggctgggcacagtggctcacacctataatcccagcactctgggaggccaaggtgggaggatcacctgaggttgggagtttgagcccagcctggccaacatagtgaaaccccgtctctatgaaaaatacaaaaattagctgggtgtggtggcgcacacctgtagtcccagctactcaggaggctgaggcaggagaactgcttgaacccaggaggtggtggttgcagtgagccaagattgcaccaccgcactccagcctgggtgacagaatgagactccgtctcaaaaaaaagaaaaagaagtttaataattggctttttttcttgtctcatcctgacttgtggatttgatttttgtatcgaggagagagggtgtgcaaacaggggttgggggaaacaggaaagaacaggaaagaatagatgaacactaaaatgtactgtgatactaaactgttaggtacttttgtgtagaaaagagataaattctttgaaggtgggaaatctggctatctggtttatatgcttttgtagctccagggcttcatacatgtaggccctcaaaaaatgtttttggtgaatgaataagtcaaaagagagatgaccaagagagttagttggggcagtagggtagataccagatcacaatccctgcttcttacgagacatgctcatgaagctggaagctcactaaacagatacaagattaagttggcatccctcattctactttttttttgagatgatgtcttgctcttattgcccaggctggagtgcaatggcaggatctcagctcactgcaacctccacctcccgggtttaagcgattctcctgcctcagcctcccgagtagctgggattacaggcacatgccactacgacccgctaatttttgtatttttagtagagacagggtttcaccaagttggccaggctggtctcaaactcctgacctcaggtgatcctcccgcctcggcctcccacagtgttgggattaccaggcgtgagccaccgcgcccgggcccctctttctacttacttttttttttgttttgttttttgagacggagtctcgctctgttgcccaggctggagtgcagtggcgtaatctcagctcactgcaagctctgcctcccaggttcacgccattctcctgcctcagtctcccgagtagctgggaatacaggcacccactaccacgcccggctaattttttgtatttttagtagagacggggtttcaccgtgatggtcttgatctcctgacctcttgatttgcccgccttggcctcccaaagtgctgggattacaggcatgagccaccacgcctggctctacttttaattagttcagggctccagtgagcccccaaattcactaaacaggaaagatggccagatggagggagaattcagggatactctggagcagttttcagccccttggaagtggagtaaaagaggggggccaccagaagagcccctgagtgccttgcctcagactaccattgcctgaggcttgggcacagtggttggcagtgaggctgtccctgagggcccaaggccttttacatggttcagggacacattgtccaattgctccagatagccaaggtacttaagaaatgtgtagaatctattaattcccaggaatcatgagggcccttgggagcaaaagcttaagcagagggatgaggttctaagtgaaatttcaggattcagccagcctgcaggtgaggtatttggggaaacttcacacctccaggtgaattctcactagggaattctgaagtccttggtgctttcaacaccccgatggtcttggggaaggtcgcaggcagtggtgatgttggggtcaggagatgctgccttgcctggcctcctggaatcccagagttctctggaagtgaggattactgcatttctaattgtggtctgatcattgcttggtcttttgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtggtaagttggtcagtctttgcttccaactagaaaggatgttatattcagacattgtgtacccagagaaaagagtattattcttttttggtggaaatttaatgaaaaacttaaatatatccaatgcgtgtgtgtgtgtgcacgtgtgcatgcgcgcgtgtgtgcgaccaacctaaacacactctattggtttaggaatatagagctgcattatatggaacttggtttgctcataaaatcttcatgtttgcgttagaactgtgaaggtctgcaaatatccaggataaatgaccctgctgttccctgtcagggtcaggaaaaacaaaactcaagatgcctctcctgtcccctctgccccaccactacatttttttcccctgatacatatttttttagttttaccatctctagatctaacagaactctgtttgttctcctgcagaagacagggagaagcgtctgtccttgggagagtcagcaggcctctattccaatgtcaccgtcagcccgagtgtgcatttagtgaatgctctggttttcagactgggctgtttatctgattactctttgttgaagaacaggattcagggaccaggcagattagggtttcagctcacttgaaagaaagcaagatgatcttaagaaatcattctgttaactctgctactccttccatcctttaggatggaatttgaataaggacatgctaattttattggaatttttagcatgaattgaccaaatctaggactacagatccattcaatgctggagtttaattttagtcactgatcagaattatgatctgtgggactcatgctttatttttttatcatctggagataatcttttgttccctctatgtgaatatccaagcagttgtggacaaatttctagttcaggtgaatttttaaacatagatatctttttgcaatataatttatttcacacttatttattcagcatgcatttattgatctctgatgatacaaagataaaggtaatccctccataccattaagtaacattctgggggtgggggtgagacaaacaaatgaaccaataattaattacaattatacatttcaaggagacttttaatctaggttaatgtgaaacgcagccatcaatggtttgtcaggaaaagggagatgaagtcttgctctggggcaacgtttggcctcattgcagtcagacttggctgggatccccttgtctttcctgtcccaggacactgggctttcacaagccatcactggctttggtggcatctacttggcattcgttggcttccaaaaagaaagtggctttctttctcccaggaaatcaccctcccactccatgcttgtgggtgagagcctctccatcaacatgctggtctgtggcaaagttgggtttcaaagctagcacctggggttgggcttcgaaggctataaagtaacaagtggtgagtggcaatcttttccttctggtacaaaagacctgcttgttctgggggaaaaacgtcctctctatggaaaaaagactgagcggcagcttgttgtagtcaacgggttggaaagatcattccatgaaaaggcccttcttgggaaaatattagccttgtcctgttgccaagggcagtggaggttgggttacctgccacaggagggccagcctccttcaacaggcctccttggtttctcagaaatgacttaattcattgattcatctttcaaaagaggtcactaggaaaaaaatatccaatgagatataaatggctccaggagcaataagatggagatgtagtttagctaatgtaatctcatttattttgttcttttctttttacctgtttgtattagcatatgagttcactatggatttagcgtatggatgacttcacccaccttacatattcagaagacagttacccgaactgtcctctaccatttgcatgttcaaatatgtaccactgcccacctgtgagttcgttctaggcttagacccagacttgtgtgagaattctgtttagacataggctatagaaccttggaaatcagattctggctacaatgggacaactagctcacgtcacttcaggctgtgcatttattgttctcccatttcttgtggtggggaagcacaaatctttttttcatggggaggcggataagccaaataaaacatccaattgcctggcctatgtaagtgtttggcttcagctccaaactccaaattccctttctcccttgagaaagtctatatagcaagatgtgtacttttaaattagcaacaatttctagtttaagagtagcattgctaataagccagaggcagaaaacaaataaccatttttttatagtgaagtaaagatggactcggaaaggagcccagagagcaatgtctattgacatgggagacggtatctgagatgtttcctaagtgtcagtgctgactgttgtaaacttcctctcacagcgctggacccctgtgtgcttggaacacaccagtgccagcacgtctgcatcagtgatggggaaggcaagcaccactgtgagtgtagccaaggatacaccttgaatgccgacaagaaaacgtgttcaggtgaggcctgtgtagggggccgtgactgaatcaaatacttgggaacctatgctccaggttttggactggccttgtgctttgactctctgacccctttttacctaactgccttttggctggtttactggtgttcatcagcagttttccctgaaaaggagcttagggagaaaagtgaaatgatagataaatcagcttatttccatactttgtaagttttaaataaaatcgtaggagaaaaggctactaagaaagaggtccaggctgagtgcagtagctcatgcctataattcccacattttgggaggctgagatggtaggatagtttgaggctaattcgagattagcctcgagaacatggtgagaccccatctctacaaaaaataattaaaaaaaaaaagccaggtgtggtggtgcatgcctgtagtcccagttacttgggaggccgagatgggaggattgtttgagaccaggaggtcgaggctgcagtgagctatgataatgcctctgctgcactgccacagagggagaccttctttcagaaaacagaacccacacacacaaaaaggaaaagaaacgggtccaagattcttagcccttttgaggatttgaaaattttcctggattttatttcattacatgcaagctaccctcttcctctctagtcatagatgctcatggaatctagaagtagcaaagaagttagaggggtactcactggtctggtacatagatacatacatggagtcaatgaggaatgggaattatatatttttttgttttgtttttaatcctagaaaaaagtttttgggaggaagaaagcttagagataacttaattttatagataatgaaattgagatggacagaagggaaaaaacttacctatgtcacagggtctcttagtgaaagagccaagaccggagggttggttcccaactcccagctgcccctcccttgtttcattagctctgtgtgtgtgtgtgtgtgtgtgtgtgtgtgtataactgtaagtggcgtggcccacaattatttctgccatgctctgcatgcatttacatttgtcccaatcatcttttgatagctcttgataggtgtgctcttaacacccacggatgtgagcacatctgtgtgaatgacagaagtggctcttatcattgtgagtgctatgaaggttataccttgaatgaagacaggaaaacttgttcaggtaagtgagggaggagtctttactattgctacttagctctctgcctacctacccggtgatggaagggcaggtcacattgactgggaagttggtgtgttttcctctcttgccaccttgagcttttcccatttttaagtcttatccaaaatgttagaaatggtaacatgtatgtatctcggcccaaatacataaatatgttgctcatttccttctctgtagccagcctgaacaatccttcccaaatgctacagacaattcagtaggttgaaatcacataacaacccacaagttacctgttgcttacaaagggaaagacagtaactttatagtggagaaactggcagacatcaccttaactaagtgatcaaagttaacatcatcagtgatgacacatagtgacatcatgtatgacctgacatgctgtgctcaatactgtggacacaacagcacacctgtagtattcttgctaaaaattcaggattatgaggaaagattagaaaaacctgagagacactctcagttcacaaaatagttttccagtacttctcagaaacgtgaaagtcataaaagacaaagaaagacttaggaagtgtcccaggttggagaggacggagatgtgaaactgaatgcaatgtggaatcctggattggatcctggaccagaaaaaggacattaatggcaacatttgaataaagtctgtagattagtaaatcatattatatcaatgttaatttctggtttgataatcatactatggttatgtaaattactgtttggggaaacagggtgaagtacaggaattttttgcactgtttttgcaaccttttcataaatctgaaattatctcagatgaaaagtttaaaagtaaaaaatagtttaaaaatatatcagtagagaggaaagtgcattgaatgaaaatgtgtgtcttgagtttttatgctgctctgaatcaaatggtctccctcgcgctcctttccctcatttaaaaaataggagagggttgaactacaatttcttcaaactctaattctatgtttttctgaatctaatgtaattagccacacaactgttggtatcccgctgagttgggataagtacaataagcctaaaaggaatgctagaaagtatttatgagatacttaggttataaaaactcaatactgatgatttccaaaagcaattgtggaaggtcagagaataattattgtatgtgcaggatttcacttaactcagttaacttctagttagaaaaaaacagtgccaatggctttgaatagtttccagtaagttttcctcatatgtttccagctgcaaataaggtttctatcctgggtaataaaatacttttccaccttctatttcttttctcctgactttttgtttcacagctcaagataaatgtgctttgggtacccatgggtgtcagcacatttgtgtgaatgacagaacagggtcccatcattgtgaatgctatgagggctacactctgaatgcagataaaaaaacatgttcaggtaagatccactcaaaaaattctttcatacttgggtctttcacatgaaaccaacttgcaactcaccagcaaagaggtttttaaaggtaacttaagatcaaggttcagacattctatcacacttttagatgaaggcacacattgctcagagggtggtgagctcactggagcaaacatagattacttcagaaaattactgggaaataggtagggagtgggggatatgagaaaaactaactaaatgtagggtccttatccaggaaaattttatagctctgtacactgaagacttttaagcaaagagaaaactttagtggaagtcagttggacagtaactatttggtgtgataggatgaactgatctttttccagttaaaacttggcctggaacttttctgtagtgttaatcttaaagctggatgattttagtaaagaagactttgtgaatgcctgaattagacccacacagatcttccagtaagtttgaggccagtcactccctggcagtttctagacgatcaatcattggtgaaactcagccttatacgttggccaatgagcccaggccagtgctgttaatcctcattaatttgatttaaacttactggcaggacagggtggcatttataaatgtaaaaacactcctgagagaaattccaagctctcaaggtgccgtttagctttggcatattgaatgtgttttagatttgacatatattttcctctcccttgaggacatacagacttcatcaagatagacaaagggaaatggcatgtcacccagtcccctcttttttttttttttttttttttttaaagggaaaccagtaaaaaaataccggacacctactttgttcccagtatggaactaagcattgggagcatacaaagaagcctaagtttctgcctctgagcaagttaaatctgggtgaacagagagccggctccttatgaaagcagagactgagccagggagagggactgatggaaacaaagggctgtagaggctggggaggtgggcatctgcgaagggctggtggtgggccttgaaggagggtgaaggtttcaatggagacaagtggaaagtggcactggcgggggactggcttgagctgatttgttcagggcaggatgactaagaaagttggggtggagagaactcacctatggctgcacttctcaaactagtgacaagtgtcccagttggtactttaagctgccaggaacattgaagacctgggaaaacaaaccaaaaacaaatttccatttaaactaacagatagtatggaataaagtgaagcaatctattttaaaaaaaaacataaatcaaagaaaattttcagttaaggcagacaacactcccagatgccagtattccatattcttcaatacctactgtaggccatgcaggattctaggcattttagatacagtaatgtaccttaatactcacagcaacgttaggaggaaactgattcagtaacttgcccatggttactctgctagcaagtagcagacccagggtttgaacccaggtacttcctctagtggttacataggctcttaaccactaagccttactgtcttaatgtacaaagcacaggacagtgaagagggacagaagagaaagaatactagtgggaaagttagttatatatatatatatttttttttcttctcttttttgagacagggtctcattctgtcacccaggctggagtgcggtggtgtgatcttggctcatacagcctctacctcccgggctcaagtgattctcccatctcagcctcctgagtagctaggactacaggcacatgccaccacacctggctaatttttgtatttttttgtagagatggggttttgacattttgtccaagcttgtcttgaactcctaagctcaagcaatacacctgccttggcttcccaaagtgctgggattacaggtgtgagccactgtgcctggcctatttatatattttaaagtaatagtgaatactgctataaagctggggaacataccatggatcagatcccttctaatggtctgcttttccgttgctagtggtaggaaggcttgtaaattaaatgtggagccccaaataagggccaggggctggaagcatgtccatttgccacctgtagagtgggtactaacctggaatgagggggaaaaaaatgaaacaccctgctataaggcattttgctgaaaaaaaaatctaaattgtagcactgaaagggaatagccatattaaggttggaaaggcactttatgtatagattatatagcgtctcacatttcacaagaagctattctataggcattagtgagccacaaaaggttctgcccatgaaatgacatttaagaggaaaattagagggaaataaactattttggttcctgcaatggcagaggaggaacctatgtcttccaggaaggctttctggatttcaaaggagaattactgttttatttgtcctaggccagtctgaacatgggatgagtatggcactttgctctcctctccactcaaatttgggcaaactgcatttgtccctgaaatgttatttgtgatagatagtaagtacttcactctctaatcatacacatcatcattactaaccctgtatcatttccccatctgtgcttgtgtgtgtgtgtgtgtgtgtgcatgtgtctcctggtcagtcttttctgttacactttgtaagctatgaaggcaggcacttggtcaatatagtgctttttgtgcagcatcaaacttagctccatgtatgattaggtccctaaaacattacttttggtgatgatgatgatgatccatgagtagctggggatgctagaagcattgatagtcatcgggaaaggctggaggtaagttctggaatatagtcaagactcagtgctgcccagtgctgtgggtagaaaaaaaggaaaggtacccttagatatctgtgagagatataaaggaaaggagtgtgtgtgatgtgaggccaaagggatgagaggtatgggaagagaaaacaggcttgctcctgcagcatggggcctgttgctgactactgactactacattctcagcacttgtggggaccaaatggaagcttctcctctcaaacatttgtgtttacttttctatttaatgtgtgaatattttctttcctgcaccacgtgcggtcagtccgtgacaagtgtgccctaggctctcatggttgccagcacatttgtgtgagtgatggggccgcatcctaccactgtgattgctatcctggctacaccttaaatgaggacaagaaaacatgttcaggtgaggatcagccctttaaggctatttcctttggtaggaaaatttttcaggagcaagcttttttctttctgtctaagacacagttgtgattctttctccctgtcagaattctccagtggctcccactggtctacagaataaaacaatgatacccctataccaggcagcctaccctccatgatctgtttctgtcttctctgtttttcacatttttcttaataactaaactttctgcctaagtctgaattttttttattgtggtaaaatacacatacaatttaccatttcaattattttcaagtgtatagttcagtggcattaagtacatttacattgttgggcaaccaccaccagtatccatctccagaaattttttatcatcccaaaataaaagtctgtgccgatgaaacaataactgcccatcacccgctcccctcagcccatggtaactacttctctcatcctggcttttaaaacttttctactacatttgcccccagattcactgcttcttcctgcatcctggtccagccacagtgggctctttgatggtccaggagcatgccctgcactcactcattcccaccctcccctcaatgcttttgcttgtcagaatttgcttgccaacatttggttttgttgaattaaatttttgccaatccagtggatgtttttttcatttcctggttactaatgaggtgaggcatcttttcctggagagtactgccattttaacagtctttcattgcattaacatggtatgtctttaatttaatttaattttattttattttaggtcttctttaatttctttcaaaattgttttgtagttttcagtgtacaagtcttgtacttttaaaaatatttattcctaactattttattccttctggtgctattataagcaccatttctccatttctcaactttcaattttgctacaacccaggtttgagaaatggagtttgagatccatttctcaactttcaatttttctacaatccaggtttacaattttctatgaagtgttgtaattaagactatcccactgaacccatgccctgctagagcttagagactatcaggcacgacagacactgaacaagtattatatatacccatcttatgggtacagggataatggacatgtagttgatcttcaatagatacttcctggtttattgactgattaactaagatgggatttggactggctgtccctaaaaggttcaataggattcagacaggtggatagatgatagattatatttaatgaatttatgatctcccatccctatattggatctttgtaaaatgttaagagtaaaaatgttgcagcaaaggaccatttcctgtcctcaggcaatagaattactccattggaagatgatacaccagtcttcagacctgggaagttactcttatttctattcacaactttaggaggagccctgatactgaataggaatagctgcctgactgaattccataaagaaataggagttacttttatcacctctcatatttggttaaatgtcaatacaaacgtgaattttcagttccaaagtatttattggtaagaactaggactcttacttcaaaccattaaatagaataacagtcctctagaggaaatcaggacttaacctggtttttatcctttttttttgttttgttttttgagacgacatttcaatctgtcacccaggctggagtgcagtggtgcgatctcagctcactgcaacctctgcctcccgggttcaagcaatcctcctgcctcagtctcccgagtagctgggattacaggcatgggccaccacgcccagctaatttttgtgtctttattagagacggggtttcactatgttgtccaggctggtcttgaactcctgacttcaagcgttccacccaccttggcctcccaaagtcctgggattacaggtgtgagccactgcgcctggccctagttttcatctttggtatattttagccatacaaatagaggactattgtcctagttttatttttatttatttatttttaagagacagggtcttactctgttacccaggctggagtgcagtggtgtgatcatggctcactgcagccttgaactcctgggctcaagtgatcctcctgcctcagcctctcgagtagctaggattacaggtgtgtgccactatgcctggctaactattttacttttttgtagagacagggccttgcttcgttgcccagggtggtcttgaactcctggcctcaagtgatccttctgcctcagcctccaaaagtgctggcattataggaataaggcactgcaccaggcccattttcctttcttaattacacagtattacataaacattgtcttatttctatatccctggcctccccctataccaaccatgtttttctaaatttactttatatcatgaataatttctggcaatcacaaaagtacagagaataaaataaggaaccctcacttaagcatcactcagctttgacaattataaacattttccccaatgtatcctaagatgaatttttctgtgataagtattttctcgtctttttgtttgttcatctatccctttacctcttggaaaatgcacttaggtaagtcttaacggtggaaatattcaactgtggatttcctgatttgttatgattcctatatagctattcctagatagtatatttgtgtactgtcattgtcttcagccactgaggaagcacgaagacttgtttccactgaagatgcttgtggatgtgaagctacactggcattccaggacaaggtcagctcgtatcttcaaagactgaacactaaacatatcctttctggaaggttttctccttctgcctggagccaaccaaggtactacgatcgagccaaacactttaagacattccacaggcaagtgacttatttgttaggttttaatatgagcagtggtaatatacaactttaaaaaatttagagttcttttctaatggtttaatagactgtttcacccattcaatatttacatgtaaaagctgcctattttgtcccctagtgcttttccataactgtatatgctcctaatgatgctcttacataacagatggaacatttatgctaatgactccttaatatggctttcttagttcagaatctgaacatgtacaaagcaagtcagctgattaatggggtgtgatatctcagattacacacagttgtaccctttgactagccaagtggtcaaaaagcagattttaaaatgtaacatgatacaatctcagaaactttcaaaatcagttctttcttcaaaggagtaactagggaaaagtttctcagaacagttcaagttaacaactctgttcctatgtaccccagaggagtggaatttagattgtggtaggtacaatctaggcgtatgtagagacttttaagggaggtacagataattggaaagaatcaatttccaaatccttcacttgcttaagacactacttggaatcagctggcattttcttttcccgtctctcatttccatatcaccattctcctaacttcacacaagaaaggcatacttctcatttaccctagatctactaaggtgcatttgttagaacagcagaatcttgagatagccaaacaaagggacaatccaactatccctttaatcaatacttcataaacactgcttcccccatccctcacactaagatgctactccaattacattttatatgaacaaaaacatctgaagaccactgcaggggtctacttttattgtgctctctgaagaacaggatttttgacttttagactgaattcaacttttggtgagaaaacagttttgctcttttttttcacttctcataggacataattattttatcttgtgaagtgtttgaaagtgtgtttatattttctaatgtgtaaaaataaatggtgttggccttaacaacttgccacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgattcttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatattatcatgtctatttttgatgactcatcaattttgtctattaaagatatttctttaaattatactgaattaacagttattttgatattcaacagtttcttatcaaaagacagaagtttgattctcctcctatagtttaatctcacactcctgaggctaaaagtgtaagttcaggttcaaaagaaaggcttcaatataaaattatctaaatttggataaaataatgatgagctttacattaatataagctcctgagaagcaaatatatcctacagatgtaaatataaaatataaactttaaggaaggaacaaaaactaaatataccaaggaaatatataaagcatctcttacttttcaaaaattttgaaagggtatgacatagagctacagtagtattttccagacttttttgagcccaaaatcagtaatacatattaatataccacagagaaatggtggtatagaaggaataaatgagagttcatgtgcaagaagggaaagataaagagaggtgagttttcaggtgtcaccatcagtaactagcttcaactaattatgtcttgaccagtttattggaaactcctgggttagataatactaatttgtctcatgcgtccagtatagggagcctatggacaggggccaatgtatcttaaacagacacacaaacaatggaaagcaaacattatctgaatgggattgggttaagtttggaaagaattcctcatggagactgatttgtgctggtttggctaggcacaactggcctgttaagagggtaggaccatatataaagtggcttgggaagcagagccggatggaatgttgccctgcagaaagcatattggcttacttgaggtgggggctccctagtaaaaacatttaggattgagggaagatctgattttggatggagtttagatttgctaggaaaggcactagggactattgtcaattctataatagattgtgctgggtgagacaaatcacccaggtcaaaggattggaggatttttattttatttttgtctgagatgggaaaagactccaagtggggaaattaactactgatgcataaattacatgctagattatggtaaaagggaaaaccagaaataaaaacataggtgagaccaaataatttcatgagtggttctacttggatttctgccctatgccttagactttgaggctttgtaactctcaagcattccaaaaggacaaaggagaatgaagaaagaaggtaagaaaaagaagagaatatgtaacagtcgactctagacgagaaaacaccaaacgctcaaatatttgtaaaatgggaggccatgccccaatagcaattgtacgctgtaattacccaacgtttacagaaattcctttaaaaggaccctcggggttgcggtaataattaaactgttaaaaaatatcaaaacaagcggaataaacaaaatcttctattcctaaattgctctagaggttctccaatccccaaagacacagagaagggttgtaagatctcagtacgcacatttgcactttcatctggccagtggcgccagcctatcaaatacagtaaatggcttttccctttcaagaatgttggaactttggaacttacaaaatactaaataatttgcccttattcgaacgggcgcctctcctcttaggtttatagtaatgccacctgaggcgcggctccatagcgatcatcacaggtgtggcgggagggagggcggcagtgaccacgagacggggcgcagagggcgagcgcacggctggcagtgacaggtcgcgacccagctccttgcggagagcagaaaggcccagacgccagggaacaggactagcccagctaccgcctcgcgcctcgcgccctgcgcccacaaacccatcgacgtccgcgcaggcgcactacgccggtgcccggtgcgagggcgtcaccggaagtgtcccgcggcgccccggatgcgaccgggcaacagcggttgccagggcgacgggagctttccggagctgctggtactcccgattggagacgtagaaccgttacttgtcgagggc

SEQ ID NO: 15750 - DNA, 20444 bp, Human
  misc_feature (1)...(20444): n = A,T,C or G
aagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaccaagcaccattcctgcttcttggttaattttccaacagcttttgaagcaactggagtcagggcttccctgatgggcagcacaggtgaccaacaaccagagaggggagagcctgggttggtatctttcagcttccccctgctccgctcacctcctgcctcctggggcaccagatgtgcaaggtgaatgttttcatttcactttctagaacagacagcaaagcagggaagcggctgagagggtgagaaggcgccccaggggcttgggtacaaaggggttggagttgagcgtgtggaaattcaaggcgaaggttagccctgacctcccccaagggttaggtcctctctggaccacagccctctataaacagcttctcaaaccaagaagcgagggtgaccagtagcagttcccctcccctgccattgtaaaaggcttctctgatttaatagaccgtttgatcccaccacctttacctcccactcccaagaaaattcttctccgtaatggcaccacaatgtacccagttatttcagtctcaaacctggcatccccctcatttcctctcccccgacatctaactccatcacccaccccacctgctccacatcagcccaaatctgacctgttctcattttccctgggtccagtccaccactatctctaaatggtcttcccgtgcttccacctgcgcagacctacagtccatcccccacacagcagccagcatcatcttgttaaaatgtaaatcggatccaggcttgcccctgcattaaactcaccagtgacttcccatcaccctcagaatgaaatcccagcccggggccccatgcagccttgcttctcgccagcctcagcccctccagccctgggtctctgtagttgcaaggcttgggatttcgtccccttagatccttgcaggagtacgggggaggggggcccttcttgtcactcagctctcatcccaaatgccacttcctcacagaggccttccctgaccaacccctcaaatcattattggagaccctattgaatagtaattagccgtgtttttaacgggtgatgtattcacgttccagcacttaaaagcctcctcctgacccttgcattcctaattctcttcataattatgatctttttaaatgcatttggctccgtgttcctccacgagagcagaggctttgttccaaccgcctagcacggcacgccagcaggagcccagtaattgttgaatggctcaatgttcggagcgcaggggccgctctgggacgagtcggatcgaagtgctacacctaggtttgtttccgagatgggcccttagaaatgcccccctggggctccaaaggggcagatgccacagccgccagggcggagcgggtgtgagcagaaggctgggaaagatgggacgccgctaggcgagggacttccgctcagagctacggcggaaatgccgctcttttaactctgggccggtctctcttggttcccccgcccctccgggttcttccgcctccgagccgacacaaaccggtgcgcatgcgccgtgccctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggtggagtggcggggtctggggcagaggctgcgcatatcccggcaaggaagcggcggcgggcccagggagttgagactgggggcacgtggtcgcgaacctggatgccaaggtgcgcggggtcgtgcaccttgttgtcaccattgaacacgagggtgtgcttggttccgcaggggtccgagatgaaatatgccctgaagcgtctaatcacgggactcggggtcgggcgagaaacagcccggccctgctacagtttggccctggcacaggtgaggtggtgctcctggcagggtcccagccatccaggtcaaaatggtggggtatgaggagggcgggtgtggtgtctcagctgtggcggaggggcagcccgagagagaggtcgggagtggcagagctgactggaggccaacctgagggaggcctcttcatgaaagtggagaaggtgtgagcaaggcctggccaggttttctatttggtgcttgggttgcccggcctcttaggtacactttctgggagcagtgagcgctgggtgggctcccttaggcctgcagaggcattcagctgattggagtagaccactctctgaggcgccttgacaaggggcagagcaataaagacccaggcctgcaggatcagcctgaggggagctcagaccacgtgcggagagaagacccagtggctgagcatttcagactagtaatctaggggccatagaaggtacatagaaggtgggactagggacctgaggcttcttgggagaagttgaagggggaagggaggttaaggtttgtgaagacgtagttgggccactctcctgaaccctcttcctcctgccacacaactcctggcagctgttacagtcttttgaagacctccccttgtgcagcatcctgcagcagatacaagaaaaatatgacctgcatcaggtgaagaaggtgagagtggggccagggaggtcagcagccccaggggtgggaggcttggggaatggggagttccagggcccctcatgcctgtgcctggaatccttttctaggcaatgctgagacctgctctctttgcaaacctgtttggagtgctcgccctctttcagtcaggtcggctggtgaaggtaagagctttggagggactgggggaatgtaggctggcttgggatgggtgggggacagtcgtgtgccctgctcataccctctgtccctctgtggggaccaggaccaggaggcactgatgaagtcggtgaagctgctgcaggccctggcccagtaccaaaaccacttgcaggagcagccccggaaggccctggtggacatcctctccgaggtatgagctccccagctgtgcgggcccaggcaacactttgttacagagacatcaagggggctcggatgagaatctggaacagcactgttccatagaaatacaaagatgtataatttgaagcgtttcagtgactttgttgaaaaggtaaaaagaaacaggtgtcatttagtaacatttagtgacatttgactttatctggtatatctaaaatattatttcaatgtgcattggtataaaaaagtgttgagatatcttacactctttttgtcaggtgtctccaaaatccagtgtgtatgttacacttaggcacacccctgttcagattagccacctttcaggcgctcagcagccctgtgtggctgtggctaccgtattgggcagtgcagctctggaactgtgcctggcacgtggcaagtatataaaacgtttgccattgttatcctggtcaaggctggccccttgtgggcctccactgccctacttgggaaggtagcaccctaggcccttttgtcaccgaagagaaaggcaggggtagcaggtctccaggccagggcttactgtgcagtcttgacctcagagccagaaggacctgaattcgaatcccagctctccacctagggctcctcgtgtatgaaatgagctagtactctgaaataccaaaaaaaggaataattaaaagggtagctttgaccgggcatggtggctcacgcctgtaatcccagaactttgggaggccgaggtgggcagatcacttgaggtcaggagttcaagaccagcctggccaacatggtgaaaccccatctctactaaaaatacaaaaattagctgggtgtgatggcgcacacctttaatcccacctgaggcaggagaattgcttcaacctgggaggcggaggttgcagtgagccaagatcacaccactatactcagcctgggtggcaaagtgagactctgtcttaaaaaaaaaaataaggggtggggggcaggtacctccaggggccagttagcgtcagtgggatgcttgtcaaaaaccccgctgcctgggaatttgagttttgttagcaactggcctctgatgactctgatacctcaccaggtggccccgtgtcaggagcaggtagaacaggatccaccaggctcaccccgcagaggaagtcacgatttcttctccctccatccttaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggtgtgatggaggtgggcggatttgccctccctggggccaagggactgcatctggccaggcccagatttgtcgtttggcctgggggtgtcccggctgctcttgtcaccctggcccttgcctgtgaggcaagtgttccctgagtcccttgccctccgcaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccaggtgcgggcgacgcgtgtcctctctcggcccccttccctgtccgtgaagtgggctaggccactagtcctgaggttcccaccaggggcaccaagggctctgaccaggctctgtcctgcaccccctttagctacctgtgtttccgcctgctgggcgcggccctgcccctgctgaccaaggagcagctgcacctggtgatgcagggagacgtgatccgccattacggggagcacgtgtgcactgctaaggtgggtaatgcccgtgcagctcgacactgccagaaaggctagacgtggagctctccctgccaaaaaggggagcagggcacctcgggggcttggctagagctatgggtgtcccctccgtctgggtagtgagctgcctgaacccctttccctcggacaaattttttttttttgagatgaagttttgctcttgtcgcccaggctggagcgcagtggtgagatcttggctcactgcaacctccgcctcccaggttcaagcgattctcctgcctcagcctcctgagtagctgggattacaggcgcccaataccacgcccagctaatttttgtatttttggtagagacgggattttgccatgttggccaggctggtctcgaactcctgaccttaggtgatccacccgccttggcctcccagagtgctgggattacagacgtgagccactgtacctggcttccctctgacagttttgataaagtcaggcccttctgccagcaggcccccttgtgggcatggatagccagcgggctgttcagacctctctccgcccccgcccatgtggcagtgatgagaacagtcgtcatgaccatgtttgggcaccagtgagcctggtgcccagtaagtgctgctgggttgactgttctcaccagctcattttatctttgcagtgagtttcagagagctgtcattctgggtgagggggagacttgaagtatcaggcagtggttaagagcttgggttggatggtggtgcacacctgtagtcccagttactcgggaggctgaggtgggaggatcccttgaacccagaattttgaggctgcagtgagccatgatcatggcactacatgccaggggcacaagtctaaaaaattgaaaggaaaacagcttgggctgtgaagccggacactatcccactgggagcctctgaccctgagaagttacctctaggtgtttttgtgtctcactgtactcacctgtgcaatgacaatattggccaaccgcaaagagttgctaaaaatgctaagctgccgcccaaaaaggcggagcgcgggtgctggcactgagtaagcgcgtgagaggtggttgtttttggtcccgaagatgacacggctaggaattggcagcgtgggctttgaacccaggtcagtctcgcctcctaactaccactctgccctgcgttgagccaggaaaacaggccatccccatccagcaaggcggaaagaggggccttctggggccggaggtgctgaagctggggcagtcagacccacagaggccttgacgccagacaaaagcactggggtgactggactgttgcaagttcaggcacagcctagctgtgtacaacaggagattgccggggctcgatttaacctgtagtgggcacaagcctggtgggctgttgcccgcctgcccccgggctgttgggctgttgggctgttgcccgcctgcccccttggctgttgggttgttaaccgcctgcccccctgggctggtgggctcagcgccatgcctaactcttgcagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgtgagtggaccttgggggaggacacctaatttaggagttaacttcctaggcctgcagagccccgcgacccaagcccgccctccacagcgtcctggctctaaaccatgagaggagcgagggggaagagccttagctctcatatgaggcctcagtttacttgtgtgtccccacactggcgatcgggatggggagatcttggagtgttgtctctgagatcaggcaaaggaatgtcctgtttttgctggttctttttttttttttttttttttttgacagagtctcactctctgtggcctaagctggagtgcagtggcgtgtgatctcagctcattgcaacttctgcctcccgggttcaagcaatcaagtgattctctgcctcagcctctccagtagctgggactacaggcacccgccaccacacccagctaatttttgtatttttaatggagatggggtttcaccgtgttggtcaggctggtctcgaactcctgacctcgagtgattggccagccttggcctcccaaagtgctgggattacaggtgtgagccactgggcccagcctgtttctgccagttataagtggctcacatgacctcgcctcctgccccgctaggcctgagcgagctgtgttccggctgaggaaatggatcatctttcgattggtgagcattgtggacagcctgcacctggagatggaggaggccttgactgagcaggtggccaggtgcgagctgtgctggattcccagcttcccatgggcgtgtggccaaggaatggggccccttaactcgtcctagtttgcatcccctggagccagaagcctttgggttgagtcatcagtggggggcaggcacaaggggacttgggaattcctcaggaacccgtgaagggaaggggcccaggaggcaccccagctgcaggggcctaaaaggttcaggtgtgctctgcgcgccctgcaggcagcttttgcacgtgggaggtgtcagggaagccttctgccccacacctgcctcgtctgtgccagtgcagagctgggtgctcacgtcaccctcaacatgcacggttgcaagagggggctgtcccatgttcgcaggagcagtgacctgacttggccatgaccacacagcctcccatctgttggttccttgagaggggcactgactctctctagctcgggttaacccgcgttcagctggggatccagagcagagaaacggccccttcccatcctagcccagcccagccccctccagccttgcccgtcaggcccccgaggactgtacccagggcagaagggcggctcctcctcctcctggccttgtaccctcggtggtaccatccaaggaggggagcctgtaaaaaccaatggcagtgaatggctatggccactctcccaccctccccaggttttgtttgttccactcgttctttgtcacaaagaagcccacatcccagatccctgagacaaagcacccgttctccttccctttggaaaaccaggcccgagaggctgtcagcagtgccttcttcaggtgagtcttgggcagcccaggagaggtccgaaggtgggaaggccttgagggcgcctgctccctccaggtcccctaagctgggaacaacggcagaggcccccggagttctagtaggtcctggagaggcgggagaccgagccctggggagggcggagggaggcggctacattgactcatctggtctgctgaccccaagccccatcccttgcccagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggtgagcacgtgggatttccagggggtgggcaggacgctgcagtctgactggtgcaggggcctgggaatcgcctgtctccccgcaggatgctgcagactctgaaggagctggaggcccactccgcagaggccagggctgctgccttccagcaccttctgctcctcgtgggcatccacctcctcaaggtactggggcctgggagggaggggctgtgagcctggggttctatggcacaatgggccccctaccgagaggcttttgagggctgtgcgggtttccaggaaaggttctgggggagttaagttgggaggtttttgaagccaactttgtcacaggtggaaacatccctccggccacttagcggcaccagctggtgtcctaggctttccatgcaggatctcgtaatccccacagctttgaggcagacaccccctctccatgtttgacatggagaaactaagactcagaggcaaaggagcttgcactgtaccccctgctgtgggaacaccttctggcaacgggctctcccgctcggttcttcccatcaagaagccctgaccacattcgaggctcagtaccctgatttcttttgagttttcttctcatgacataagctgctcttattggggctgctttaggtcttctgtagcctgagtaggtgggtctcttgcttgctcccgtctggccacttgactgtggttgccttacttgccagctttggttattctgagcccagcatgtggatgagctgtttggggaaaggttggccacgatgccccttccaattcttgacgtcaggcctttgatagcagcagagtcctggtgattccaggacacatgtggagcctgcccccagccttgggatctccgaacttgacttggacagaggaggctgcagtttgctgtgtcagagccttagataaaaggtgcagccctggccaggctcggggctcgcacctgtaatcccagtacttccggagaccaaggcaggtgatcacgaggtcaggagttcaagaccagcctggccaacagagtgaaaccccttctctactaaaatacaaaaattagccaggtgtggtggcaggtgcctgtaatcccagctactcaggagggtgaagcaggagaattgcttaaacctgggaggcggaggttgcagtgagttgagatgacaccactgtactccagcctgggcaacagaacaagattctgtcttagaaaaaaaaaaaaaaaggtgcagcccagaggaggacggggacctgcttgggcacacagcctgggagccggagagcaatgacaagggctttgggctgctttgtcccaccctggcctaaacgttcaagctgccgactgcattatgaggggaaagtctgctttttaggtaccaaagatcacacagttttcaagagctcctgcacacgcacatgcgcacaccacgccacctcactcgagtctggggttatccccagtcagatgagttcaatgtaattaaattagttaaaactaatgactttcaattctgtctctcatgccaagccaagcatggagggaataatctagaattatgaattgggggctggggcttgctggcttctctgggaccctgaccatccttgtcaggttctgcctttcttgagtgtccaagggggagttggactccttgtccccttcaggcttttggatcctgtaactgcgtattaggtgtgaaaaagccgtcagctagctgggcgcgggggctcacacctgcaatcccagcactttgggaggccaaggggggcaagggggtggatcacgaggtcaggagttcaagaccagcctggccaacatggtgaaaccccgtctctactcaaaatacaaaaattagccgggcatggtggtacatgcctgcaatcccagctacttgggaggctgaggcaggagaatggcttgaacctgggaggcagaagttgtggtgagccgagatcagaccactgtactccagcctgggcaatagagcgagactccatctcaaaagccctcagctcttggggtgtccagctggggtcttctgttctggattgtgggggtgactggccagggcgggccagtggctgggtgttggaggcttcttgatgccactgctgccatttggccagccccttgcctggtttagaagggctggggacagggcctggccccagtgtgtgtcctaccctgcccgcagtcccctgcagagagctgtgacctgctgggtgacatccagacctgcatcaggaaaagtctgggagagaagccccgccggagccgcaccaagaccatcggtgggtccttggtcacgagagggactagagtggtggggtggggccagcggtcccctatccgggctcaacccctccctcttgcagacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgagttgggacctttgggagtggaatgtgggctggggctcactgagcagcaagctgcaccaggggtgccgcttcagcctccagcctccctgccgggagcctgcggccggtgggaggggtctcaacgaggccttggcctggcctggccgcctctcctaggctccgttttcttctgggaaatggaggtctttggtcaaggctgagtggggcctggagaggagggcgggggctgcaaatgggtcagtggctggcacccctccccaggtgctgaaccccgagaccagtgaggatgagaatgaccgtgtggtggtgacggacgattctgatgagcggcggctgaagggtgcagaggtgttgccagcatgggccgggcgggggcggtggggagtgggacgatcggggaggtgtgtgacgcgcctgcctctaccacacaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctggtgagtgggggaggtggaggggggggcggccggggagggctcgggtgtccccatgttgtgtgcctgcccgaggcctggctgaccgctgggcctctgtccctcagggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgagcctgggggcgggccgcacccacccccgcctccctgtgcgcccacccccgcctccctgtgcgcccacccccgtgttgctgacctgccctcctggctgcaggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgtgagcacgggggtgcagggcgggcaggtgtggccggcagcccccaggcgcaggagagccagagctctaggcttgctgtctgcacaggaaggagagagccaagcttccagcctgggcccctagctcgcaggctcactgctcagccctagaggcacacgtcacttagtgattcccacagtccttgcttcatccccgcgttctcccgacacagtgccaacagtgccctggagctggggtccatccctgcccttgacagtctcaagtggggctgtgccaacagtgccctggagctggggtccatccctgcccttgacagtctcaagtggggctgtgctggggtggagggggacagtgggtgcacctgtggcaggggacacccaacccagtcctcggaggtgtagtgtgcatgggagtttgtcaggctgggaggccttgggcagggcagaaagggaggaagagcatcctgacgggagctggtcagacacgcagctggaaggtcaggcaagcagcgaggccacagacccccgcaccctcgcaggccctgaccctagcggtgctggaggccacagaggcattatcagcaagagcagtggcgggggggagggtctgagtctggtttgccttttcagaaacggctggcagcgtggagaagggtttgggaggggctgtgctggaggcagagggcccaggagggaggcggtggcaggcgtgggagagacaggcaggcacctggtagacctgccttcagagctcaggtgctggggaggtgaaggcctgggagctggggcgctgcgtggatagtcaggaggggtggggagtgtgactggcagtgcattcttcacaaacccaggcccgcccgggccacgccttctcagatagttctgccagcgtgcgtggacagtgtcgtttgttgagcatcctgcctcttgcccccattatatccccggccctgcagggccacagagggttctaagcacatgaacccttgtctcgctttacaaaaggcctgaaggccactgccccatgagagacaagtgtagacaggaggggtgccccaggcaggcagttggcccttggtgcagcctccactcagggagctgttctgttctcccctggagcgcccctgtcaccccagcactctgagcccacacagcttccaggcagcctgcaggcggccctgggccctcctctgtggcctgggtcgcctctgtcgtcttctaggtctgtttccccacttataaagtgggacttgggttggctctgcttggcggagcagggtggaccgagaatgttctgaccagctctcgtcctcaccacccacaggcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggtgagcagggcctggcccaggagcagccccaggcatttcacagccagggagtggaggccgggacttccccagggcccaaccctcagccttctgatgaaggtaggccaggctctgctcccatcccagggacccctctcctggcctcacccagctcgctctcccctggcctaggctgccagctgcttggacttgaacctggtgacccgggtgtactcgacagcactgagctccttcctgaccaagcgcaacagccccctcacagttcccatgttcctcagcctcttctcccggcacccggtgagtgttggggcctgccctgcttcctcatggtccctgctcagcccagcctgcacctcacagcccttgtcactccccaccaggtgctctgtcagagcctgctccccatcctggtccagcatatcacgggcccggtgcggccccgtcatcaggtgagagacttcccagctcccagcccagggcctgtctgaattaacccgcttaaccctcttctgactggatattgtgaggccccagagcgctgtcctggtgagcacgggcacagctgtccctgccccactggcttggctgtgggtacatggtctctgaagggggtggccgtgccctggcccctgccacacagtgaacacagaggagctgagggggcagggccagcctcactcccgcagccactgctgcccatctggccacacacaggatgcccctggtagtgtctgctctggtgccagggctgttgggggcaggctggaggaagatggcactaagccaataatgggcaggaattgtcccaacctgaggtcccacctctatccagctgggaggccttggtgtccccacctgcacacaaaggcacaggagcaggtagtcacagagcccagagcagcaggcagcctcacacgctgcccacagcagtgcccagcgggcccccgagccctcatgcatccctgagccgtgagcacccaacgtgccaaggctcctgccacccacctttgcccacccacaggcctgcctgctgctccagaagaccctgtccatgcgggaggtgaggtcgtgctttgaggaccccgagtggaagcagctgatgggccaggtcctagcaaaggtcaccgaggtaacagccggggggcgccctttccccaccccctcagaatcagttctccgggagaccgatctctgggaaagaagtgaggattggagcctgagtccagagtcgggagaactggggttgtcccaggagacggtccctgcctctgggctttacttccggctgggaaacagaaaggctttgagcagctctccggagtgcctcagcctggccacccttccctagaacttgcgcgtgctgggggaggcgcagaccaaggcgcagcatcagcaggcactgtcctccctggagctgctcaacgttctcttcaggacctgcaaacatgaggtgaggcgggggcccagtccgcggtcgtgttcgggttcctcttgggggccttggggcctcccggccagcagtgccatgcccgggctggactgcagggatgggggtcatgtggggaaacttctcagtgcctgggccagggctctgggctgccatttgggcagttaccaaaccatggatgggtgagtgacttgggaagggactgtgccaccctgtcctcctcctgcagggcggggtgagagggggtggggtggcactgccacatcccgtgagaaagccgagaaggggctggcagggctggagactgtggaagggttggagaagattcagggtgagcagccaggtttccaggcctggtacaggagtgtgggcagccatcagggcagggctgggaggcagctggaggtggccatctgggtcccccggtctggcccagagggcggggtttgggaatcttcagcataggtgctagtcagcccttgtggagggagagcttgccaagggggtgctggcaggcagaggcggggcccgggacggggccttacaaaactggctgatagtgaggaagccaggagagcagggctcccggaagctggcggattccaacaataacccattcaggatgtgcaggaaggtggcagggttgggtggggaagcgctttggcagccccgcggtgatggagtgctggggagtggccctcttggaggtgggtgggcccgggccactgctggaggggaggacaccgagactctgagaccaggcctttggctatgggaaggaggagaaccaacacctggggcgcgtgtttcctccctcggtaagagacacggatgacttaacaggcagaaggagaggctgaggcccaggaaggggcaggggtcactggtgaggcagcaacagggcagaggtgggaagactgggagcccgcgagaggccccgccctctgtggccccacagctctgccttcccaccctctgcagaagctgaccttggacctgacggtgctcctgggtgtgctgcaggggcaacagcagagcctacagcagggggcacactccaccggctccagccgcctgcacgacctctactggcaggccatgaaaaccctgggagtccagtaggttctgggagggggacacacaccttgggtaggggctgggaacaccctcacgctgctgcacacacacacacgctgcacacacgctgctgcacacgcacactgcacacgcatgctgctgcacacacatgcactcaagcgcattctcagatgtgggagctgtaggaccctcacaggaccctcgcaggaccctcgcaggaccctcgcaggacccaggggcctcgcaggaccctcataggaccctcacgggaccctcataggggcctcacagaacctaggggcctcagaggaccctcagaatccaggtggaggtagcagtcgcggtggcggtggctgctgccctcgatgggcaccttctaaccttgctcacttcccttcaggcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggcgcccgctcattgggccaaacccactcatcaccccacaaagcctgttggattcacttacaggccacccgctacaactccaagcaggaggtggggaggggatccaggacagatgcctccatttcgccttgacatttggtttctggtaggaggcctggcgtccagccagcacagcannnnnnnnnnnnnnnnnnnngggtggaggctggtctttggaggatgccacccccaccccatcctcttgtggggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccgaggcccagctgagcagtggtccctgcataccaggccctcgcgtgagcctcaaagccgggactgccgccctgaggcctgggccacctgctctccgtatggtccagggtctgttgagtcttcaaagctgcagatcgtgctttgcccagcaagttgtgtgggaaagtccagccccctggcccttcgttccagggagggcagggacttgcccaagatcacataagctggtggcaggccaggctctccccggacacccacttggggctgtcttcttccttggccccaggggccctgcggcccaaacctagggctgggaacctgtccaaccgtgtggctccaacacacacatccttccagggtaactgaggacacagcctcttcttgatgccagggccactcagcaggcctgggccagagagggtgggtgcctagccgtggatcacacagaaagctttggggcagcccagccggtcccggacgctgtaggacacctcccagacgaggtgggagtgtgggttcttcattgtcccaatggcacctggggaaaggggtgtcaggtcagcagtggggcttagtggggcctgtgccaaggctgccctccctccttcccttttcttgctgtttggagacgcaagccttctcctggacctgcagctgtgaccctgggtctcgtgctgctgggaagctataactcccagagggaagggccaaggagtcaggccctggtacatccaggaggatttgggagaacagaagtccggacagagtgaggagttcctggccagtcctggccctgatctatgcgaggccccacccagcccttgaaaggaaggaaaggggagctaatttactggaaggagcagcctgctgtcccacccatggctc

SEQ ID NO: 15751 - DNA, 10374 bp, Human
ctgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatgatgtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctcccagcctccatgccgtccctggaccaccaccctccaggaacctccatgtatttagctatcagaggctctccaaaccctgtcctcgggtttttatggaagcctctggacttatctaaatgatataagctggcttcttgtccccagaaaaatgatgttccattagaacttggatgcaaggttggaggtgcagagagggaaggtcacaaaaattaatcatggatcctgcccttgaggatgtcacagtctggttgggtttaacctggttaaagcagcaacgctaggaggttcctgttgaaaagagaatgaagcatatgggctgggtgcgcacaagcatgagttccgagccggtggaaaaaaaggttctagaaggcctctttcaggaaaaccctcagactttcctttgctctcacaacacaacaatcaacacagaagacttatgtggccaaaggtttgggtttttcccctccacactaagcagcagacaccagctgggtgtcctccaattcaatcccaacagtatctacctggagatagtgtcagatcccataggttgagggctcagtccccaagaccgcccccaccttcagacagcaatggcaagtctgggcctctgaaacttccgaccaacccgcttcaagttggggttcccacgacccccctctttggattatgttaactcactggagcagttcacagaactcagggaaacacattcaccggtttcatataaaggatatgaccaaggatacagatgagatgagcagggtggggaatggggaagaagctccgaggttccttgcctaccctgggccaccaccctccaggaacctctacgtattcagctgtcagaggctctgcaaaccctctcctcttgggtttttatggaagcttctggacatcagcatcccttcccccagggtatatggtgggaccttctctgggaagggacttaagacccataatcagaaatgtggaaggagattagagtcctgctttggggcaggtaaaaggagggcaggagaaggggagagtctgtttcctgaggcctaacacacccaacattatcacagaacattgtaacaagggctataggagttacgacccaggaactgtggatgaaaaccaatacatatatatatcataacaccacagcctcctagaggaaagtgaccgtggaagggtctggtgagagctggcgggagacaagagtgcattccacgcagcccaaaagccttgcgtgctttgagaacagcaggtggaaagtgggtaagcggccactagagggaattaaacagcttcggacagcggactcggcagcgcagcaagaaagctccggaatccggattcgaggcttcccgggctgcaccggaggtctccagcagagggcgcgattccgcccgctggccttaggtcgtcagagcgccggcgcgggaagcgcttccgggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggtgaggtttagcgggccgggggtgtggtttgcgttcaacagagggaaaacgtagaccaggaatagggcctgcaaccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggtaatgcgttcattgttggaaatcacttttccagaatcaggctcagcttcctactactattatggtatttttaccgataaggaaacaggcttctagagtaaccgtaatagcagagagattagaaacagtccaggtttctggctgcaataacctgggtaatagttttatgttttagactaactggctttcctttttatgtatctggatttcttttctaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagtaagtactggtctggggatcccagggcagcaactcccttaaccttgcaggacccatcctgggtcatccccagaagagccttgagttcaggtgtggatactttgataaatgggtttcaagagagtgaaggattcatttggacaacttcgtaagccccaggcagtccattcaccgaacacaaatttgctgtgggctggttactaaggagacaaaaatgtagtgcaaaaaagtactggcagaatcagtttgatctctgatttacagccctgataaaataggacactgctctctaatgtttagtatgggtgaaaatgaaaaatatgtaacttctatgtaacaggatggggttacactgtagtaagggctgccatcagaggtggggagtttgtgacctaagtcagctcccccatcatctcctaaactgttaaagtgtttacacttttctgcattatagtcatccataatctcattacacagataaacatttggcatcttccaggtttttaaattgagcctgggcgcggtggctcacacccataatcccagcactttgggacgggcagatcatgaggtcaggagaaaatcctggctaacactaaaaccctggctctagtaaaaattaaccgggtatggtggcacgtgcctgtagtcccagctactcgggaggctgaggcaggggaatcgcttgaacctgggaggtggaggttgcagtgagtcgagatcgcgccaccgcgctccagcctgggcaacagagcaagacgccatctcaataataaataaataaattgaatttccttcataattgaccttatgatgtgtatgtaatttttttaaatcacagcttttatgagatttaattgagatggcatacgatttacccatttattgaagtttattaaattaagtggttcttagtcctcgcagaattatgcatcagttatcactacctaattctagaacactgttgtcatccccaaacaatacctattagcagtcactcattattcctccctgtagccaccccaggtaatcactaagctactttctctatgggattgcctcttttggacatttcatataaatggagtcatacaatttgtagcttccccccccaaccccacggagtcttgctctgtcacccaggatggagtgcagtggtgcgatcttggctcactgcaacctctgcctcccaggttctgacaattctcctgcctcagcctccttagctgggattacaggcgtgcgtccggttaatttttgtatttttagtagagacagggtttcaccgtgttggccaggctggtctcaaagtcctgacctcgtgatccgcccgccttggcctcccaaagtgctgggatttcaggtgtgagccaccctgcccaccctatttacctttttaattgttgggttgtaaaagttaagtttttctgggtacaactatcttatcaaattaatgatttgtaagtactgtttcccatcttgtgggtttccttttcactttcttggtaatgtcctctgacacaaaagtttttaattttgaggaagttcagtttacctatttttttggtcgcttgtgcttttttatttattttttactttgcttctaattcaccaagtgcaacttgtgcttttttagtgtcacgtctaagaaaccactgcctaacccaaggttgtgaagatgtatgccttaattttttcaaagttttctagttttagctcttagtttaggtctgtgattcattttgaatatggtgtgaagtagggtcctgattctcttgcctgttgcatagtgtgtttttgccctacacaggtcaattgtgtcttctgtaatctcacctaaacaccatttgcgcaaggttttcatagctatttgggggccattaaaaataatgctctgatgaacgtcattcaatttctgtgcccaggagctcagcttagtcagcacagttggaattagacagattttgtcaacctcagactgcctctgttgccatggaaaggtggcttcctggcagagcagctagttagcacaagtggagggcggcacttcatgtactcttttttttttttttttttttctgacagagtcttgctgtgtctccaggctggagagcagtggcgtgatctcggctcactgcaacctccacctcccaggttcaagcaattctcctgcctcagcctcctgagtagctgggattacaggcgcgtaccaccacgcccagctaattttttttttttttttttttttgtattttttagtagagatggagtttcatcgtgttggccaggatggtctcgatctcttgacctcgtgatctgcccacctcggcctcccaaagtgctgggattacaggcgtgagccactgcgcccagccttcatgtactcttgtgtggaatggtgcctgccagagttgcatagcccagcagttttggttctaaaccttatgtcccaagaattttgactcaaactttggaacatgatttgtcaggtgtggattcttgcaccttaaaattgtcactagttggtgtgtctggcctgctttgtgattatgaaacttcccacaagtactctaagggatgagtctctactacagcccttgttctttgtgaggcattcccttccccgttccagggctgctctcggtgtttagcagaggcaccctccatcgcttcttcctttccttgcagggcaaattttctgacggggaaagtctcttaaaggggcttctgttccatctcaccagcctctcaggtccttactttgaccaagggttccctggaaagaccagggtgggcagtgtcagctggctgtggccatgagatgcccagtcagcacatggcagtgagccctggggtactggccctgttgggagtaacccatgcatgacttgtttggctgagataaactgaggccagctttggcttccagcagctggtacatggtaggcacacttcagacctgctgagtcactcaggattggatgtaggcacccagcctagtttgaagttctgcatataattcagccagctaggacagagacattgtttcaatacgcctttttaactgtagcagatttccatgtttatgtgttaacctgctcggttaaaaccatgccttgtctgttttgccttgtctgttttcccttgccgttttagaatcacggtcactttcaacattaacaacagcatcccaccaacatttgatggtgaggaggaaccctcgcaagggcagaaggttgaagaacaggaggtaagctaatactataatcagcttttacctcagttctgacaggctgtgcctggggcttagaggaggagcgtttttctttggtctttcaaaaaaaaaaaattcctctaagtccagtcgcatggctcacgcctataatcccagcactttgggaggccgagacgggcagatcacgaggtcaagagatcgagaccatcctggccaacatggtgaaaccccgtctctactaaaaatacaaaaattagctgggcatggtggcaggtccctgtaatcccagctactcgggaggctgaggcaggagaatcgcttgaacccgggaggcagaggttgcggtgagccaagatcacaccactgcactccagcctggcgacagagcaagactctgtctcaaaaaaaaaaaaaaaaaaaaaagagagagagaatggcaggggcataagagactttaactggatcatgcctactcttcaaacatttcaggaagtgctgtgcccagcctagtaaccagccagtatgagggccacagagtccctagacattctgcccaagagccatcagtacagtgttgggtcatgacctggtgtggacggcgcagctctctggtgtgctgctttcccagccaccccaactagcatctccctgacgttggacccagtctgctcccagagctccgcatcagaggaaaagctgctgctgttattcagccataaggatggccaggttccccagcctttgaccctggtcccttatgaagactcctggaacagtcaagctggaaagagatcttgaaactttaggaaagctttgcagtgtacgggtggaggaaaaggcttggaatgttaagggactgatataaactcagttaattggcacatagctgaggctggtatccacatttcttaactgaaaacccagtgtgttatttaaccaagcagggtgccaacagaagtgagatcaagctcttcatttgggaatagtatggcataagactattcaaatggctacataatatcctaatagtggtggccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatcaatgagaattctacacattagatgaggtctcctgagtccagtttcaattagttcagtagtgtagtttgtcatgatgaccgcccctctttggcattgctggacctctgtcctgcagccttcaaacaactgccctgggaaccatcagcatcaatagtcttcaagctaagatcaaatcctgtagatgaactaatcaaacatcctcaccatcaggaaaccactgaccagaaagattgtattcaaactcttgatagcctggagcttttagagcccagcaggaagatgagactccaaatctacacaagattgaagcaggtatgtatcataggggaggtgcaaaccatgcatgatcagtacgggcagaaaacatgtaaagacatgatcagtaagcacctgagtgtaaaactgcctcccgactcctgggtggctcagcctctccactatgctaaggaatccagtctgtccttaacccatttatgccagaggttgcaaatttttttgtgtgaaaaatcagaccttggcgatgaccttgagcagtaggggatcaataactcccacaggcttagcgttccaataattaaacagtaggcataagtgggttactcttgtttcttaccacttccacaggtaatatgtttggctttctctaaaagacactgtaactctgctaataggcggtttggcatattccatcccaggaccaccacttgagcaccgccacatccgaaacattcctcgtcttgtgatagagtgcaatcttctgtaacccacccctatctttcaacacatcctcagccatctgtcctgagcgtccctacgtcctgacctcactggattctaacacaatggtccttgattcccccttaagtgaaaaccaaaggtctagtggaactagagcattccaaatgtctacctttccaaatgttgaactcaagacctacagaatacaattttgtctttccccctcctcttttttttttttttttaaggcacaatctcgctgtcacccagcctggagcgcaatggcgccctctcagctcactgcaacctctgcctcctgagctcaagccatcctcccacttcagccttccgagtagctgggagtacaggtgcgagccaccacacccagctaatttctgtatttttagtagagacagggtttcaccatgttgcccaggctggtcttgaattcctggcctcaagtgatcctcccacctcagccttcctaaatgctggggttacaggtgtgaaccacagtgcctggctgtgtttctcatatttgctgtgacccccacctcccctcacttacccaacaatggtcttcctgcccaccccagagccggcactgtcaactatgatctccaagactgctgcacagcactcaccttccaaacctcacctcctacttagcttcactgctgctctgagccacagggcactgacggttaggtgagtggataactggggtccataacaattatatgctgagctgaagctgtacacttggcaattaggccatcttccacttaccttttaattccccttctcttcccccgaccagcattttgtctttcacactcaaggggactttcatactcaaggagctgtagactccagctctgctaccattataatctgtgtggatgactcactgttcaccttactaagaagacagaagccaaagccagctgac

SEQ ID NO: 15752 - DNA, 84558 bp, Human
  misc_feature (1)...(84558): n = A,T,C or G
cctgatttagccaaaatgtccaagaacatgtgcattcaatgttaggggattcatggatccctttaggtaggattgctggataaaatacaggtgtccagttaaatgtgagtttcagatgaacaacaaagttttttgttgttgttgttttctgagacagggtctcattctgccacccaggctggagtgcagtggcatgatcatggctcactcaacattctgggctcaagtaatcctcctgcctcagcctcctgagtagctaggactacaggtgcacaccaccacatgtggctattttttttttgtagagatggggtcttgctatgttgcccaggctggtcacaaataagtttttagtataaatatgtcccctgcaatatttgcagagataataattattcttttatgtggggcagggatcctgatcttcaaaagcgccagtgtctaagaagtgatgaaggatttgctgaatgaactgatacacttgagtggctccgaaggcatgagcaaaactattgcacagaacatacttacatttcaaaaccatttgttgtttatctgacattaagatgtgactgggcacttgtaattttttttttcttttttttgagacggagtctcgctctgttgcccaggctggagtgcagtggcgcgatcctggctcactgcaagctccgcctcccgggttcacgccattctcctgcctcagcctcccgagtagctgggactacaggcgcccgccaccacgggctaattttttgtatttttagtaaagacggggtttcaccgtgttagccaggatggtctcgatctcctgacctcgtgatccacccgcctcggcctcccaagtgctgagattacaggtgtgagccaccgcgcccagccttgtagttttttacttgctaaactggcaatctgatcttgaggccatccacagctttcctaggttcacagtatagagtaagaatttatatagactgaagaagattaagagtgtttattttttgtggaattatttaaccacttaacactgaagtaccaggtgaagggtaaattgaaataactctttccacttcttttagctctaaatatcaatcaggacattattattatggctgttttctggacttacatcgttatagagtgactatgagtttgatagtgtcaccaacaattatggccaataatttccatggtaaattcctagaacagaaagatgttgcatcaaattcttgaaatcgcagacttaggaaattaagttacataaacagcagatgttcaggctgaggaaggaaagaagctgaaacaagtactcccaattattcaacaatcccttgaagccgccactgtaactctgggaattgaaataccattaagtcctatcacggccaccacttagccttttttctcttactattatttgtaattccataatcaagctagttttcctacgaagttctggggcaggagttttcttttttcggaaatttcatttggataaagaaacatggtcaaaaagttacaacggtgcaaatggttatacaaagaaaaacaagtctctcttctatcgttacccctagttcctggaccgcgggttcttaacttgggttaggaactgcagtctaagggtttctagagtaatgtgaattttctcaatgcataattttcaatgtacagataattttgctcgtttgtggggagaggatccaaacttttacctgagcctcaaaagggtccgtgatgcagagaacctgctgaagtaaccgatggccccgagtgactcggaacagggggcgcagatatcctgtaataatttgtccccgtgtgaaaagtctacccctatccactccactccactccactccggggccgcttggaagggacgctctccgtgggaggcatccagctcttcctaagttttccgcctgccgcattcctcccctccggcgcgccggcgtgcgcttacgtcatgacgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaaggtatgcgccgtgggcctcctctctgctctcctccagcaaccccgggggccgcacccccttccacgtctgcgaacccccgcagttaacccctcaccccttccggcagacttgcctcccgaaacgtctggtgcggtgtctgcattgccagtggagaagcaccccatctccctatgccctgtctcttaagctttggggccttgaagtaatcttggggagtcttgctccctgttggtgttcccttctacacagtggccctcttgggtaggccttttgcgtggacttactctatcgcgcccctgtcccacctagtcctttccttctagcccgtatcttcaggatattttccatcctctccttccaattaagtgtcagcatcagctggacttttttccgtgctcctccccccacccattcctactttctcatctcgccgccttccttccccgagtgttttggtgtttttgcttcgtgttccttcgtttctcctttcttttcccaattgggaaggagttagggattattggaaataatctgtgtgttttatttgcatattctttaaagctttgatttttttgtgggagaggaggggctctatacttgaattagggattttgtgaaaatgggagtgctgatcaactgtttgaagaggacagggagagatctttactgaaagaaaaaaacactttagattatgttcctgtgtttgaaagttgcaatcttgcagcattcttaaatcactccccctcaaaaatctgaacagcaagtctcccaagccactctccaaggagtttcaagggtaagtgtccttagatgtggactatttttgcagtgttttcagagtgtggagaactttatggactcagagcctgcccttttctctcccccacatttgaatgtgaacactggatttattattcagtcttccttgtcttgaatccgcgtcgataactcctagtgtccagtagccacccatgcaaaatgtgactaaaagtagaatgtaatttattttttagaccttaaatacttcctcttgatctgtaagttggctggaacagtgtaaactgatattttaacagatgtttatgttcttacgtatgtacagtgttttgtggcagttgttttattgggaagattgcctgctttctccacccctagatttttttttttttttttttttttttttcagaattagcagttgatgggctgcgttctactaaatccagctgctttgcaccaattctaacaattaaagtggggtttcccccctaaatatttggagaagattcatttaggtcatgcgtattattattttggatttcgagaaaaagctcccttttttcctaatccctttgatacattgatttacttttgtgtattctaaggaaattttgttcatttaagatacattcctccccaggaaggacaaattagatttgtctttctcagcctgggaaactgcagctttgtgtgtgctctctgtccattttattaaatcatgtgtaatcttgtacctcatatgtaatctctcagaggaaatcattgggaatgtaatccaagtgtatttactagttgaattcgttcaaaatacttgaatatcttttagtaactttcacttctaattgaagcttttcatttgaagattattagtatgaatagatggtgcttttgttagaatttctgtttcacatagttcacacagttttaatattgctcctttttggtacacttttacttcttaatagttgtatgcttattgggagtatggcactgtgctaagatgagggaagtgttaaacatgtgcctgtaactatgttgtgcttttatgtgttattttgtttaatcttcagaattaaactgtgaagtagagtacagtataaccttgctttattggtgagaaagttaagtaatttaattaaggtctcaaacctgatatttagttcctgagttccttgctcttttacttagatatctatcttaagatagtagattattttaatgaaagatattataacactaatttttttattagcttctatggaagtggagtgaaagtcagtcccaggactctattctaatctttaatggagatgtaagaagaaattattctttttattaaaatttaaaaaaaatagagatggggtctcgctgttttgcccaagctggtcttgaactcctgggctcaagctatcctcctgcctcagcctactgagtagctgagactacaggcatatgccaccgcacctgacttttcttccttttaaacactattagcatatacatataagaaactttttttgtggagacaggatcttgctctgttgcccaggctggagtgcagttgtgatcatagctcaccgcaaccttgaacccctgggcttaagcagtctttccatctcagcctcctgagtagctggaactacaggtgtatgccacccatgcctagctaatttttttttttttaatttttagtatagatgaggtcttgatatattgcccaggctggaaaaactttttaaagcaatataactgcacacataaatataagatactcaccccctgcccaacttgtgaaaattttaggaggcttactgtttccaatttccaattttctgcactttaaagccaaggagaaactcataattacatctctcttgcagtccaaatttccatcagtaggcatagtcatagacaaaattggagtatttgtggaatcaaatttccccattctgcttgtttggtgtactacagtatgactgtgttaatttttgtaatagcttcagataaaggcacaatcgtaaagcattaggagatggggttatggaatgaatggaaggtaaagaagcaggaatgttgactgctgtataagcagggaagggagagcatagaaagggtaaaatatgaaatgttttttctttttttttaaaaaaaaaaagaatggaagacactagaatatatttgttggctgagtggcagaaaccaagagaatgaggttgagtatccaagtgtggtgggaaataagttacggagcaaagtccctgagcaggaacatgagttgatgagtcttgcctgtttttggtctttcctccttcaccgtgcataaattaaggtattatccttatattggagttggggaaagaactcttcttctaagatcagaacaaaagaattaaagatgtaaaggcgcagggctcacactcataattccaacactttgggaagctgaagcagaaggatcgcttgagcacaggagttcgagaccagcctaggcaacatagaccccttctctacaaaaagtagaaaaagttatccaggcatggtggtgcatgcctgtcatcccagctactcgggaggctgaggtgagaggattgcttgagaccaggaggtcagagcctgcagtgagctgtcattgtgccactgcactccagcctgggcaacagagggagatcctatctcaaaacaaaacaagtcgttaatataggtaagtttgtaagaatgattgtcatgaattaggaggtgagttcatttgctgcgggtaagtgataggagtggtagcttttatacaggaagtctaaacagaagttgggaatgtctactgaggtgtatgagaagggaaggtgactaaaaatgtgtaaaagaatagttaataaaaatcagaaccctacacaatacagtcatgtgttgcttaatgacggggatatgttctgagaaatgcattgttaggcgatttcatgcttgtgggaacatcagagagtgtatttacacaagcctagatggtatagtctactacacacctaggttatgtgggatagcctattgttcttaggctacaaactcatatagcatgttactttactgagtaccgtaggcagttgtaacacagtattaagtgcttgtgtatctaaaccaggggtgtccaatgttttggcttccctgagccacattggaagaagataaattgtcttgggccacacataaaatacaataacgatagctgataagctgaggaaaaaaaaaatctcataatgttttaagaaagttaacgaatttctgttgggtctcattcaaagctgtcctgggggctaggtgcagtggctcatgcctgtaatcccagctcttagggagacagaggtgggaggatagcttgaactcaggagttcgagacctgcctgggcaataaagcgagaccccattcttcacaaaaagaaaaaaaaaagtgtaactgaaagctgacctgggccacgtgtggcccgctggctgtgcattgggcaagcttcatctaaacatggaaaaggtacagtataaaagataagaaatggtacacctgtatagggcacttaccgtgaatggagcttttaggactggaagttgctctggtaagtcagtgagtgagtggtgagtgaatgtgaaggcctaagacatcactgtacactactgtagatgttataaacagtgtatacttagacgactataaattaatgttaaaaataaagtaattcaactacaatgtctctaggcaataggaactttttggctctattataatcttatggggccacctttttatatgcagtcggttgttgactgaaactttatgtggcatgtgatcataatgcttggattctgaaagttttctctccaagggcgtgcaaccattttggtataaaagcaggtaagatgaagtgaaagaattgtgaggcagatggagtgatatatgcctgtagtcccatcctagctactcaggaatctgaggcaggaagatggtttgagcccagaagttggaggttatagggtgctagctgcggtcgtgcctgtgaatactgcactccagcctgggcaacacaattatctcttaaaagaaaattctagaactctatacagagtgaaaggaaatagagacggggctgtgttcttattctaaagaatgaagtttatggccaggtgtggtagctcacacctgtaatcccaacagttcgggaggctgagccgggaggatctcttgagtccaggagttcaagactggctggggcaatgtagtgagactccatctctttaaaaaaatgaatgaagtttatgatctttttattttaactactgaaggtctattttgtgttttttccaaatacaaagtgtgccgtagagttaaactttgtctgggtgaagtgtttcagcagtgtgttctatgtattgttttcacaatcttaatttttttttttttttttttttaacagagtcttgttctgttgcctgggctcgagtgcataggcacaatgtcggctcactgcaacctctgcctcctgggttcaagtgattctcccgcctcagcctcccaagtagctgggattacaagcacctgccaccacatccagctgatttttgtatttttagtagagatggggttttaccatgttggccaggctggtcttgaactccttacctcaggtgatctgcctgcctcggcctcccgaagtgctgggattacaggagtgagccactgcgcccggcctccttaatgatttttttaaaaattaaagtattatgctgaaaagaaaaaacaaaataaaaataaataccatgctgaaaaccatactaattaggttctgatttaggatcggagttaattttttctttttctctgtatatttcagttgtatagctacatacagcctgaactaacattcagttttctgagaatttaaaaaaatacactgatggccgggcatggtggcttatgtctgtaatctcagcactttggggccatggtgggaggattttgcttgagtccaggagttcgagaccagcctgggcaacatagtgagatcccatctctagaacaaagaaaaaaattagccatgtggtgggtgttgcatgcctgtagtctcagctactcaggaggctgnnnnnnnnnnnnnnnnnnnnccaggaggctgaggttgcagtgagctgtcattgcatcaccgtactccagcctgggtgacagggtgagaccttgtctcaaaaaaaaaaaaaaaaaaaaaaattaaatttggctactaaaattataaaagtatcagaataaattattgggtcaatattttgcagtgggaaatgaccaaaatttcttctttaaagaaattgtttttctttcttttttaagagacaagtcctccttctgtctcccaggctgtagtgcagtggcataatcatatctcactgcaaccttggactcttggccccaagtgatcctcctgcctcatcgtcccgagtagctaggactacagatgcttgccaccacacctggttaattaaaaaaaaaattttctcctttctgtaggagataacaacaaaaaaaaccttaaaaattttttttttgtagagaccgaccgtatctcactttgttgcccaagctggtcttgaaccttagcctcaagcagtcttcccacctcagccccgtaatgtgctgggattacaggtgtgagtcactgtgcctagcctaaaaaattatttttaaggtaatgtacaaatcatgaaaatgtcaaacactataaaaataagtggccaggagcagtggctcatgcctgtaatcccagcactttgggagaccaaggcaggaggattgcttgagcccaagagtttgagaccagcctgggcaacatagggagacactgtctttaccagaaaaaaaaaaatttattcaggtgtggtggtgcatgcctgtggtcccagttgcttgggaggctgaggtggaaggatcatttgaagcttggcaagtcgaggccgctcagtgagctgtgattgtgccgctgcacactagcctgggcaacacagtgagaacttgtctcaaagggggggaaaaaggtaatgtaaaaataattttaaaatctatctttacctcttgtcttaccttgccaacactgtaatgccatcttggcatgaagaaggcatttctaagaatgaaaccaaagcccagaaggaaaaaaaagaaattgatgtgttggaatgcattaaaaagtagagcagggagcagtggcttactcttgtaatctgagaactttgggaggccaaggtgggaggatggcttgagcctaagagttctagacctgcctgggcaacatagggagaccctgtctctacaaaaaaattaaaaattagccagacatggtggcacatgcctacggtcccagctactcaggaggatcgcttgggcctgggagattcaaggctgcagtgagtggttatcatgacactgcactctcagcctccagagtgagaccctgtctctctctctttcacacacacacacacacacacacacggctgggcatggtagctcatgcctgtaatcccagcactttgagaggccgaggcaggcagattgtttaagcctaagagttcaagactagctgtctctctctcttacacacacacacacacacacacacacacacacacacacgcacgcacacacggctgggcatggtagctcatgcctgtaatcccagcactttgagaggccgaggcaggcagattgcttaagcctaagagttcaagactagcctgggtaacatggcaaaatggtgtctcaaccaaaaacaataaaaaataagctaggcatggcgacatacacctgtagtgccagttacttggcagaattgcttgagcccaggatgcggaggttgcagtgagccaagatcatgctactgcactgcagacaggatgagactgtctcaaaaaaaaaaaaaaaaaggaaattgtaagaacactttaaaaaaacactatgcagatgacagcatttgacagatgaagggcatgttttctaatacagaaagatctaatactaatcagtttgaaaaaggcagctaaggcaactaattcatgtcccaaaaaccagtttacagaagaggaaatatgaatggccaatgaacattaaaagatactcaactgaaatacaaattcaaatacaagataaagccagatgcaaggtaatcatgacgatgaagaaagaaaatctggaggaattcaacttgttacctggctataacaattaaggtaatatggtattggcacatggattgacaaatagaccaatggatcaaaatcgacagtccagaaacagactgacacatatactatcacctgtattatgataaaagtgagacagcactatgatagggaaaggaaagtcaaattaatggtattggttaattaatttctgtatcagggaagaaagtatcttgactttacctcacaccacacacaaaagtcatttccagataaattgctgatctaaatatgaaaaaagttttttagaaaaaaattttatgtcagcaaagattaatttggatctcaaagtggttaaatataaaggaagtgtgataaattggtgctatattaagatcaagaacatctcatcaaaagatatcattaagcaagtgaagagtcaagccacagagtgggagaagatatttgcagcacctgtatctgacaaaggactcattgtacacctaaagaaagaactgtacattaatagcagagaaaaggcccaacatggtggctcacgcctgtaatcccagcactttgagaggccaaggcaggggatcacctgaggtcaggagttcaagaccagcctggccaacatggtgaaaccccatctccactaaaaataaaaaaaattagccaggcatggtgacaggcacttgtaatcccagctacttgggagtctgaggcaggagaattgcttgaacccaggagacggaggctgcagcgagctgagatcatgacattgcactccaggctgggcgacacagcgagaaaaatactcagttttttgtttgtttgttttttgaagagaatttgaataggcatcccaaaagagaatattcaaaaggccaaacatttagaaagaaactcaaccttattttgtcttcagagaagtactgttttactgtacacccatcacagtgactcaatgaaaatgttagcaaggatatggagaaataaaaaactctcatacattgttaatgggaatataagttgatatgccattttggaaaagcagcannnnnnnnnnnnnnnnnnnnaactacttgaaataatatgaatgaatcttgcaaatgataatgagtgaaataaaccagtcacaggaatatataccaggagttcctaaactttctccctttataacccttggttcatggcaaccccaggccaaaagaaatacctgacagttctgtttattaagtagttagatccaaaaaacttcatattatttatgtcctaacaacttaagatctgtttcttaaaatgcacaaaaattgaacgaaaaaactttcattcttagacaaccacattaactaatgggatgtttgtttattgggcactgtacagcgtctcaaaccttggaatcagattggataccaccactctcatctggttttttttgtttgttttttttttgtttttgttttttgagagggagtctcactcttcctccgaggcaggagtgcagtggcatgatctctgctcactgcaacctctgccttctgggttcaagcagttctgcctcagcttccccagtagctgggattacaggtgcgtgccaccacacctggctaattttttatatttttggtagagacgggttttcaccatgttggccaagctggtctccaactcctgacctcaagtgatctgcctgtctcggcctcccagagtgttgggattacaggcgtgagccaccgcacccagcttcatctgatgttccttattgactttttatattaactctttttatcacagcaaccactgaaaacacagcttcataaagatctcattgaaagcagtgtagtataccagtctagtagttggtatagcgcattgcagatgctgaatgttgtttctctcaaattaagaatatctagcagggcctcagggcaccttggtgcacagtttggaaactggatgtataatatatgatctcatttatatgaagttcaaaacaggcaaaatttagttgttgaaagttaggagacgctattcttggacagtagtgacgatgcagggacagatatgaggggagccttctgagattgtggttatactttgttattatctggatgctggttacaagtgaaaaatttatcaagcttcacatttaaaatatgagttgtgcgctcttctgtatgcatgttatactttgatttaaaaatgttaaaataggctgggcgtggtggctcatgcctgtaatcccagcactttggaaggccagggtgggtggatcgcctgagttcaggagtttgagaccagccttgccaacatggtgaaaccccgtctctactaaaagtacaaaaattagccaggcatggtggctggtgcctataatcccagctacttgaaaggctgaggcaggagatctgcttgaacccaggaggtggaggttgcagtgagctgagatcgtgccactgcactccatcctgggtgacagggtgagactctgtctcaaaaaaaaaaaaaaaaaaaaatttaaaataggccaggcgcagtggttgatgcctgtaatcccagcactttgggaggccgaggtgggtggattacttgaggtcaggaattcaacaccagcctggacaacatagtgaaaccccgtctctactaaacatacagaaattagctgggcatggtggcggatacctgtaatcccagctacttgggaggctaaggcagaagaatcacttgaacctgggaggtggcagttgcaatgagctgagattgcactgctgcaccccagcctgggcgacagagtgagaccctgcctcaaaaaaaaagaaaagttttaaaataacatcagccttcacctgtcagattgtcatgctttaaaaattcaaatcactcataccctttaaccaacaatacaatttaaagaatttttcttccaggaatacttgttgaatgtgtggaaaatcctgttagaggatattcagtgtttgttcataagcagcattgtttatgatggcaaaaattgaaaacaaccatatgctaatcaggaatggaatatcatagtgcatttataaagaatgagtattctatgtatactagagatgccagaacatagagcaagtagggagaataaaaagtttgttacaaagtagtgtgaatagaatcatcttatgtgtgtgttttgtttttgtttttttgatagaaacggggtctggctctgttgtccaggctggtcttgaattcctggcattaggcggtcttcctgccttggcttcctaaagtgctggtattataggtatgagccaccttgcctagcctccattgtgggttttttgtttgtttgttttgagacagggtcttgctctgttacccaggctggaatgcagtggtgcaatcaccacttactacaacctccacctcctaggctcaagtgatcctgcctagtagctgggacttacaggtgtgtactgcatgctcagctaatttttgtattttttgtagagatgagattttgccgcattgttcaggctggtgttgaactcctgggttcaagtgatcttcctgccacagcctttcaaaatgttgggattataatggtgtgagccaccatgcctggctgtgttttttttttttttttttttttaatgtggggaaaatatgtatatgtgtttgcattgaaagaagaatataggggaacacaacaaaattttaatggtgtttactccaggggtaggatcgcaattgctttttactttgtacatatatgctctattttctttttttttttctgagatggagtttcactcttcttgccgaagctggattgcagtggcatctgcaacctctgcttcccaggttcaagtgattctcctgcctcagcctcccgagtagctgggattacaggcacccgccaccacgcccggctaattttttgtatttttagtagaaatggggtttcaccatgttagccaggctggtctcgaactcctgacctcaggtgatcctcccgctttggcctctcaaagtgctgggattacagatgtgagccaccgtgcccgccctcaaaataaaaatgtagaaaacattgattttggtggatctatcttgacaaccatatttctccgtgagaagcttcagctgttcctccttcttcgtgtccatcttctgaaatgccctgttggcattatagtacaaaaccacaagttatctgtcacaaaaattgaatcccgataggtgatcacaagcattcttggcaacaaagatgtcttcatagaccacataagctgttcctctagtttcaggtgtgttttccactctgatttgatgaataggtccatatttcccaaatatacattgattgagctgtgattgtgtatggcaaatttcttatatacaatatctgatttacttcaggtggaagtcgaatgctcgccctcttggccgcttgcactgctgtcttggcaggctgatgaggttactgtagcaaatactgaaattcttctggacaccttccgagctcgctgggtttcaggcgctgcacagcatcaggggtgggacatcaacacccaagtactgctggaacctgttatagcacccacggaatagcgctgtctcacgccaagatgcgaccatgtagcgttcccttttgaataggctcccagggtcaaaaaaaaaaaaaaaaaggaaaagaaaaattttttttttaagtgaagactttcagacttatttctgaaactgtatactagatattcagcattctttttttttgtcgtttcttttcctttccttttttttttttttttttttttagatggagtctcactctgttgcctaggctggagtgtaatggtgcagtctcggctcactgcaacctccgcctcctgagttcaaattattttcctgcctcagcctcctgagtagctgggactacaggtgcgtgccatcacacccgactattttttgtatttttagtagagacggggtttcactatgttggccagtctggtcttgaacttctgacctcgtgatcctcccgcctcagcctcccaaagtgttgggattacaggtgtgagccaccgcacccagccctattcaacattcttgaggtgctaaccagtactgttaaaataagtaaaaagccagcaaagtcaactgaaaaactatagcagtaagataattcagtaaaggggctgattacacgtttataattaaaaattcaatttttctatatgcaatataggaaggattatatctgactcaaaataataaaacacnnnnnnnnnnnnnnnnnnnntctttttttttgaggcagggtctcactctgtcgcccaggctggggtgcagcagtgcaatctcagctcattgcaactgccacctcccaggttcaagtgattcttctgccttagcctcccaagtagctgggattacaggtatccgccaccatgcccagctaatttctgtatgtttagtagagacggggtttcactatgttgtccaggctggtgttgaattcctgacctcaagtaatccacccaccctcgccctcccaaatgctgggattacaggcctcaacaactgagcctggcctattttaaattttttcttttttttttttttcaatggagtcttgctctgtcgccaggctggaatacagtgatgcgatctcggctcaccgcaacctctgccttccgagttcaagtgtttctcctgcctcagtctgctgagtagctaggattacaggcacacaacaccacgcccagctaatttttgtatttttagtagagacggggtttcaccatgttggccaggatggtctcgatctcctgacctcatgatccacccacctcggcttcccagagtgctgggattacaggcgtgagccaccgcgcccggcagaaagtgttttcttatagctatactgccctatccttttgtctcatggaaacacttccgattttcaccacatattggtagtgaaacttcaagaagagaagctgagagacttatcccaaatatagagattgctggtatatattgtgttatgtatgactggttatcactgactaggccttacatctaactagatttttgttttgaacttccatttgtgctgtggtaannnnnnnnnnnnnnnnnnnnggcgtggtggtgggcacttgtagtcccagctactcgggaggctgaggcaggagaatggcttgaacccgggaagcagagcttgcagtgagccgagattgggccactgtactccagcctgggtgacagagcgagactccatctcaaaaaaagaaaataataataataataaaaaaacacctcaaggagtgagaccaaaaagacacccaaaagtcttcaataaatgtagaagagccaatattttgttcctagattggaagatttggggtttcaaagatgtaacttttcccagaatctatatattcagtgtgaacttaatcagaatccccagaacagttcttagaaccgttaaaaattttaaaaatgtgtagtgggaaaaaatatatctttatataatagaggattaaagtttattaagcatattcaaaactcttgcaaatcaataagaaaaggagaactggaaagaagtgtgccattatgttgacagtgattttcctctgtagatggatggtaaaaatcagcaattatttttgaaatttccctgcattttctaatgtttttaaaaacataaatgctgaaatcagaggaaacaagtgttttacagttggttatctagaatacagaatgagttttcttatagagacaggaagtgttttcttttttctttttcttttttttttttttcaatggagtcttgctctgtcgccaggctggaatacagtgatgcgatctcggctcaccgcaacctctgccttccgagttcaagtgtttctcctgcctcagtctgctgagtagctaggattacaggcacacaacaccacgcccagctaatttttgtatttttagtagagacggggtttcaccatgttggccaggatggtctcgatctcctgacctcatgatccacccacctcggcttcccagagtgctgggattacaggcgtgagccaccgcgcccggcagaaagtgttttcttatagctatactgccctatccttttgtctcatggaaacacttccgattttcaccacatattggtagtgaaacttcaagaagagaagctgagagacttatcccaaatatagagattgctggtatatattgtgttatgtatgactggttatcactgactaggccttacatctaactagatttttgttttgaacttccatttgtgctgtggtaacatctcctaccactaacaaaatcatactatcttgaaaattatgccattgacctataaagtgaggtatagagttggagcatctgggtaaatacacataagttcattcttttaaccattgggggggaaaactcttaatttcttgtttcatggatgattgacctagtgacatcatcatcataaatggacagcatatttaagttttagtaaagggttgcccttttatttgaatattatctgaaatgacactttaatgaagcaacagataaaggacattaaatgtaaggtataaagtacaaagaaaaggaatatcaatattctaatataatgtttttcagagtacatttcagatgatttttttttccccagaaacaggatctcactttgtctcccaggctctggtgtagtggagcaattatggctcactgcggcctcaacctcccaggctcaggcaaacctcccacctcagcctcccaagtacctggggcacacgccaccatgcttggccaattttttttttttttgtagtgatgggggtctccctatgttgtccaggctggccttaaactcctgggctcaagcagtcctcccaccttggcctcccagagtgctgggattacaggtgtgacccaccacgcccaacatcagatgagttttttactttttaaaattatttgttttgaggcaggattttgctgtgttgtccaggctggagtccagtggtataatcatgactcactgcagccttgaccttcagggctcaagtgatccttccacctcagccacccaagtagttcagactacagatatgtactaccacgtctggctaattttttattttttgtggagttgggggtcttgctacattgccccggctggtctcaaactcctggtctcaagcaatcctcttgtctcggcttgccaaattgctgggattacaggtgtgagccactgtgccagccttcagatgagttttgagatcagagcataataataaatgaatcatgtaagtgacgataactcatgtttgttaaatgaaacatattcttttatgttagaggtaaaggatacatttacaagacttccttttttaaaaagttaaatacatacagaaatagaatagaataatgaattcctatgtctatcacctagctttaacaattatcgattctggccagtcttgttactgaatctgttctcccattcactttcccctttcatgtgatatttggaagcaaatctagacatcagatgatttctttgttgttgttttttgtgttttttgagatggagtttcactgttgttgcccaggctggagtgcaatggtgcaatctcagctcaccgcagcctccacctcctgggttcaagcaattctgcctcagccccccgggtagctgcgattacaggcatgtgccaccacgcccggctaattttgtatttttagtagagatggggtttttctatgttagtcaggctggtctcaaactcccaacctcaggtgatccgcctgcctaggcctcctaaggtgctgggattacaggcgtgagccaccacacctggccaggtaatttcatctagaaatattttagtaactaccacactattataacacctgaggaaaatgaacagtaattccttaatgttcttaaatgtacagtcactgttcaaattttcagttgtttcaaacatgttttttttttttttgagacggagtctcgctctgtcgcccaggttggagtgcagtggcgcaatctcggctcactacaacctccgcctcccaggttcaagcaattctcctgccttagcctcctggtagctgggactacaggcacacaccaccatgcctggccaatttttgtatttttattagagatggggtttcaccatgctggccaagtttgtcttgaactcctgaccttgtgatccacctgcctcagcctcccaaagtgctgggattacagccatgagccaccactcctggactcaaatgtgtatatttttatagtttgcttgtttggatcaggatgcaggtaagttccacatgttagcattttcttgatacacctcttgagtctctcttgatctatagtttacctttccttctgttttattttctttgcaatttacttgttaagaaacacattcgtttgtcctgtagactttaaagagtttcctgaagtctagattttgctgatcagtatatacagcattttcatctcccctcagaaacacctgggtgtttttgcatttgtctgtctggggacttcatgggtttcactggtttcaggctagtttttaatgccagattctgagtttggggtctgtaaatcatctaggtagtatcaatttggactaggtacccatgtgtgtcctggactggaggtttcagtttttcataggagactgctaaagctagaggagatgttctagacttctttaggcaggtagttagacttctttaggcaggtagttaatctccaggtctctttgcttacaggatatgctgcctcagctcctttctggtctttgatactctagcttgaaaccattcagaggtataaactactctgttttccttctttcctagctgctttcaagtttgtgttttcttaatttttggcaactgtggagtttctatgcttggtttcaatttagctatttatccaaaagttattttgtgattttttttaaatatatatccagcctttctgtgtccgaaaaagggttgaaaggttagcatctttgtcagtgctatgtgccatattgctagaagtgttactagcaattcctctgcatctgaagttcttggagtggatattttatctgtattcttaaagcagtttgcctaccttcatcatataatctgtgaacattatttttctgttctgaaagattctaaattttttgaaatcagagaacagttctaccaaaaactacacaaattagccaggcattggtggctcgcacctgtagtcccagctactccggaggctgaggctggagaatcgcttgagcccaggaagcggaggctgcagtgagctgggatttcaccactgcactccagcctgggtggcagagtgagaccctgtctccaaaaaaaaaaaaaagaaggaaaaaaaagaaacaacttggctgggtgtagcagggtgtgtctttagttgtagctacttgggaggttgaggtgggagaatctcttgagcccaggagttggaggctgcagtgagctatgatcacgccactgtactccagccaaggtgacagtgagaccctgattcaaaaacatgaaaatgaaaggtgcttatagtctgattggagaggcagtagtcaactgtgtgaaagtgaggtttttcccaaagtatcaaatttaccaaccgggttaatctcgataatttcagtaaataaggatgtaatataataacaatactaaataattgattccctaattataaactccagagtagagactgtgtcttgaatttttttgtgtcttctgaggttctgagttccatccaaagtaattaagtaccaatttgggttattcatttagaaaatatttaagggggccaggcattgtggctcatgcctgtaatcccagcactttgggaggctgaggtgggcagctcacgtgaggtcaggagttctagaccagcctggccaacatggcaaaatcccatctctactaaaagtataaaaattagccgggcatggtggtacatgcctttaatcccagctatttgggagactgaggcacgagaaccacttgaacccaggaggcagaggttgaagtgagtcaagattttgccactgcactctagcttgggtgatggaatgagactctgtctcaaaaaaaaaaaaagaaaaaagaaaaatatttaatgtggcaaggattgaaaaactacttactgggtactgttttgctacttgggtatgggttcacttgaagcccacaccccagcattatgcaatataaccgtgtaacaagcctgcaaatgtacccctgaatctaaaatttttgaaaagagaagaaagaaaaaatttttatttttttgagatggagtcttgctctatcgccaggctggagtgcagtggcgtgatttcagctcactgcaacctctgcctcccaggttcaagagattctcctgcctcagcttnnnnnnnnnnnnnnnnnnnncgttctgttgccaggctagagtgcagtggtgtggtcttggctcactgcaacctctgcctcccaggttcaagcgattctcctgcctcagcttcccaagtagctgggactacaggtgtgcaccaccatgctcggctaatttttgtatttttagtagagacagggtttcaccatgttggccaggatggtctcgatctcttgacctcgtgatctgccccacttggcctcccaaagtgctgggattacaggcatgagccaccgcgcccggggggaaaatgttttttttaaaaaagaaaatattgaatgtatatcttgtactaggcactgtgctaggtattgggaatatagtggtgtctgtagtcacctcatagaatgtagagtgtgatggaataatatatttaacaaatgactgtttaagtgaaagcatgcatgtcttaatgctactgtggaggtaaaaaaaacagtgtgtcatgagaaagtttaacaggacatagaatttagattgctgagtcaggggaagagctctgtgaggaagtgacatagtgtagttgagaggatttggatgagttataaactaaccaggcaaagaatcatgttaccagtgcttcatgtagaggtagtagcatatgtgtgcaaaagttatgagccaaaagaaagctaaggtggcaggagtgtaggagacagggagaaacaatagtaaacgatgaggtcagaaatataggcaggcgtcaaggccaggggcagtggctcaggccggtaatcccagcactttgggaggcctaggtgggagtatcacttgagcccaagagtttgtacaccaggctaggcaacatagtgtgaccccatctctacagaaaaaatggaaaaattagccaggcatggttgtgcatgcctgtagtaccagctactatctggggctgaggtgggtgcattgcttgagcccaggaaggagattgaggctccagtgagtcatgatcatgccactgccctccagcttgtgagacagaggccagactgtctcccagggagaaaaaaaaaagaaaggccaggcatggtggctcacacctgtaatcccagcactttgggaggccgaggcaggtggatcacctaggtcaggagttcgagaacagcctggccaacatggtgaagccccatctctgctaaaaatacagaaattagctgggcatggtggcgggcgcctgtaatcccagctactcaagagactgaggcatgagaattgcttgaacccgggaggcagaggtagtgatcccaagtggcaccactacactctagcctgggcaacaagagtgaaactccatctcaaaaaaaaaaaaaaaaaaaaaaaaaaaccgcaggggtcaggtggcttttaggatctcagaggtaacattaataaagattttggattatgggccaggcgcgatggctcacacctctaatcccagcactttgggaggccacggtgggcggatcacaaggtcaggagatcgaaactatcctggctaacaccgtgaagccccgtctctactaaaaatacaaaaaatgagctggccatggtggcaggcgcctgtagtcccagctactctggaggctgaggcaggagaatggcgtgaacgcgggaggcggagcttgcagtgagccaagatcgtgccactgcactccaacctaggcgacagagcgagactccgtctcaaaaagaaaagattttggattatgttctacattgggggtgccatttaaataaaggttttaaacaagagaatggcatgatatgagttacttttttacaagattattctggttactgtgtggaccgtaattttgagggagacaagagtggtaatggagggactaattctatcaaacctttacagtaatctaggtgaaatatttgagatattaatcctataccatatatataagcattgtattatttcagatttttatatggatgcatatataatgtagatatacaatttagaagcaaaagtggaattttattacacgtttcaggaacttgttcacttcatataacatggccatttttccttgataacaaccccttttcatttctgaagttttggctatttaaagactctctgagaaagttccaaacatgaatgagatgcacaggtttcattggtatgtgtgagtgtgtgcatgcaattatgtgccttcagtttttcttagaacataggtgttttttggttggttggttgtttttgagacaagagtctcagtgtcacccaggctggagtgcagtgcgcaatatcagcttattgcaacctccgcctcctgactttgtgcaattcttatgcctcagcttcccaagtacctgggacacgcagccatgccgggctgatttttatatttttggtatagtcagggtttcgccatgttggccaggctgatcttgaattttatgtgatgtgatgcttaggaaagcaatgttagcaggtagcttttaatactgctatgatataattttttaccatttaaaactttgataaatctggaattcctttttgttacattttatcaggtaggcatctttgtttacccatttttatgcactctttattaagtaatttttttctttcctcagtgatcttaaaatgcttcttttgtcatacgttgatatttatatacactaaggtctgtttttgaactttgcattttgttctgttggttgatctatcttcataactgtataatactgttttaattgtattttattatctgtttttatatctggtgggtgataatttgcctacttctagaaataagcttgttttcccttttgtttaaggtaggaacagctgaaagtggttgatatagccctttaatagcttcattatgctacgggtacataatataaactaaaataagttttaaaaatcttatatgagaatcattactggaacaaaaagtatcagtttcctctcttctaagctctgtttcataagatgtttgaatctatgaggggattaacctttaaatcttccatcatttctataaaaatattttaaattgtccatttaatacttttaaaaatttccttttatattatcttcaagaggcaatatagggtaagttgttaagaacatggatgtagggacagactgcctgggtaagattcctgctttgcccatcctaattatatgattttgagaaggttatttaactgtatatgactcagtttcctcatctgtaaaaggataaaatgaataatttatgaaaagcactgacaacagtgcctgacacataaaagattagaagttattttttttctggattggtatccaaaaacccctttaattcataaaatgtcttaatttcaggccgggcacggtggcagacacctataatcccagcacattgggaggctaaggcaggcggatcacctgaggtcaggagttcaagaccagcctggccaacatggtgaaaccccatctctactaaaaatacaaaaattagctgggcgtggtggcgggcgcctgtaatcccagctactccagaggctgaagcaagggaatcacttgaacctgagaggtggaggttgcagtgagtcagtcacgccactgtactccagcctgggcaacaagagcaaaactctgtctcaaaaaaaaaaaaattactttgcattttttagataaacttggtaaggatgagttgaaacaaattaccctttcccgtcaatttaaatgtgagcgcattttaactagagaaactcatgcctgtaatcccagcactttggaaggctgaggcgggcggatcatgaggtcaagaaatcgagaccatcctggctaacatgttgaaaccttgtcgccactaaaaatacaaaaattacctgggcgtggtatcccgcgccggtagtccaggctattcgggaggctgaggcaggagaatcgcttgaacccaggaggtggaggttgcagtgagctgagatcatgccactgcactccaacctggtgacagagtgagagactctgtcccaaaaaaaaaaaaaaaagaaaatttaaacagccaaatatcaaatatagactctcatttagtaggatacaccagtttcagtcattaaaggaatgcagtgaattgtaagataacataaaattttgtttttaggcaaagtagttgtataacttgtttttgtttattctttttttgttttttttgagacagagttttgctccatcacccaggctggagtgcagtggcgcgatcttggctccttgcaacctgtcttacgagttcaagcgattctctcccagcctcccgagtagctgggattacaggtgcctgccaccatggcctgtttaatttttatatttttagtagagacaggatttctccatgttggccagtctggtcttgaactgttgacctcagctgatccacccccccttggcctcccaaagtgctgggattacaggcgtgagccaccatgcccagcctgtttattctttttttaaaaagaaattctaagccttaagtttgataatgaaaagtcagtcattttggtaagaagctaagattgttgtcttagtgtttttggagtgtatgtttgtatttattttggtaactgttgtgtcgcaaatcagaaatttatcaccttgttaagcccatgttataagaatgtggtcgtaagttctcagctttactttccctgagttattctgttttggttgtcaagtaaataagacagcagttaatagtagtgaattttacagcatgcattcccagaagctcttacttttctatagcagaaaacagagtcctctataaggatagcaaatataggctgaacgcagtggctcacgcctgtaaccccagcactcagagagtctgaggcaggaagatcacttgagcccaggagtttgagactgcagtgctgcattgagctataattgtgccactatactgcagcctggatgacagagtaagaccattaaaaaataaataaataaataaataaaaataacaaatctttcttgctgaaggttttaatgttaacataaatgtctaactattacatgaagataacatttctgcctttccttcgtgagcatgtggtggtccctgtcccctctcccctccaggagttacagattttttgaagcagtcattatggatttggattaatatatttacctaattcgacctgacctccattgtgactagtgatttatgcccaggagtgtgctgaggttttattatgttttccatgcaccaagtaaactggcccatttggagagtgaccttgttttctttatgaaacccatgttctcatcaactgagctgttaaatgcctgtaatataaagtcaaataaatcctgctttctaaggcactgtattatttatatagcatgtgtaaatttagaagcatttggtcttgaggtcaggagttcaagaccagcctggccaacatggtgaaaccccgtctctactaaaaatacaaaaaaaaaattaggcatggtgatgcatgcctgtaatcctagctactagggatgctgaggtgggaggattgcttgaacccgggaggcagaggttgcagtgagccgagattgcaccactacacactcttgggtattgtattgcctgggcaacagagcaagactgtctcaaaaagcatttggtgacattgaggcggggttgcagggagggacaatagtatttgtctttctgtttatttatttataatttttttgagacagggtctcactctcacccaggctgtgtattctagagacagggtgtcactatgttgcccaggctggtctccaactcctgggctcaagcagtccccttgcctcaacctcccaaatagctgagactacaggtgcatgccaccacacctagcgaatttatttatattttataaatagggtcttgctatgttgcccaggcctgtctcaaactctggcctcaagcaatactccctcctttgcctccttagtagctggaatgacaggatcaaaccacagcgcccagccttaaaatgttattttaaattgtagttctaaaaagtcagaatgtataaacgattatggcataattagaaatcctgccatcctgtattactattgacatgctctactattggtgtgtttttgacgtgttataaccaggactgaactgagatttttgaggtggccatattgaccagctctgttttctggacattatctttgctattattttgataattttacaccgactctccagttttgtttaagtaaaaaagttaacagtttaacatgatttttatctgtatttaatgaatacataattatacagcactttgtagtacttgccatgttccaggtactgttctaggtggtttacaaataccaatttgtaacgattatatgcaactattaaaatatttttatatgaattgtagaaatttgttagtgttacatttctcttaacataagcatctttcctgaaattaatcaaattacatttatcaaatatgattaaagtaaaaagaagaattaaattgcaaaatttttaaatcatttgttttttatttcagctttaccaacagggacgcttatgtcaactgggcagtgaattttgtgaattggaagtttttgctaaagtactgagagctttggataaaaggtaaattcttttttaaaaaattgtaaaatatacataacataaaatttaccattttaaccgaattgagtggcattaagtatattcacattgtgggctgggtgctgtggcttacgcctgtaatcccagcactttgggaggctgaggtgggcagatcacgaggtcagatcgagaccttcctggctaacgtgatgaaaccctgtctctactaaaaatacaaaaaattagctgggcgtggtggtaggcgccttagtcccagctacttgggaggctgaggcaggaaaatggcgtgaacctgggaggcggagcttgcagtgagccaagatcgcgccactgcactccagcctgggtgacagagcaagactccgtctcaaaaaaaaaaaaaaaaagtatattcacattgtgcaaccatcaacaccattcatttccagaactttttaatcaccctgaacaaaaactccttacccactaaatagtaactccccattctctctttcccttatcctgtgtagccaccattgtactttagatgagtttgacttctctgatttcccatataagtggaatccttataatgtttatccttttgtgtgtattgtatttcatttagcataatgtttttaaggtttatctatgttgtagtacaagtcagaatttcatttctttttatggctagattatattccattgtgtgcatataccacattttgtttatctattcatctgtcaatggatatttgggttctttctaccttttggctagtgtgaataatactgctgtgaacatgagcgtagaaatatctcttcaagcccctgccttcagttattttggttatatactcagaagttgaattgctggattatatggtaattctacttttgtttattttttaagagacttagtttgactatgttgtacaggctgccctcgaactcctgggctcaagggatcctcgtttttcagcctctctgctagctgggactaaaggcgctatgccactgcacccaactcttatttccagtttttttgaggaactgtcatactgttttccatattttttttttttttgagacacagtcttgttctgttgccaggatggagttcagtggcatgttcgtagctcactgcaaactcaaactctccttggctcaaagccatcctcccacctcagcctcctgagtagctgggactataggcgcatgctatcacacccagctaatttttttatttttagtagagatgaggtctcgctgtgttgcccaggctggtctcgaactcctgggctcaagtgatcctcttgtctcagtcttccaaagtgctgggacataaatttcatttttaggttacttgttttttaaaattccattacacctctttttaatgcatgaagttacgtttatttttgactaatttcttatgtggtttagaaattatttcataaatatgattatatcagaaaatttagagtggataaaataattttgcctcataagtatagtaccaatataaatctataaagttgtttcattgagaaattgtctcaattagtttttccatatacctggtattatttcactatgaattatgtttatttgcagttgttaccagaacccctgtcttgtctttttccagtcactacttcccctcccctagggtaaccactagattcattttatgtattttagaacatattaaatacaattatacagtttgtgcccttttgtgtctggcttttttttcccccagtattgttttatgagaatcacctatgttatgtgcaattacagtgtgttcattcttgttgctgtatatatatatggtgttttattatgtgaatacagtattattcattctattattgatggacatttgggctgtttccactttttagctattataactcttgctgccctgaacattcttgtaaatgttttttggtgaacatatgtatgcatatctattagatacatacctagaagtagaatttgaaagcaatttaagacaactcaagaagtctttgccagcatcatagagaatatagtaaaaatattgtggcagtaattgtacaacccaaacagaagcttggtgacaaagagaagataatttgttctgcctccttctatcccctttggaaagttaacactttggaagtttagctttttgagttcaagaaagggagattgaattcatcttcccgttttaagtatcatcatgtagtagtagtagctacagatctggcttttcattgtacttgctgttcttttttttttttggagccagggtctcacttccatcacccagcctggagtgcagtggcaagatcatggctcactgtagcctcgacttccagggctcaggtgatactcccaagtagctgggaatacaggcatgccccaccacgcctgggtaattttttgtatttttagtagagatggggtttcgccatgttgcccatgctggtctcaaactcctaagctcaagccatccacctgccttggcctcccaaagtgctggggttacaggtgtgagccaccatgcctggtctgcttgctgttctctttagtgttcttccctaagtttaactgccattttatttcctaacccacatttctaggaaaataagaatatagtttcacaaaatactgctgatctctaataagaatcttaccaagttgttagcatttattcaacaaattaaataaatacttgctgagtgcctaatatgttccaggtactgttttattttaagtttttgggggtacatagtacatacatattaggtgcatatatttatgggttacataagatactttgatacaagcatgcaatgtgtaataatcacatcaagataaatgaggtgttcatcacctcaagcatttattctttgtgttacagacaatccagttatattctttcagttattaaaatgtagaactaaattattttttactataatcctgttgtgttagcaaatactagattttattcattctttctattttattgtacccattaaccatcttcatttgcccccctctcccagttacccttcccagcctctggtaaccatccttctcctctctatatccatgaatgcaattattttaatttttagctcccacaaataagtgactacatgcaaagttgttctttccttggctggcttcttttacttaccatacagttccatccgtgttgttgcagatgacaggatctcattcttttttatggccaaatagtacaccattgtgtatatatagcacattttccagatactgttttagatgctggggccatagcagtgagtaggatccacaaggtcccttcctcatggagtttgtattttagagagagatgataagataataaacaagtaagtcggctgggcgtggtggctcacacctgtaatcccagcactttgggaggccaaggtgggtggatcacctgaggtcaggagttgaagaccagcctggccaacatgctgaaatcttgtctctactaaaaatacaaaaattagctgggcgtggtagctcatgcctgtaatcccagctactcgggaggctgaggcaggagaatcacttgaacccgggaggcggaggttgcagtgagccaacatcacaccgctgcactccagcctgggtgacagagtgagactctgtctcaaaaaaaataaaataagtaagtaaacagcatgatttcagtgttcaagggtaactttgaaatgtggcctgtgtgctaagattatagagaaacttcttgattagttgattaaagttaggctgtaaaaaaaaatctaataaataagaacttctcattttggtaaaagaagactagaaaaacttttaaaaacattccttactctaaagaaaggatagcttttggggatttgaatctctgtaggtagttttaaacgtggctgttgtaaagattcagtggaatacctctttttcatctcttaggttatctttcaccaagtccaaatcctttggtaagtgttttatgtatttgtgaaactaaaagcatgtaatttgacctttttttcctttacccaaagcagtgactcttacaattttgtttaaaaggttttttttctattgaaatgtgattcacacactataaaattcaccaatttaaattctaccattcaactattcacaagattttgtaaccatcaccactgtctaattctagaaaatttggtcaccacaaaaagaaatcattaacagtcaactccatttcctcttggctgaccatttcctcagttaacagtaactttttcctcagtttctagctgaccattaatctactttctgtctctctggatttgcctagtctagatattttatataagttgattcttatatggtcttttgtgactgacacttagcataatgtttttaaggttcattcatgttgttgcttgcatcagtactactttccttttttatggctgaataattttccatcgtaaggataatactgcattttgcttatccagtcatctgttcatgaacatttgagttgtttccaccttttggctattatgaataatgctgctgtgaatgtggttggacaatattttgtgtgtatatagtctcaattctcttgagtatatacctagggtgtataatatggtaaccctatgattaactttttgaggaaccactacactttttcacagcagccatatcattttataatcccaccgccaatgtatgagggttcccgttttttcacctcatgacaacacttcaaaaaaaattatagcagggtgcagtgacaggcatccatagtcccagctactgtggaggctgaagcaggaggatcttaattgagaccagttcaaggctacagtgagctatgatcatgccacttctctccagcctggatgacagagcaggaccttgtctctaaaacataaataaataaataaataaataaataaataaataaataaataataaataaataaaatatttttaaaaattctattgggtgtaaaggggtatctcatgattttggtttgcatttccctaatcattaatgatgttgagcctcttatttcgtgtttattggcatttatatatcttttgtggagaaatatctgttcatatcagccaggcgtggtggctcacacctgtaatcccagcactttgggaggccgaggtgggtagatcacaaggtcaagagattgagagcatcccggctaacatggtgagaccctgtctctactaaaaatacaaaaaagattagttgggcatggtgacacgtacctgtagttccagctacttgggaggctgaggcgggagaatcgcttgaaccagggaggtggagattgcaatgagccgagaccacgccactgcactccagcctggataacagagtgagactccatctcaaaaaaaaaaaaaaaaaacaaaacaaaacaaaaaaaactcttctatcttcattgccttttaaaaactgggttatgtacctttttattgtgaattataatttggtttttaaaagccaattttaaaagttagcttcatccttccttgtcatcaagttacacattgtgtacttttcctgaatgttgtaggatcactcagttatccactgagtgaagagattaggctaaattttgaattatggccttgtaattgataaggcaaaatgctttttatcttattccgtcctggaaaataatggtgctattatttaaaagagaagcagttagcactttctaaaaggagaaaaataaattaactctataaaataatctttttcttttcttacagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtaagtaatggtggaacagaagtattttgtcctgtgatggactcagaattaaatctgctaacaaagaattcttccagggctttcccaaagtctacgtaagaaggttatgagaagaacatcagaaccacttaaccccatgccaaagcattatactatacatttaaatagtatctttctaaatcctcatgacattccaacgaagtgatggtattaatagcattttacaaatgaggaaacagactcagaaaagttgagtaactggctcaagtcacatagctagtagtagagctaagtttagattcctgtgtctatgtgattccataatatgtgtttttctaccatgtcatgctgccaccagcctctttgacctgcttactgtaggctgtggcagagaacttcatcctttcggagcctcagttttcccatctctaaaatgagggttattctgtatttcctcatgtggatgttatgaggatagtgaaaagaaatgtaaaagcaacatagtgagaccttaaaaatatgtgatagagctgggcatggtgactcatgcctgtagttcctagcactttgggttactgaggtgggtggatcactgtcagtagttcgagaccagcctggccagcatggttaaatcctgtctctagtaaaaatacaaaaaattagccgagtgtggtgacgcatgccagtaatcccagctacttgggaggatgaggcatgagaattgcttgaacttgggaggtggaggttgcattgagcctagattgtgccactgcactccagcctgggtaacagggagactctgtctcagaaaaaaaaaaaaagaaaaaaaaaaggctgggcatggcggttctcacctgtaattctagcactttagaaggctgaggtggcaggatcacttgagcccaggagttcgagaccagcctgggcaacatagcaaaacctcctctctaaaacaaaaaaattaaaaataaatgataaatataaaagtagttagaaaaatgttttgtgtgctatacatgtagaaaaatattgtttaatgtatgtatacaattttatatggttttcacaaatctgtttagatgtgtgtttcaggcaatttcttattaaagtttttgctaccttttttgtttattttgttttattattttattttgagacagggtttcactgtgtcacccaggctagagtgcagtggcacaattgtattaatctgttttcatgctgccattaaagacatacccgagactgggtaatttataaagcaaaaagaggtttaatggacttatagttccacatgactggggaggcttcacaatcatggcggaaggtggaaggcatgtcttatatggtggcagacgagaatgagagccaagagataggggaaaccccttataaaaccatcagctctcatgagacttattcactagcatgaaaacagtgttggggaaccggccctatgattcagttatctttcaccaggtccctcccacaacacgtgggaattatgggaactataattcaaaatgagatttgggtggggacacagccaaatcatatcattccaccctggcccctcgcaaatctcatgtcctcacatttcaacaccaatcatgccttcgcaacagtcctccaaagtcttaactcatttcagcattaactcaaaaagtccacagtccaaagtctcatctgagacaaggcaagtctcttctgcctgtgagcctgtaaaatcaaaagcaagttagttatttcctagatacagtgggggtacatgcattggataaatacaaccattccaaatggaagaaattggccaaaatgaaggagctaaaggccccatgcaagtctggaatccagtggagtagtcaaatcataaagctccaaaatgatcttttctgactccatgtctcacatccaggtcatgctgttgcaagaggtgggttcccatggtcttgggcagctccgcccctgtggctttgaagggtacagcctccctcccagctgctttcacggactggcgtcgagtgtctgtggttttttcaggcacacggtgcaagctttcagtggatctgccattctgtggtctggagcacagtggccctcttctcatagctccactaggcagtgccccagtggggactctgtgtaagggcttcaacccaatatttcccttccacactgccctagcagaggtttttcatgaggacctcaccctgcagcaaacttctgcctggacatgcaggcgttcccatacattctgaagtctaggcagaggttcccaaacctcaattcttgacttctgggcacccacaggctcaacaccatgtgggagctgctaaggcttgggacttgcccccttggaagctatggtctaagctgtacgttggtcccttttagctatgagtagagcagctgggacacaggggtccaagtccctagtctgcacacagcaggggggccctgggctcaactcacaaaaccattttttcctcctaggcctctgggcctgtgataggaggggctgccacaaagttctctgaaatgtcctggagacattttctccattgtcttggagattagcatttggctgctcgttactcatgcaaatttctgctgccagcttgcagttcttctcacaaaatgagtttttcttttctatcgcatcctgaggctgcaaattttccaaacttttatgctctgttttccttttaaaactgaatgctgactgggtgcagtagctcacacctctagtcccagcactttgggaggccaaggtgggtggattgttttgatatcaggagtttgagaccagcctggccaacatggtgaaaccgtatctctactaaaaatacaaaaactagccgggcctgttggcgggtgcctgtaatctcagctactcgggaggctgaggcaggagaatcacttgaacctggaaggcagaggttgcagtgagttgaaatcgcctcactgtactgctgagatcaccccactgcactccagcctgggtgacaaagcaaaacttcatctcaaaaaaataaaaataaaaaaataaaaataaatgagacaatgcttttaacagcactccagtcacctcttaaatgctttgttgcttggaaatttcttctgccagataccctaaatcatctccctcaagttaaaggttccacacatctctgaggcagggacaaaatgtcaccagtcttttggctaaaatatagcaagagtcacctttactccagtttccaacaagttcctcatctccatctgagaccacctcagcctggatttcactgtccatatcattatcagcattttgatcaaagctattcaacaagtctctaggaagttccaaacttttcctacatttttctgtcttcttctgagccctccaaactgttccaaactttgcctgttacccagttccaaagttgcttccacattttcaggtatctttatagcagctccccactctgctggcaccagtttactttattagttcattttcatgctgctgttaaagacatacctgagactggataatttataaaggaaaatgaggtttaatggactcatagttccacgtggctggggaggcctcacaatcatggtggaaggtaaaaggcacatcttacatggtggcaggcaaaacagaatgagccaaatgaaaggggaaaccccttataaaaccatcagatctcgtgagacttactaccacaagaacagtattggggagactgcccccatgattcagttatctcccaccaggtccctcccataatgtgggaattatgggagctacaattcaagatgagatttgtgtggggacacagagccaaaccatatcaacaatcatagctcactgtaacttcaaacttgggctcaagcagtcttcctgcttcagcttcccgagtagctaggacaacaggcatgtgtcaacatacacagctaatttttatttttgttgagacaaggtcttgctatgttgcccaggctggtcttgaactcctgggctcaagcattcttcccaaactactggaattacaggcatgagccactgcacttggctcttttttctctattaaacaaactttttttgaagtgactgtagattcataggaagttgcaaaagagtacccagagttctttgaaccattcctccagcttcccccagtggtcacatattatataactgtagggcaatatcaaaaccaagaaattgacactggtgttataccattaactagactactggccttacttagttttcaccagtttttacgtgcactcatttgtttgtatgtgtgtctgtgcggtggattccatgtagagtcgtacaaccaccatcactatcaagatacagtactatttgatcaccacaaactatttttgtttgggggtttttgttttgttttgttttgttttgttttgttttctgagatggagtctcactctatcacccaggctggagtgcagtggcatgatttttgctcactgcaacttccgcctcttgtgttcaagctattctccttcctcagcctcccaagtagccgagattacaggcgtgtgccaccacacccaactaatttttgtatttttagtagagacggggttcaccatgttggccagactggtctcaaactcctgacgtcaagtggtccacccacctctgccaccaaaagtgctgggattataggcgtgagccactgcacccagccctacttttgtttttaacttctctcattactgtgtgcatgtgccatgtatgtgttttctgtcttaaagtgtacacacgtgcgtatacatccttcccaacaacttttaacagtcatttttaatctttttttttttttttttttttgagacatggtcccactctgtcgcccagactggagtgcagtggcacgatctcagctcactgcagcctccgcctcctgggttgaagtgattctgctgcctcagcctcacaggtagctgggactacaggcatgcgccaccacactcatctaatttttgtgtttttagtagagatggtgttttatcatgttggccaggctggtctcaaattgctaacctcaggtgatctgtccacctcagcctcccaaagtgctgggattacaggcctgaggcaccgtgcctggcctgtttaatcttagaataattctttgtagtagccaaagacaggttgccgaagggacttcagagcatatttttttgaaaaggaccctcattatttctttttttttatttgagacagagtcttgtactgtcgcccaggctggagtgcaatagtgtgatctcagctcactgcaacctcctcctcccgggttcaagccattctcctgcctcagcctcccgagtagctgggattataggcacctgccaccatacccagctaattttttgtatttttagtagtgatgaggtttcactatgttgggcaggctggtctcaaactcatgacttcgtgatccacccagctcagtctcccaaagtgctgggattacaggcatgagccaccgtgcctggccagcatttattttttaaatagtcttatggaaatgtcagtagcgacaaagaattgtccaaagaaagtctctcaaaacttgtgatcttgactaatgttaaggatgatatccctttagttctatatgatcatgtaaaaatgtgtgtgtgagagaaatttagtatgaaagaagatgaaaggaagactagtgttcattgaggtcctctatcatctccacatctacttatgccaatctggccattataatgacccaactagataccttggagagagaaccaagtcctggcaaactcacagttatcagtcttaatcctaaaattacccaagaggaaaaagtcataccagaagagttttgcagacatcaccacaaaaagttttagaacattatttcctccccaaaaagaaaacagtacccattagcagtcactcccatttctctccaacaccaggcaaacatcatctactttctgtctctatagatttgcctgttctggacattttatataagtgtactcttgaaatacatggtctttgtgactggcttgttttatttaccataatactttcaaaatccatccatgttatagagacagaatttaatataaataatattttttgacctctggggtcagggcatagctgaacaaaaggcagcagaaacttctgcagacttaaacatccctgtctgacagctctgaagagagcagtgattctcccagcacggagtttgagctctgagaacagacagactgcctcctcaagtgggtccctgacccccgtgtagcctaactgtgagacacctcccagtaggggctgactgacacctcatacagccaggtgcccctctgagacgaagcttccagaggaaggatcaggcagcaatatttgctgttctgcaatatttgctgttctgcagctttcgctggtgataccccagcaagtaaggtctggagtggacctcctgcaaactcccaacagactgcagctgagggacctgactgttacaaggaaaactaacaaacagaaaggaatagcatcgacataaactaaaaggacatccacaccaaaaccccacctgtaggtcaccatcatcaaagaccaaaggcagataaaaccacaaagatggggagaaaccagagcagaaaagctgaaaattctaaaaaccagagtgccttttctcctccaagggattgcagctcctcgccagcaatggaacaaagccagatggagaatgactttgacaagttgacagaagtaggcttcagaaggttggtaataacagacttctccaagctaaaggaggatgttcgaacccatcgcaaggaagctaaaaaccttgaaaaaagattagacaaatggctaactagaataaacagtgtagagaagaccttaaatgacctgatggagctgaaaaccatggcgcgagaactacatgacacatgcacatgcttcagtagccgattcgatctagtggaagaaagggtatcagtgattgaagatcaaattaatgaaatgaagtgagaagagaagtttagagaaaagagagtaaaaagaaacaaacaaagcctccaagaaatacaggactatgtgaaaataccaaatctacgtttgattggtgtacccgaaagtgacggggagaatggaaccaagctggaagacacttcaggatattatccaggagaacttccccaacctagcaaggcaggccaacattcaaattcaggaaatacagagaacaccacaaagataattccttgagaagagcaaccccaagacacacaattgtcagattccccaagataaaaatgaaggaaaaaatgttaagagcagccagaaagaaaggtcaggttacccacaaagggaaccccatcagcctaaccgtggatctctcagcagaaactctacaagccagaagagagtgggggccaatattcaacattcttaaagaaaagaattttcaacccagaatttcatatccagccaaactaagcttcataagtgaaggagaaataaaatcctttacagataagcaaatgctgagagattttgtcaccaccaggcctgccttacaagagcttctgaaggaagcactaaagatggaaaggaacaaccggtaccagccactgcaaaaacatgcaaaattgtaaagaccatcgatgctcggaagaaactgcatcaactaatggccaaaataaccggctaacatcatagtgacaggatcaaattcacacataacaatactaaccttaaatataaatgggctaaatgccccaattaaaagacacagactggcaaactggataaagacgcaaaacccatcagtgtgctgtatttaggagacccatctcacatgcagagacacacgtaggctcaaaataaagggatggagaaagatctaccaagcaagtggaaagcaaaaaaaagcaggggttgcaatcctagtctctgataaaacagactttaaaccaacaaagatcaaaagagacgaggccatcacataatggtaaagggatcaattcgacaagaagagctaactatcctaaatatatatgcacccaatacaggagcactcagattcataaggcaagtccttagagacctacaaagagacttagactcccacataataataatgggagactttaacaccccactgtcaatattagacagatcaatgagacagaaggttaacaaggatatccaggatttgaactcagttctgcaccaagcagacctaatagacatctacagaactctccaccccaaatcaacagaatatattcttctcagcaccacatcggacttattccaaaattgaccacatagttgaaagtaaagcactccttggcaaatgtaaaagaacaggaaatcacaacaaactgtctctcagacctcagtgcagtcaaattagaactcaggattaagaaagtcgctcaaaaccacacaactacgtggaaactgaacagcctgctcctgaatgactactgggtaaataacgaaatgaaggcagaaataaagatgtctttgaaaccaataagaacaaagacacaacgaaccagaatctctgggacacatttaaagctgtgtgtagaggtaaatttatagcactaatagcccacaagagaaagcaggaaagatctacaattcacaccctaccatcacaattaaaagagctagagaagcaagagcaaacaagttcgaaagctagcagaaggcaagaaataactaagatcagagcagaactgaaggagatagagacacaaaaaacccttcaaaaaaatcagtgaatccaggagctgggtttttgaaaagatcaacaaaattgatagaccactagcaagactaataaagaagaaaagaagaatcaaatagatgcaataaaaaatgataaaggggatatcaccactgatcctacagaaatacagactaccatcagagaatactataaatacctctaagcaaataaactagaaaatctaaaagaaatggataaatgcccggacacatacaccctcccaagactaaaccagaaagaagttgaatctctgaatagaccaataacaggctccggaattgaggcaataattaatagcctaccaaccaaaagaagtctaggaccagactgattcacagccaaattctaccagagctacaaagaggagctggtaccattccttctgaaacttttccaatcaatagagagggaactctccctaactcattttatgaggccagcatcatcctgataccaaagcctggcagagacacaacaaaaaaagagaattttagaccaatatccctgatgaacatcgatgcgaaaatcctcaataaaataccggcaaactgaatccagcagcacatcaaaaagcttatccaccaagatcaagttggcttcatccctgggatgcaaggctggttcaacatatgcaaatcaataaacgtaatccataacataaacagaaccaaagacaaaaaccacatgattatctcaatagaggcaggaaaggcctttgacaaaattcaactctcaataaattaggtatttatggaatgtaactcaaaataatagccgtttaagacagacccacagccagtatcatactgaatgggcaaaaactggaagcattccctttgaaaactggcacaagacagttttctgtctttctctcatcactcctattcaacatagtgttggaagttctggccagggcggtcaggcaagggaaagaaataaagggtattcagataggaagagaggaagtcaaattgtccctgtttgcagatgacatgattgtatatttaggaaacccccatcatctcagcccaaaatctccttaagctgataagcaacttccttaaagtctcaggatacaaaatcaaagtgcaaaaatcacaagcattcttatgcaccaataacacataaacagccaaattatgagtgaactcccattcacagttgcttcagagagaataaaatacctaggaatccaacctacaagggatgtgaaggacctcttcaaggagaactacaaactactgctcaacaaaataaaagaggacacaaacaaatggaagaacattccatgctcatgaataggaagaatcagtatcatgaaaatggctgtactgtgcaaggtaatttatagattcaatgccatctccatcaagctaccaatgactttcttcacaggattggaaaaaactactctaaagttcatatggaaccaaaaaagagcccacattgccaagacaatcttaagccaaaagaacaaagctggaggcatcatgctacctgacctcaaactctactacaaggctacagtaaccaaaatagcatggtactggtaccaaaacagagacatagactaatggaacagaacagagccctcagaaatgacgccgcatagctacaactatctgatctttgataaacctgagaaaaacaagcatctgatctttgacaaacctgacaaaaacaagaaatggggaaaggattccctatttaataaatggtgctgggaaaactggctagccctatgtagaaagctgaaacaggatcccttccttacacattatacaaaaattaattcaagatggattaaagacttaaatgtgaggcctaaaaccataaaaaccctagaagaaaacctaggcaataccggtaattcagcacataggcatgggcaaggacttcatgtctaaaacaccaaaagcaatggcaacaaaagccaaaaatgacaaatgatctaattaaactaaagagcttctgcacagcaaaagaaactaccgtcagagtgaacaggcaacctacagaatgggagaaaatttttgcaatctactcttctgacaaagggctaatatccagaatctacaatgaactcaaacaaatttacaagaaaaaaaacaaacaacccatcaaaaaatgggcaaaggatatgaacagacacttctcaaaaggacatttatgnnnnnnnnnnnnnnnnnnnntgtactgtgcaaggtaatttatagattcaatgccatctccatcaagctaccaatgactttcttcacaggattggaaaaaactactctaaagttcatatggaaccaaaaaagagcccgcattgccaagccaatcctaagccaaaagaacaaagctggaggcatcacactacctgacttcaaactatactacaaggctgcagtaaccaaaacagcgtggtactggtaccaaaacagatatagaccagtggaacagaacacagccctcataaataataccacacatctacaaccatctgatctttgacaaacctgacaaaaacaagaaatgaggaaaggattccctatttaataaatggtgctgggaaaactggctagccgtaggtagaaagctgaaactggatcccttccttacacgttatacaaaaattaattcaagatggattaaagacttaaatgttagacctaaaaccataaaaaccgtagaagaaaacctgggcaataccattcaggacataggcacgggcaaggacttcatgtctaaaacacgaaaagcaatggcaacaaaagccaaaattgacaaatgggatctaattaaactaaagagcttctgcacagcaaaagaaactaccatcggctaggtgcggtggctcacgcctgtaatcctagcactttgggaggccgaggcgagcggatcacgaggtcgggagatcgagaccatcctggctaacatggtgaaaccccgtctctactaaaaatacaaaaaaatagccaggtgtggtggtgggcgcctatagtcccagctatttgggaggctcaggcaggagaatggcgtgaacccaggaggcagagcttgcagtgagccgagattgcgctactgcactccagcctgggcgacagagcaagtctccatctcaaaaaaaaagaaactgtcatcagagtgaacaggcgacctacagaatggagaaaatttttgcaatctacctatctgacaatgggctgatacccagaatctacaaagaacttaagcgaatttacaagaaaaaatcaaacaaccccatcaaaaagtgggcaaaggacatgagcagacacttctcaaaagaagacatttatgcagccaacagacacatgaaaaaatactcatcatcactggtcatcagagaaatgcaaatcaaaaccacagtgagataccatctcacaccagttagaatggtgatcattaaaaaatcaggaaacaggtgctggagaagatgcggagaaataggaacacttttacactgttggtgggagtgtaaactagttcaactattgtggaagacagtgtggcgattcctcaaggatctagaactagaaatactatttgaccctgcaatcccattactgggtatatacccaaaggattataaatcatgctactataaagacatatgcacatgtatgtttattacggcacttcacaatagcaaagacatggaaccaacccaaatgtccatcaatgatagactggattaagaaaatgtggtgcatatacaccatggaatactatgcagccagaaaacaggatgagttcatgtcctttgtagggacatggatgaagctggaaaccatcattctgagcaaactatcacaaggacagaaaaccaaataccacatgttctcactcaggtgggaattgaacaatgagaacacttggacacagggcagggaacctcacacaccagggcctgttgtggggtggcggtctgggggagggatagcgttaggagaaatacctaatgtaaatgacgagttgatgggtgcagcaaaccaacatggcacatgtaacctgcacgttgtgcacatgtaccctagaacttaaagtataataataataaatttttaatcctaaaaaataaaaaagaattgtcttttagaaaggactgcattactaagtaggactatcaccctggacattcaagcccttttctgacaggccacatctttattgggatgaggctattcaaagggaaaattaaacatttcttaacaggaatatgtttttaaaatggtttggattcatttatttcttgtttataagtatttaatttgatgcttatagtcaaggaacacatttcttaaaattaagtttttaatcgaagtagtaacccggccggacgcggtggctcacacctgtaatcccagcactttgggaggctgaggtgggcggatctcctgaggttagaagtttgagaccagcctgaccaacatggagaaacccgtctctactaaaaatacaaaattagccgggcgtggtggcacatgcctgtaatctcagctactcaggaggctgaggtaggagaatcacttgaacccaggaggcggaggttgcggtgagccgagatcacgctattgcactctagcctgggcaacaagagcaaactctgtctctaaaaaaagaaatagtaacctatcctgtggttactggattgatacttctattaacagcaaatgtccacttcattttcaagcacaaatggtcattgtaagaagctgtaacagctgccacaattgtgctgttgtcttcttttcctaacttcttttgaaaacaaggatctcatttgttttgaacagagaaaataaatttggttctggatttgacttagctgaagcccagctctattgtagtattttccttgagtttaggtgaattctagggtcaatattacaagttttgactttgtcatgctctagaataaacctaaatttttagggattgtcaaactaagaaccaaataaaattaagtacattgtataaattttctccttctcaacaagatgtggatgaagtagatgttatatctgaatagttcatttcactaggctataaaatcaattatcagcataaaaaatatttatttatttaggagacagggtctcactgtgttacccaggctggtcttgaactcttggcctcaagggatccttccaccttggcctccaaaagtgctggaattacaggcatgagccactgtacctggcctaatacaaatcgtttttaaccagatactagagaactaaagaggcaaaaagggaacagtagggtattatggacaaagcagctgtgagaattggctaccatacctatggcttggggaaccaaggaaagagattggaattattaaaaagtaggagttggaggggtttgccccatgaagctgggatactgctaggctgttactggtgcctcagaggtctgaaaagagggcccgtgggtctaggatctagacctctaggaggagcaacctggatggctattgctgatgtttgatggagtgctgtgaaactggttttgcaagcattggaaaactgcaactggtattgactattatttaatggaatgaactaccaccaaagaaaagaagcacaccctggggtgtttttgtcagcaggaacctcactaacagatacaggaaggagagtgtccattgctcttccagtcatgcagcccatttctccagtgcctcctattcgctgagccaaacggagccagctagcaaaggagaaatgtggtttgcagagtccttgctcagcatcctcaaacagactctagtagtatgggtttgaagctgagagacagtattctaataaccagcacaatatacaatatgttgggatgataagtagaatattgcttagtatgaatatgaataatctcattattctgctcaacttggtgaggaagctagaaagttttaaagcacagttctctccaattaaaaaaatgcttaattacatgtagttttaattaaatataaaacatgagtctaagcaaaatataatattttgtcaactcatacattaatactattaagacaccatattttttgtgtgccaagaaaaagccacttattgtaatataccattacttttatgacgtactctaatttcagagttttgttgttgttgttgtttgagacaaggtctggctggctctgttgcccaggctggagggcagtggtgtgatctccgctcactgcagcctctgcctcccaggctcaagccattctcccaccccagcctcctgagtagctgggactacaggcactcgccaccacatccggcttacttttgtatcttttgtagagacaggattttgccatattgcccaggctggtctcagataatttcagagattttttaatgtgcaaaaaaatgtgttttagaacataccatgatggtatgttactttgtgttttctggttattgtaactaatcctgaatagcactaagaaattattccttaataactgttgcagtatagggactacagacttagcctctgaagtcacattgtgtgcatctgaatcttttcacttactggattataagctttggtttttctgtgactcaagtgttttcatctgttacgttggggcagttatttaagtcgaaggtgtgttgtgaaagttaaatgagtgagttcgtgtagttatgtagttaccacaatacgaagtgttttacatggtgtagtaacagtgtattaaatgttagtcatatttaggaggcagaatcctcaaaaagataatatgctgaggaaatactgcccaggacagtaatttcttgtttaaaaaaataataagataatcgattaaggatcacagtctttttttatctgtgtatcctccgttatgtgctgctatactaagtatattcagatttatcttctttgggattgtgtattgggagatgctaaagttatatgtacactccaagatgaaaatagtaaaataatttagttagctcattagctggaaagtaacaactcttaggccatggagtattcttagaaggttcaaacttttgactccttattcaaggtcttagccttaaccctccttcccgtagttcaaaacctttatataaaaatctcacagttcatacctgtgttgtatgctaaacacaagattttactatcatggtttatttttaatttaggtaatattcactgtcagcatgtcattttatcttgcaggctatttatcaagttttctaaaattggtgtttcttatttttttaggtggctttctttcagatgcaggctggtacagtgatgctgagaaagtttttctgtcctgccttcagttgtgtactctacacgatgagatgcttcattggtttcgtgcagtagaatgttgtgtgaggtaagttggaacatatcctgtaattacgtgctataacagtatttagtggcttttatagttttagctcttataagtatatgccaacatttgagtaaatctctgagatgatatttatatgtcatagtttcactagtctggcatcctctcatctctaaaatatagttaatctgctgtagacagcttaggttagatttgagtattatgaaccagaatgtgtttctttttttatttttattttgaaacagagtctcgctctttcacccaggctggagtgcagtggcacagtcttggctcactgcaacctccacctcctgggttcaagtgattctcctgtctcagcctcccaagtagctgggattacaggcatgcgccaattatttgtatttttagtagagatggggttttgccatgttggtcaggctggtctcgaactcctgacttcaggtgatccacctgccttggcctcccaaagtgctgggattacaggcatgagccaccgtgcctggcccagaatgtgtttcttacatatctttttgctttgtcatagagcttgtttgtttattcattcaacaaatatttattgaatgcttgtgtactaggaactgtggtagacactggatgctcggaaactccagaaatgtactttttctttggtgttacttttgtaccccctgctttgtttacatttccataattgtgcataacaagattagtgctttacttatgaataacttttctttgagtatacatttattacttttttacagatttccttaaagtcaagcaaatctagaagtaactctgctttattgtccttatttttttctgcatgttacatttacctttagctattttcatacaggttttctctttgtcccccaatttgatttggcatttcttaaaagtatttttttatataaaactaaaggaaaattaaaataaagtcaaaaaattaaacagcagaaattctttatcgtaaggtaactaaagtccaatcaatttattgaatttacagtcttctatttttatggaattaaggttcatatttcctaggtattttttagatgagttaattgaatctgaaccctttcaaacctagaatattctcctataaaaccattgtatttttgttttgggtttttttttaaatatattttttactttatttttattagaaatggtgttttgctgtatcgcccagtctggtctccaactcctgggctcaagcaatcctctgcctgggcctcccaaagttctgggattacaggcatgaacctctacacccagccagattattgttgctttaagctaaaattgagtaaaactctattttttttttttttttttggccagttggatttcagtcttttgaggctgtcattgaccttttttatacaaggcttatctatgtcagacagacattcaatcctgaagttaattttgtaatatgcaaacttaattataaataatattttagaaggtgataatttcccacatatactttggaagtgtatgataaattataggaatatttgtgtgcagaaactctaaaaggattagtatttagccctataatttatagtactcataaaaataatctctcatttttttccccctcttctgcctattttatatttttaggaataggagactacattatcccatatgggatttgggaggttagttatatattgctatgtacataaactggttaatttggaacagaaaggggattttgtatgatttttatcatagattattcactatggcaatcttgaccaaaagataaaacactttcttttttgtatgtgctttatttttttattcacatattcagatttatttcacccaaatacctgtgtttcttctgattttaaggttcctgtataaatttggctttagccttaccaaaaggtttagttttctcacaagacaagtcagtctccttctctccttcctagtttgtcatctgtagcaagtagctcacatcattatggctgcaagtgttaataggcagtaagaagaggggaggtcaaaaagtgcatgccagctgactcttttttaaatcagaaaaaaattgctttcccagaagtctaaccctgtctcttggattacttgtcttttaaactggaaactgggacacattctacacaacttctaatctgtgtaataagtatagtctgaggagcaaaacatttttaattgtgcatgaatgaactcatgggtctacattaaggaagaaaacatgaggaatattgggtagataactggctgggtgcagtggctcacgactgtaatcctagcactttgggaggccaagatttgaggattgcttgagcttaggaattggagaccagcaagacctcatttctataaaaaattttaaaataaattaaaaacaatagataattaacaattcagaactagctgtctttttagcaagcacatgtgaaactagaatattgtctggaccaaggaacaaagccatttataatgccagctcactgcctgtataccaagaccttatgtctttatgaatttgaaatttcacaataaaatttgcctctattcaactaaccttgccaaattcttggccgttacaggtgtatttaatataatttatttataataagtaatttttttcatctacttagtattatttgaaaagattattaaaattttatgacttagcctttttttaaggcagagagaaatttggggtattaattgaccatgtgtttaattgaattagaaaagaagtgttttgcacaacagatactaatcaaatgctttggccaatcccaggggctttgagcctgatgcaagaataaaagtatatttttcaatttaatgtcacaaagccaatttctaatatggggctaacatcaaaacattatacaacaaaggtcagagaaccttcctagcctttcttaatagaaagtagttaaaactggtaccatttttcagtccttttgtattctttggagactctgcctatttccatttattcattttctatttaatggctttgtttttcttgcttatacatgtctggccaaacacatccagaaaatacagaaagctatgaggaagaaaattgttgtctataaccctgctgctcagaaataactacagttactgaactggcttgtttttgggggatgacaaacttaaaatcacacccgcaacccccttttcagttttttctttggagctaatcagtccatgtgagcatggtttgtttaaggtcaggaattctctagaacctccagataagggaacagagattgcttttgggcttgtgagagttgggcagaacaaacttactttttattttaaatccttttctactatttattatgtttttaaaccattgacatgtattcctttggtgggtttttttaaataataaaaagaacttcttgaactactggactgtggggtggggttggggagcgtgtgtgtgtgtgtgtgtgtgtgtgtgtgtgtgtgtgtgtgtgtataaagagttgaatgtggattgaaagagaaccctgggcagctgaatttcctgaaatccaaagataaatagaaattagaagctagaagaaagtagcagtatcttagttactgagagaaaatactgtacctcaccagtttgaagggcaaaagaagtaattttcaaatacatgaagacccagtatatctccatgtaccgtatctgagggaaataatcgaggaacttctgtaaccaaatataagttccagcaaggcatggtacctcatgcctgtaatcccagcactttgggaggccaaggcaggaggatcgtttgagccaaggagtttgagacctgcctgggcaatataatgaaactatcatgttatgttatgtcatgtcatgttatgtctgagtcatgttttttgttttttgtttttgttttttttgagatggagtctctgtcgcccaggctggagtgcagtggtgtgatcgcggctcactgcaagctccacctcccaggtttaaatgatttttctgcctcagcctcccgagtagctgggactataggcgcccgccaccatgcccagctaatttttttgtatttttagtagagatggggtttcaccatgttagcctggatggtgtcgatctcctgacctcgtgatctgcctgccctggccccccaaagtgctgggattacagacgtgagccactgcacctggcctctattttattttaaaataaaaattttaaacttttatttaagttcttaaattaataataacaaatcccaaggtaggggaagacagtataaaaacagtggtaggtaatgaatattgtaatatatgtctcacatgtaaatggagtaggaagagaatgaagaacaaattgagaatttgtaataggccttaaatgaggattcttttcaaaccagagatgaaaaggaaattttggaaataacaaaaaacaaaaatttaccacgtcaaacctattacaggtttagtgttcctaatccaaaaatttgaaatctgaaacatgattggtcccaaacatttcaaataaggatactcaacctgtattttgaacaacaaagtagtatttaggaaagaaatgttaagctgaaatttcagttagtgctgatgtcaggaagctttatagagatcacctagtgaaattttctttctaaataagttatgaggctgggcggggtggctcaacacctgtaatcccagcactttgataggccagggtgggtggatcacctaaggtcaggagttcaagaccagcctggccaacatggtgaaaccctgtctctactaaaaatacaaaaaaattaactgggcatggtggtgggtgcctgtgatcccagctacttcgggaggctgagggaggagaatcgcttgaacctgggaggtggaggttgcagtgagtcaagattgcaccattgcactccaacctgggcgacgagcaaaactctgtctcaaaaaaaaaaaataaaaaaaaaatgaaatttaacagatttagaattattctggaggtcatgaccttatagttttaagagttggataattttattaactggctttttaaagattactttgaaaagtgatggagtaattcagttctggagatcctggatatctgcttgccataggagaaattgaaaagcccagcagtcctaatgctttgcagatggttactggtagctttggattaaatttctgatgacatcatacagagattcagaagtactggttttcaaacaagtgaaaatgttttactctaaaaagctgtcattccaaagaaggatttatttaaaagataaaataaaaactgtcagatgactcaaataactatggtgatgatgaagctaaatgtttaaggtacatgtgaataatttggataaagttttgtaaattgtgaggaggaaaagcgatttttgaaaatttaatttagattttaaatatattggtataaggaaagatttaaatgttataaatttttattctttttgtttttaatagaaaagggacctcagtatgttgcccaggctggtctcaaactcctgggctcaagtgatcctcctgccttggcctcccaaaatactgggcttacaggcatgaccaccacacctggccttaaatataaattataagtgttttaatgttatcacatatatccctaaaacttgatatatatgagttggcaaaaatatttttagatggaaaatggaggttcatcttacattcaggttgttttttaatagacatatagcctatttttaaaatatgcatttgggagaatggatgagtaaaagtgttacagagttctcatcttagtgggtagagtaggaaagggcatcattatttagtttaaacattatcagtgctagagatgggcatttgatgccttgtgtaatagaaaagtgtgatagaacttccaaactagggtggtgtgaatatgggtgagaatgatttgaaacttgaccaagctagatataagcaaagtgaatagaggaacaaactgattatgataagtgaaaaataagatgaaaaggttagaccaaatataattatcatcacaatacatgtaaatgggctcaattctcctacctaaagatggcagttaccaagagggttaaaaaattaaaactagtgctatatcataaaaaggaaacaccccaaaacaataatactaacaataaggaagaattcaggataaaagtcattagttaatacaaaagggatattgataatagaatgtataattcacaaaaatgtcataaacctatgtgtagcaaataagataggagccacctacataagcagtgtaccttaaaagtacaaaaactttgataaaaagataatcagtacaatgttaagggcctccagggtaggttaattctgaatatatagaggttattaaggaactagattctttcaatctgtctgctaattctttgtgtaccagtcatttctttggctagctctccagtgcttgtaagattgctgccatggtttgaggtgtcaggtgcagattccacgttctctagcagaagaaacactctcacactgatgtcctccctgacttgaaattaaaaccataccagactaacaaagaaaaagacagaagactcaaataactaaaaccagaaatgggacttggaacattactaccaaccttccacaaatgaaaaggatttaaggtgaatcctatgaacagttgaacaccagtgaattagataacataaataaaatggacaaattttttagaaatggacaatttacctaaatgccccaagaagaaatagaaaatcttacgagacctataacaagtaaataaattaaatccataatcaaaaaccttccaacaaagtccaggactgaagacttcactagtgaattctatcaaacatttaaagaattagcactagttcttctcaaactcctccaggaaattgcagaggaaggaacacttcctaacttgttttgttttgtttttgtttttgtttttgtttccattttcattttatttgctttattttatgagacagagtcttactcttttgcccaggctggagtgcagtggcaccatcttggctcactgcaacttccgcctcccaggttcaagcgattctcctgcctcagccacccaagtagctgggattacaggctcccaccaccacacctggctaatttttgtatttttagtagagacgaggttttgccatgttggccaggctggtctcgaactcctgacctcaggtgacctgcccaccttggcctcccaaagttctaggattacaggcatgagccactgcgcccagcccctaactcgttttaaaaggttaacgttaccctgataccaaagaccaaaaatgacatcacaaaaaaggcaatttcagacgagtatctcttatgaatatggatgaaaaaatcctcaacaaaatactagcaaatcaaatctaatagaatattaaaaggattttacactatgacaaagtgagatttatcccaggaatgcaagggtggttcaacgtaagaacatcagtgtgatacaccatgttaataggatgaagggaaaaaaaaaaaacccagttatctcagttgacacagaaaagacatttagcaaaatctaacaccttttcatgattaaaaaaaaaaattcacaaagctaggaatagaaaggaacttcttcaatatgataaagagtatttatgaaaaactcacaataacatcatactctatagtgaaagactagaagcttcccccataggatcaggaacaagacatagttgcctgctttcactagtggtattcaacattgtactggaagctttagcagaagaaattcgacaagaaaaataaaaatcatcagtattggaaaggaagaagtaaaactatagatttgttggacttaatcaaaataaaaacttttgtaaatcaaaaacatcaagaaaataaaaagacaacctatggaatgggagaaaatatttgcaaatcacatgtcaattaagtttctagtatccagaatatatcaagaactacaactacaaacaacagaatttaaaaatgaggccgggccctgtggctcacacctgtaatccaagcagtttgggagtttgaggcagagagatcatctgaggtcaggagtttgagaccagtctggccaacatgataaaactctgtctctactgaaaaaaaaaatacaaaaattagccaggcgtggtggtgcacacctgtaatcccagctactcaggaggctgaggcaggagaatcgcttgaacccaggaggcagaggttgcagtgagctgagatcgtgccactgcactccagcctgggcaacagagcaagaccccatctcaaaaaaaaaaaaaaatccagtctggccaacatggtgaaacccatctctactaaaaataggaaaattagctgggtatggtggcaggcgcctgtaatccaagctactctggaggctgaggcaggagaatcacttgaacccaggaggcagaggttgcagtgagccaagattgtgccactgcactccagcctgggcaacaagagcgaaactctgttaaaaatttaattaattaattaataaagagcaggctgggcatggtggctcacacctgtaatcccagcactttgggaggctgaggcagaaggatttcttgagctcaagagtttgagaccagcctgagcaaaatagcaagaccttgtctctattaaaataatttttttaaaaatcagccaggtgtggtggcactggcctgtcgtctcagctacgtaggaggctgaggtgggaggatcacttaagcccaggagatcatggctgtagtgagcttgatcatgcaactgcactccagcctgggtgacagagtgagactctgtctcataaaattaaaaataaaaaatggacaaaggacttgaatagacattttcccaaggaagatacacaaaagaccggtaagcacatgaaaagataagcacatgaaaagatagtgtcattcagcattagggaaatggaaatcaaacataatgagctaccactttattcctaccaagatgggtacagtttaaaaaaaagaaaataactgttggcaaggatgagaagaaatcaagtgattctgctgagagagcatttgaaaaaaaaaaagaaattggaaactttgtgcactgttgctgggaatgtaaaatggtgcagctgctgtggagtacagtttggcagtttgtcaaaaagctaaacatagaattactgtatgactcagcaatttcactccaagtatatgcctaaaagcattgaaagcaaggaatcgagagatatttgtgtgctagtgtttatagcagaatttttcacaagtcaaaagataaaaacaatccaagtatccatcagcagataaatagatacacaaaatttggcatttacatatatacacatacaatgattcagccagttttggtacatgctacaacatggatgaaccttgaaaattttatcctaagtgaaataagttagacacaaaaggacaaatattgtatggttccacttacatgaaatatgtagaataggcaaattcatagagacagaaagtagattaaaggttactagggactgtttggggtgatgaaaaagttttggaagtggatagtattgatggttgcatgacatagttaatataattaatgccactgaattgtatacttaaaaatagctcatatggcaaagttttatatatatttcaccatagtaaaaaaaaattattaaacccataccggtctttattttcattatgcagctctcccctttcaagctatcatttatttccaattttttttttttttttttttgagatggagtcttgctctgtcgccagtctggagtgcagtggtgtgatctcgactcactgcaatctctgcctcctgggttcaagcgattcttctgcctcagcctcccaagtagctggaactacaggcacgcaccaccatgccaagctaatttttttttgtatttttagtagagacggggatcgtgttggccaggatggtctcgatctcctgacatcgtgatccgcctacctcggcctcccaaagtgctgggataaactagttctaagaaaaagacacttacaagaaggagagaaattcttttcctttaggttcactttcagtgtattttactttcgtcatgtctggctgatgaggctctaactagtcatgttcagtcttatggtaaatatattagtaaactaatgacttacacatttgtatatttttcattttaaacaatgaatagttcaatcaaatagtaattgttcttgacagtaggtgttgatcaggtagacataattttatgttatgaaagtaaaatactgtgtttacatggtagtgccacattttgagaacctcctttttccttaggcagaaggttgggataaaattagaccataataagttggaccacaagttccttggattcaatatactgcttagtgtcagcccagatggacacacagaacctaaagagtctccatatgtttaatttgcccttttgtttaaatagacattcagcagggactggagaaaataccaagctgtgcctttctggcatacagtgtttattttgctacttcatcatgtgccaattactaaataatttccacagattgttatttcaggagaatacttacagtgaaggtctttggaaaggaaattcttagcattgtggaaatgagaagtaagcactgttctttttattctctaaattttcaacctatgggtttctcatttttttctctttcaaccatttggctatcaaatctgtgtttcaaatactaatcctttttttctcaaggacttttttttctggactgttacagtatcttctgccttggttgctttgcttcccctcttggctttgctatagccagagtgtagccagagcattcttgatagagttgcattgtcccatatggtagccattaaccatatgtgattattaagtttaaattaattaaaagtaaaatgtgcctcagtcacactaggcacatttctaatactcagtagccactgtggctagtggctaccaaattgagcaacacaagtatagaacatttctaacatctcaggaaattatattagatagtgcataagtcaaatcacctcccttactgttgcaaacaaaactcctttccacggcccgcaaggtgctataaaatcttgcttatctctcccttctcatttctctttacataatcttttattcactgtagtctagatgaattggccttctttctgttcctttgactatgccaggatttccccccatcccttctcaggggctattccttctgttttgctgttccttctgttttggaacatgcttccccaccagatcttcacttggctggctacagtgtcatcatttagatgtcaacttaaatgttactacctcaggaggattcttccctgtctaccctaaatacctcctttcagaatcttttgatcatattaccctacttttttatcatctttatggcatttatccttaaatgaaagtcttacgtattttatctttgcccacactaatacccttctcaccactagaacataagctgcttatggtaatagattttgcagataattgtatggtacgtgttgggaggatacacattggcattgtatagtagtcatcactttattgattagtcctggttctttggaagttaatctgtttctgtgactatacagaggaatgatagagattaaaagattgtctgaatttttctcattatgagttactaatctgttaataattgtggtatagatagaaaaaataaattttttgtatctgttgatttgatgctcctgaggaatacttcctaacctgtccatccttgtttttcttttaaatagcttttatacctttgttccttctcagtctgagcattttcagaaagttgtattggcttgatacatgaacataatgttctagctagcatttaataaataaataaataaataaatatttgtccagtcctaacactatttgcctatcttgtacagtctatatagatacacagtctgttgctatctagaccagtctgatctaaagcattgtactatttttgcatatcattaaatagtcagcatagttgtacagttaatttgtttaaagaactctgtatttctactatagaggataaagattttaaaagaaatagttgacactactgctattttcggtaaatttatcttattggaaaaaatgaacattatgaagcatcatgaaataagtggtaactgatcaagtgttagactataccaaaaataagaaaagaagatattttatgtcaattttattttcttcattattttccaagtttcttatactgaagctatattacttgtggatttggaacaaaaagattaaatgtcatttttttagatgcagtacatgctgagtacataaaatatataaaatatttagagaaggaatcaacaattgatgagatgaattatgggacgctttcaggaaagagcatgtacttctttatgggcatgaggtcaactccaatttgggccacacacttattttcaatgctgccttgtaattgtatttaattaccttaagtcattcaggtgattggtaagaggtcatcaggtctaccaagctgaaaatatcaaaaatagagcaatgttattggtgttttataggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggtaagtgttttaaggtacatttcactgtgaccaataagtacctataaaaacagagggtaaatcaaatagtcttctcttatttttcttacagatctcttttacatattaggtttatataaggcagtacacatttgtaatggaaaatttaaaatcagacaagccgagcactgtggctcatgcctgtaatcccagaactttaggaggccaaggtagaggatcacttgagcccaggagtttggggccagcatgggcaacaaagtgagagagaccctgcctctatagaaaattagccgcatgtgtagcacacgcctgtggtggtcacaactacatgggaggctgaggcaggaggatcccttgagcccagtaagttgagggtgtagtgagccatatttataccactgtactccagcctgagtgacagagtgagaccctgtctcaaaaaaataaaaaatcaggcaaaaggagtgtttgtgaggtgaatttgaaatatatacatgtgtaatttagagccctttcttttgttgtttttcttttaatttaaccaaatatttgcctaaattgtttggttgggcctcgtgttgtagtttttgagacaggatcttgctttgtcacccacgctggactcaaactcctgggctcaggtgatcctctaccttggcctcctgaagtgctgggattacaggcatgagccaccatgcccagcctgacagttattttccttctacatttggatttaggggtttatactgtgccttattcatgtctttgcagctctcagcacattcgtgaggaatgttgaagtcttggataattttgacagttcaatcttctagtgataaataagcttttcactgatatctacagaaaagtacacaaatcttacagacatggtttgatgaattagcatcatgtttttgtgttaggataggctaggttatgcagaggtaatatcaaccccagaatagcttggaacaataaaagtttctttctggctcataatatatccctgtcttcagatggctatggctgttcttaacattatacctacgctttgatcaagacacagcgtggttttgggtctatctggaacgtatctatctagaacattaccagcctgggcacaggggcagaaacttcatggagaagtactgccggctcttggacttttcttccagaagtggcacatttcacttctcatattttaattgtggaaagaaatcacatggccacacttgtctttgtttgtttgtttgtctgtttgtttgagacagcgtctcactccatcaccaaggtctggagtgcagtggcatgatcacggctcactgcagcctccacctcagctctaccaagtagctggaactacaggtgcacatcaccacgcccagctaatttttttgatttttgatagagacaaagtctcactatgttataacccaggctggtttcaaacttctgagcttggcgatcctcccatctcagcctcccaaagtgctgggattacaggtatgcaccactacacccagcctaagacaatttattttgccttttttatttcttccactaagcaccaggagaggaaggacatttttggttttgtttcccacttcatacctagatactagcacattacctgccacttaacctctctacacctgtttcccctaatagtacgtatcttatagggctgttttgtcaggtaaatgtgttaatgcacataaaatactttggacagtagctgggacaaagtaaacactcaactaaacagacaattcagacataaaataacaaatgttacaataggaggatggaatgtataggaaaacacaggaaaccccacaagacagatgagtttaaggggttggaggaagggggaatgtattttaaggcagagggaacagtatgtgcaaaggcttctgggcaagagagaacatacctctgatttccagaagatatgtcatgtatccacaacgtctgattcagataagctatagatattaagagtaaaaataatataacagatttatactttgaagaaagtttagcctcagaaaattctaactgtaaatattttgtgtgtgttcttatttaagtgcttgtagaaaaattttgcagtcatcttgttaaatattgtcaacttgatttaaccacagttctgtctcttctataaataatttttttaggcatacaaatggtgcatcgaggcaatgaaagaaattacagcaggcttaccagtgaaagttgtggtggatgtcttaagacaagcttctaaggtaaatataatgttaaaattattaaatgaattataggatttatcaggctttaagtttgttttaattaacctgttatttaacattttagttatttgtacactccgtaggcataggtctgttttataagtttctgtgctcatttttagaaatctggtttctaactaaaactatatcacacatagatttttagccaatttttctttaccaagaaaaccagtgaaataattcattttgatcattgtttcagtgcactaaagtacagctcaaagtagtatttgggtgctattctggcttgagtttgtttttgtttttcttaaatatttatagcaaccagaattccttatgccaaaatcctgtgaactttggtcacttttctgctaaagatagcctggtgttaaatctctttgtcatagtattgcagtctcacagcaaggcagcttgctatacttgacctgctaggcagtccttacttgatttttctctagtgttttcttattctgtaaataaatgcattaaatcttttacatttttattttattttaaatagagacagggtctcactatgttgccctggccggtctcaaacacctggactcaagcgatcctcccacctgagcctccaaaagttctaggcaagcctccaaaagttctaggattacaggtccaccacggttggcctgcgttaactctttgaggacatttagtagtattttaaaactactcctttggtgcagtgaggacttaaagcattaatgtacttttcagatacactcttctaccctgaagtttctcagatttgaatatttcattttggttgattttacttatggaaattcaactagaaaatagattccaaaattatagatctgagagagtctaatatttctctgaaatttattaaatcagtcattttagagtaagtaaacagcataaatatttaagttatcagagctagaacagggatattcttacgtttttaattaattgaaataattgaatattaatataaagacaacataatatttatgcaagatttatatttctgggtttttttttctttttttttttttttgagatggagtcttgctgtcgcccaggctggagtgcagtggcgcgatctcgggtcactgcaggctccgccccccagggttcacatcattctcctgcctcagcctcctgaatagctgggactacaggtgcccgccacctcacccgactaattttttgtatttttagtagagacggggtttcaccgtgttagccaggatggtctcgatctcctgaccttgtgatctgcccgcctcggcctcccaaagtgctgggattacaggcatgagccactgtgcccggccacaagatttatatttctatatgcaaattatatttagagtttttagaaaatgcctagctataatcatggatcaaaataacaactgagagctgtgcacagtggcacatccctgtagccaggagttcaagtccagcctgggcaacataaaaccttgtctcttaagaaaagaattaataggaaaacttgaaattctatgcatttaaaaattattaaatgaaaataacaaaagattgttgtcagccactccaggactgggatataaggaccttagaaaatgctgtggtaaattctgcccccattgttttattttaataatagcggaaaatgggggtataccagctttgtaaggtaactttgttttgacagatttgtactaggactgactgtcaaaattttaaactttataattttcccagcttatatacagatctgtttataatagaatttttaagtacttggaaggaaagaaattacaaatagaacctttgtatttatgtttggagggttttttttcttattaactcttatagccagaatatataaactacacgtattttagcacactaatgaactgtttgagagttaaccatttttcactttatctttaggcttgtgtagtaaaacgtgaatttaagaaggcagaacagttaattaaacatgcagtgtatttggcacggtaggtgattattattaaaaatatccttttaaattgtctctatactttatatcctaataattttgtgtctttttatagggatcattttggatccaaacacccaaaatattctgatacactgctagattatgggttctacttactcaatgtagataatatctgtcagtctgttgcaatttatcaggtatgttaatggttaccctttttttctttcaacctgtattgacttgctgacctgtatttgtttgtggtgtataaaccactctaaaaatgactttttgacaactaccccgcccaccaatataggttgcatcattattttattaagtattacctagaaggtgtaaaagttaatgctttgggaattaaagaaaatcattcaggaaaggaattattgggttgtgagctcatatgtgggagtagttttccattttttatttacccatgtaatggcttgtctttgttgttgatttagcaaatgtcactaaaactgcctttgtagtaacaaagatggctgataattattttaggtctttcttactcattctcaggtaaatgatgtattatgccattgctgtagacaaggcatacttgacttcaaggttcactttttttttttgagacacagttttgatctgtcgcccaggctggagtgcaatggcgcaatctcagctcactgcaacctctgcctcccaagttcaagcaattctcgtgcctcggcctcctgagtatctgggattacaggcccgtgccacaatgcccggctaatttttgtatttttagtagagaggcggtttcagcatgttgcccaggctagtcttgaactactgacctcaggtgatccacccacctttgcctcccagaagtactaggattacaggtgtgagccaccgcgcctggcctaaggttcacttttgaagaaggaaacagagcaaaacattcccaatgtcttgattctcaagacataggaatgattattattattattattattaagccgtggccttttaagtcaaactcgtatcttcagaaattcaggacttctaggtgactttcatgttctgtaatttaaatacagcaggactttctgggcttcaaaattttatggtgttaggcatatagatatatatttaaattactaggatgtttaatttaactaggtggtattttctacagtattgacaaatatttttatgattctttcaggcagcccttgacattagacagtcagtgtttggtggcaaaaatatccacgtagcaacagctcatgaagatttggcctactcttcttatgtccaccagtatagctctgggaaatttgacaatgcactgtaagttccacattccttttctctgaaggaggaaatactgtttttgttttattttgttttttcccattagggaactattattacattaataatagtacttgatatactttatggattgaacttgtcttcctggagctttatcagaatgcctaaaatgttcttgaagtcatttaaaatcataccagttttcaggtgcagaggctcccgcctgtaatcccagcactttgggaggctgaggtggaaagattgcttgagcccaagagtttgagaccctgtctactcaaaaaatttttaaaactagatggacgttttggtgcatgcctgtggtcccagcttctctggaggctgaggcaggagaatcgcttgagcccaagaggtcaaggatgcagcgaagcatattcacaccactgcattccagcctgggcaacagagtgagaccctgtttccaaaaataaataaagtcatactaatttataggttattcatttagcctttatgtgatttactattgagacttgtatattttcatgcagaatataacttatgttttgagtatttccttcaataatttttgagtaatacagtagcaaacttaataacctaaaaacttcttggtgataacacatagaaatactgaataacaattgtctttttaaatatataactgagcttgcaagagtgagggggaaatcccccaagggccaataatggacactaaaatttaaaggattaagtatggcctgtggtataactgctctggggtgatgggaaagtttacagatttctgtaaccttggtttaagaaacagcctataggaggctgggagttagaactgaaaccctcacatgaagcaaagtcaagactgcaacccggccgggcgtggtggctcacgcctgtaatctcagcactttggcgggccaaggcaggtggatcacctgaggtcaggagttcaagacaagcctggccaagacgatgaaatgccatctctactaaaaatacaaaaattagccgggcatggtggtgggcacttgtaatcccagctattcgggaggctgaggcagacaattgcttgaacccaagaggtggaggttgcagtgagccgagatcacgccactgctctccagcctaggcaacagagtgagactctgtctccaaaaaaaaaaaaaaaaaaaagggactacaaccccagggaaaggacaggtggacatctatctaattaatagatgacagggaaagttggccatctgagcttggtgtcacagttgaacccaaaaagaagcctcacaaaacataattatttacctataccgctcttgagtttagggataatgcatcaggatctgcaaacagaaaaatattaaaaagcactttgggggtgctggttctcctgggatgccttgtgagagaaaatgcaagacttggaaataattatctgtcaacccaaactatacagacatttcatagacgaagctttacctaaaatgaactcaccattaaaaattacaaaacataaggaaatatttcctctgagtcagcagacataatgaacaggattagaatcctgaaaactttagttaacagaacttttttttggctgggcgcagtggctgatacctgtaatcccagcactttgggaggccgaagcgggcagatcacgaggtcaggagatggagaccatcctggccaacacagtgaaaccccgtctctactaaaaatacaaaaattagccaggcatggtggcatgcgcctgtaatcccagctactcgggaggctgaggcaggagaatcgcttgaacccgggagtcggaggttgcagtgagccaagatcaccactgcactccagcgtggcgacagaacgagactccgtctcaaaaaaaaaaacaaaaaaaaaaaccagaacttctttttggttgatgctgtaaagtatgtgttctttatatgattaaagatacaaaataggttgacgaactaggcctataagtaaagttttatgttttactggaacatagccatgctcattcattcatgtgttttctatagcttctttcacactacagcagccagagttcagtagttgcagcagagaatgtgtggacaacacaacctaaaatatttactatctggccctctacagaaaaactttgttaactctaatataaaagaaagaatgaagaatattcccataaagaaaacaggaagtttttttgtttttgttttgttttttttttgagacagagtctgtcactctgtcgcccaggctggagtgcagtggcgtgatctcggctgactgcactctccacctcccaggttcaagcgattctcctgtctcagccacctgagtagctggaattacaggcacacgccaccacacctggctaatttttgtatttttagtagagacagggtttcaccatgttggccagactggtctcgatctcctgacctcaagtgatctgccccccttggcctcctaaagtgctgaggctgcagatgtgagccaccatgcctggctggaaaagggcagattttaaagtaactgttacatgctacagcatggatgaaccttgaaaacactgtgcccagtgaaagaagccagtcacaaaggatcacatattgtatgatttcatttatgtaatatgtccagaataggcaaatccgtagagagaacataaattgatgttatctaggctggggagttggagggaaatggagactgactgctaatgggcataggtttctttatggggtaatgaaaatgttgtaaaattgattttggtgattggcatactactctgtgaatacactaaaaatcattgaattgtacacattaaatgggtgaattgtgtggtatactaattatatcttgagctgttataaaaataaaacaaatggctagaaatggaaatagtcattgacattaaaactcagcagatgggccaggcgtggtggcccacgcctgtactcccagcactttaggaggccagggtgggtggatcacttgagcccaggagtttgagaccagcctggacaacatagcaaatccctgtctcttcaaagaaaatgcaaaaaaattagttgggcatggcagtgtacacctgtaacccacctatccgggaggctgaggtgggaggatcacccgagcccaggagtttgaggctgcggtgagccatgattgcatcactgtactccagcctggatgacagagcaggatcctgtgtaaaaaaaacaaacaaacaaaaacaaaacaaaaaaaacctcagcagacaagttaaacagaagtttagttacaacaaaagagagaattagtaaattggaagacagatttgagaaaactagtggttacctggagggtgggggagagggaggcttggcattgtttgaaagaaactgacaataaaacagaaatagcttaccttctatttggtgatatgggccataaacaaataaccaaacttgtcaggcaagaatacatgttgtgaagaagagtaaagtaggctgagttgagagagtgatggtaatttttttttttttttttgagacagtctttgtcactcatgctggagtacaatggtgcaatcttggctcgctgcaacctccacctcccaggttcaagcgattctgcctcagcctgctgagtagctgggattacaggcgttcaccaccacacctggctaattttcgtatttttttagtagagatggagtttcaccatgttggccaggcttgtctcgaactcctgacctcaggtgatccacccacctcagcctcccaaagtgctgggattacaggcatgagccactgcacccggccagtggtaaatttttttagggccttttatgtggtctgttctggaaagacctgaggagcgagtcgtgagaatgttcaggggaagagcattatagaaagggtaaagccagggtgagaacatgctctgcatgttcaggaaactgctaggcctgtgtggctggaggggaaggcggagagggttggtgtgagaatggcaggagatgaggtcagggaagtagcaggctgaaagatcatgtagaatcttgtagtctgtagtaaagatttcctctcattctgagggaaatgggagtctctgttgggtattaaaagttcagtctacaacagattggaaatttaaaacaaaaagctggatctttaccacagatagttttagaagtactttctatcaatattatattacagattgtgatttttaaaattcctaaatcatttgtaactaaaaagaaatgccagactgtatctatctgtattacagatttcatgcagaaagagctattggtatcattacccacatcctacctgaagatcatcttcttttggcttcttcaaagagggtgaaaggtatcctttgtaatctagtctcagatattttaaaatagatgatatatggtataaaataggggtatttgtttattttctcagaggattggaggattttctcacaggatttgacggtgtctatgtattactagatagccattttaccacaactctacttaaggggttccagtggctcataatgaaagactgtttgcatctctcataaaacattgttaataggccggatggggtggcttatgcctgtaatcccagcactttgggaggccgaggcaggcagatcacctgaggtcagaagtttgagaccagcctggccaacatggtgaaaccccatctttactaaaaatacaaaaattagccggatgtggtggcgtgcacctgtaatcccagctacttgggaggctgaggcaggagaatcgtttgaacccaggaggcagaggttgcagtgagccaagatcgtgccactgcactccagcctaggcaacagaacgagactctgtctcaagaaaaaaaaatcagtaagccagaatttctttcttttctctctcccttttgtcattcactcatgcatgcattaatttttttgaggattgcatggaagcataatacaaatgtttctacacaacatgaatagaagatgggtttcataacttcagctttgtagtgcaggattcttatcctgagcttcgtatcaggttaccccgaatgttgcaaggctcttgcaaaatacccctatcttccatttcttattttaacttttcttctgattaccaccaaggctttttcacgtaatgcatttattttgctaacatgattgggtcacctatgtgttatttccgtgcatgttggatatgttctaccttaattctggaactgagttttttctccctctaggtttgtattttttaagttgcacaagtaatacatgatgttagatagaaaagagaaaaataaattgccttaaaatcccaccaatcctcagtcaacattttggtgaatattattttagacttttcttacttcaaataagataactaaatgaatgatttaattttataatctgattttttcacttaatatattacattttttcatgtctctacatatatccttttttctaatgtatttaaccttacctttattatttgactcttataattatttttaaccttttctttttaaaaaatgctacagtgaagtaaatctctttttcttacctttgtgtacatagacagttttccaataaatcaaattatctggtaaaataatatgtatattcttaagactttagatagaatttgaaagtcttgaatggagctttgaaattgaaatgtcttgcctgatttggttggtcagatgagtaggaggaaatcagttcttttagccgtgtttggttaaaggttatgttttataaagtgtgttttcaaaattttcagaagtgcttaggtactccttgacacagtttcatgactttaaaaaacttgccttgtgcttccgtttaatttgaaaaacaaatttcacatcagcaaagtatagcagtctattaaaatagaagctaattctgcaaaatcgtttataccattgtttttcttaaatttgaatatatatactgtgcaaaatagaatgaccaccaaaaagtgtacttttttgttaaaagtggaattctttcatcttgaccagttccaaaccataatcacatataaatatattcagtaaacatttatattatttaagtttaaattagatgttcttactagctttggtagatggttttgaagtacactaatttattgccttcttttttagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggtagaaacatgtttttactatatttttctctcttaagtaatgaaatagaacctgaaataataaattttaagtaagctcaaataaattatacacttattgcacaaaggaattgagaagatagtgagtataaaacaacataggccaagcacagtggctcattcctataatcctggcactctgggaggctgaaatgggagggtcctttgagaccaggagtttcagaccagcctggacaacatagggagaccctgtctctacaaaaattaggcaggtgtggtggcacatgcctgtcttcctacctacttggaagactaaggcaggaggatgagttgagcccaagaagttgaggctgcagtgactatgatcacatcactgccctctagcctgggtgacagagtgagaccctatctctaaaacaaacaaacaatagtcaaaatataaataaaatttaaaaatcaggaccgtgggccaggcacagtggcttatgcctgtaatcccagcactggagtccagggtgggacaatcacctgaggccaggagttgaagattagcctggtcaatatagggaaatcccatctctacaaaaaagaaaaagttagccagacatggtggctcacacctgtagtcccagcttctccagaggctgaggcaagaggatgacttgagcccaaaaggttgaggctgcagtgagctctgatcacaccactgcactccagcctaggtgacagagtgagagcctgtcttcaaaaaaaacaaaaaaaaaaacaggatcatgaaaaattaggaaacatgtcaaactaaaaagattaatatatgaggccgggctcagtggctcatgtctgtaatcccagcactttgggaggccaaggtgtgcagaacacttgagggtcaggagttcaagaccagcctggccaacatggtgaaaacccatctctactaaaaatacaaaaattagccaggcatggtggcatgcacctgtagtcccagctactcaggaggctgagacaggagaattgcttgaacctgggagatggagattgtagtgagccgagatctgcactccagcttggataacagagtgagactcatctcaaaaaaaaagattaatatatgaaagtagtacttgagataagaaaaaattttttaaataaaaaagacaaatatgattgctatatttcaaacagttcttagtatatagttcttgatatataattcttagtatatactaagtatagctcttagcagaatgcctggcacatggcaggtgtgcaagaaatgtcagatattgcaacaagtattatcagttgtagcaataaatatgactaacttcaatgtattttagaattttgagttatatatatattttttaatatgggttcttactctgttgtccaggccgtagtacagtggtgtgatcatggctcactacagcctcaacctccctgggctcaggtgatcttttcacctcagcttcccaagtagctgggaatacaggcgcacaccaccacactgcctaatttttgtattgtttgtagagacagggtcttgccctattgcccagccctgttgcccaggctgatctcgaactcctgggctcaagcaatctgcctgcctcgacctcccaaactgttgggattacaggcatgagccactgtgcccagcctataaattcttaatattattaattttgggatcacagtaagtaaagagtgagaggtcttctttacctgaaaagcaacctgtatatccctcaattagcttgagtttagtttgttggaataaaaattgtcaaaattccaaaaaatgaaatgaaagtgtatgcccatgtaaattaacatattatgatctagagcttgttaagaaggttcaactaaattttggactgtgttaactgtgttaaccaaaggaagtaatttttgttttagaatgttttgttaatttcttctaacagtttcttaaaattttgcaaatttctttgttgtgaatttcttgtaacaattttttattaccaggataagttttcacttgttacttttgacataggatactattgctgtcatcagtttatctgcagtttccaaaactctgtaatgcttcccataggcaatttttggaataacatagtatgttctttgatctgattaccttatggcattcataagatgtctttggcatttagatcagttttgctcattgagtaagaactgttaagatgagaaaaagtataatgattgatatggcataattgtttttcaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattggtatgttacatttaaattttctttagtcagttgattacaaatcaacatgtcagcatgtcttatatgttgtataaggaaaatgttattaaagacttaaatggggctgggtgcggtggctcatacctgtaatcccagcactttgggaggccgagataggcagatcacttgaggtcaggagttcgagaccagcctggccaacatggtgaaaccccatctctactaaaaaatacaaaaacaaattagctgggcatgatggtgcatgtctgtagtcccacctactcaggaggctgaggcaggagaatcacttgaacctggaaggcagaggttgtcatgagctgagattgtgccactgctctccagcctgggcaacagaacgagactccatctcaaaaaaataaataaaataaaataaaatactaaaatatttaataaaataaaatagatttaaatgggataagttgctaaggatattcaggaaccacccaaaaatcatctggaacattttgctaaaggtgctttttttgatactgaagccagtagtaagaggtatgacagtagactgtcatgtgtaggcaaaagtagttattttaaactatttgtgcagttactgcccactcattcctccccctcccttctcctacctttaacatcatagatcaggcttacctgtttttgaacttgatgaagttatacaatgtatatttttatgtgtctggtttattggtgaacaataatggtgaaatctgtgatgttgcgtatcactgccatttgttggattaggatgtcatcatttatccattccactattaatgaacatttggaacatttggatttccatttcaggactattacaaaatcaaaataaggaatctatggccatcatcttatgaagtgcctgttaaaactcttgcccatttttatattgatttgtcttgtcattttcttattgacttatagaagttctttatatgatatgaatatgacagaccttcgttggttacatgtgtcatagatatcatctcttattcttgcttgtttcctaatggagccttttaaataacagaagttctttttttcttttttcttttttctttctttttttttttttgagacaggatcttactctgtcacccaggctggagtgcacatcagggctcactgcagcctcaatctcctgagttcaagtgatccttctgcctcagcccacctgagtagctgggactacagatgtgcaccagcacacccggctaatttttttttttttattgtttcaatagggacaaggtctcacaatcttggcccaggctgatctcaaactcctgagctcaagtaatcctcctacctcagcctcccaaagtgctgggattataggcatgagccactgtgcccagccagttcttaatgtaatcagatgcatcagtattttctttttttttttttttgagagggagtctcgctctgtcacccaggctagagtgcagtggcgcgatctcggcttactgcaacctccgactcccaggttcaagcgattctcctgcctcagtttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacccatatcaactaaaaagacaaaaattagccgggcgtggtagcatacgcctgtaatcccagctactcgggaggctgaggcaggagaattgcttgaaccctagcgggcagaggttgcagtgagccgagattgcactgtgcactccagcctgtgtgacggagcaagactacgtctccaaaaaaaaatatggaaatctttttctacccaaagtaataaagatatttttttctagaaaattatcttcaggaaactttatttatatttagatctacaatcctgaaactgattttttttttatggtgtgaagtagggatcaatttttttccccatatggacacagagttaagccaagaccatttcttcaaaagacttttttttggttttgttttgttttgagacaagagtctcgctgtgtcgtccaggctggtatgcagtggcgtggtcttagctcactgcagcctccacctcctgggttcaagcgattctcctgcctcagtttcccaagtagctgggactacagatgcacaccaccacacctggataatttttttgtatttttttagtagaggcaaggttttgccgtgttggccaggttggtctcgaacttctgacctcaggcagcctgcccgcctgggcctcccaaagtgctgggattacaggcgtgagccaccgctcctggccaaaagactctttttttccctctgctatactgtgttcttcataaatcatttatccatatacatgtgggttccctattatctataatatattgactgacttgctcattcctcaagtgcatgtagtttaagagttgctaacccataccgctgtgaaaaacagacctactacttagagttcaatattcgtttacagttttcctttttctctagcccgaaggtagtatattttcagaatactatgttcaaaagttacttggggttatttacacccctttcctttcaatgtggttatgttattcttttgcacaacaattaggtttatttaacatgttaaattgttgccccatccatctttgtttattttgttaatttttttgagtatgcgaaatattaacgtactgtaattagaactatacagaaagatatgtccagatacatataattttctctgatttcttctacccagttcccacccactcactatggataaccagtctcattagtttctggtttatcatttttgtgtatctttttgcacaatgaacagataaatattttcttatttccctatcatacacaaaagatagcatactatagatactctttggtattttacttttttcaatcttaacaatataccatcagtcactccgtaaccgttacagagagcccagaaatttccccatcagtttgcagctacataatatgccattgagtgaaggtaccacagttgattaaactattctacgtgtttttgtttgtttctgttaatttgtaattacaaatactgttgcagtgaatagccttgtgcatgtgttttggtttttcatttgttggttggtttttttgagacggagtctctctctgtcacccaagctggagtgcagtggcctgatcttggctcactgcaacctctgcctcctgggttcaggcagttctcatgcctcagcctctcgagtagctgggattacaagcatgcaccaccacgcccagctaatttttgtatttttagtagagacgggtattcaccatgttggccaggctttcaccatgttggccaggctagtcccaaactcttgacctcaggtgatccacccaccttggcctcccaaagtgctgggattacaggtgtgagccaccatgactggcctgtgcatgtgtatttttctgttgttggagatgctgccattcttctttgagatctctttaaacagttctttcaaaccatgaatttttataattctattctaatgaggccaacttctttagacgagaaaattttttttaagtcttagtgatagctcatggttgggactgatttaggggatgctgatacaagaattatatctattcctttcaggggaataaacctaagccaccctgtttaaagaattgaacttgtgttcatgttatagaaattgcttgttatctcattatttgtgcttttttttttttcctttttcttttttgttacagggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattgg

SEQ ID NO: 15753 - DNA, 236964 bp, Human
  misc_feature (1)...(236964): n = A,T,C or G
gtctcccctcccttgttagaaagtggacttgaatttattataaagttattaccttgtctactgatagatacattttgcatatttttaaaagccttcatttaatgttaagaaaagtaaagaactgtttaaacatgtcaatatattcttcttgtagtaaagagtaaaaagagattcaaggaaggagaaaagccttttgtcgttctctcctttgtttactgcagtagcattgtagaaaccaggtttatctcaatgtatcttagtattttgggaaggacttagtatctcagaaatttagaataggggtctagctgagctgggaacaaacccatagaggagcagttaggcagggagaaagataaattaacaaataagaaaagtgacttaaaaaaaaaaagcagcatgcacagttaccccagcgtgatctctggtaatatcctctttactcatgtgaaaactatttacaaaaacctcaactcatgtgaactctgaagtgggtaggaaagataaaaaaggaaattctttaattttgtgctttagagtctgaatatggatgccagtttgtcagtttatattccttgggaatattccatgggaagaaactggtccgccttgcagtcggcacagcacagcttcccaggtgtaacaacttggttgggataggagaaaacggttgctcctaagcttttgcgcagactggaagctgaatcaggcgtctgctgggatacaatcagagaccagcagctaacctcagggctttcagaaaataacggcaatcaggtagaaacagagtctcgaggagggtaattgccagctaggattcctcaagggctccactctctatcttacacgtgaactctatctttctctgggtcatggggtcacaaccaattaagactttccgagtgacaagctgggaatcaccgtgttgcagttacagcaagtgttattgccaactttgccaatagtgtgtgtgtggtttgtgtgtgtgtgtattcctctctgtactttaatcttattttcatatgtgaacactaaagagattggacaagagataacgtttatcttgaaatctcactctcagtaagatggtaccagtatcgcacacacacacactcgcacacacgcacatcacctgcagccgcagaaccttgcacccttgggctggctcgcgtcttagggttttggtatatttggtggaaacttgctgatttcctatgccttttggaaagaccaagctggatgagggtggttggaacgctgtggctcatcatttattcattgcgactgttttgattgttgacactagtggcaagccgcatcctccagctcttgcaagggaagtctgacaccttgaggacaggagagggggtgccagtcgcccagagaagcgggagtgggagaagctttgagagttgcaggggactacttttttccggtcgggcggcgggcctcatgggtgcttgtttaccgggctgggagcagggcattcaaaagctgggtgtcggagcgcactgaagtccaacacgcctgcagagaccgccctaagcctggaggtgtgtctggcttgcatccagaaccacagggtggattctcgccaccgacttggctggatgacggctggctggtggtgagctcccctgcccactggctgacctcaagcagttggccccggtaggtggaggctattcgagggggacaagctggggacgcagcgtcagctcctgccagcgcgcgggtctcctccacctccaagcagtgtggtgcgtgggacgcgcatcttcccggactatccctttccagcgcggtctgtgcggaccccgagcccggcagccaccagggacggagggcggggtgcctttctctgggctcatccgctgtcagccgtgggaactcttaactttatccagagggatctgtgcaggcgggggtgggagaggttctcctcccctggcggttacctccccctcccgggccgcccctcccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcaggtaaagaggatgtcgcctcggggctccgttcgaccggagctacacctcgccttctttctgggatctcggttaagtttcctaagctgcctgggaagccggctctcttctgggaggcggacatccctgcggggttaggagttcaaaaggttctggctatgtggtttctcttcaaggctcaggaaaaaaacctgtgaagctttcggtgcttgactcgggctgagcaggagtttgggggtgctcctcagtcttccgccgcactcggctttaaagcaggggagagggcgaggagtgaacccccggtgtgacttatatggtaaacaaaggagctgcagccacgccgtggtgctggggaatgtggccgtttttagccttttatgcatttggggaaaatggagatctcgggggcatctgggtgcatataagtgaggccttagctctccggcacttaaagtagggtaacgaaggaaggagagtgatcaatgttctaccgatcgattacattctgcgtcgttttcattctctgtcaagaaacagaaacacttttatccgtgttgcccgacccaggctagtgattcctagttcgcctggcaaccgagattccaatgaagccaatgaagccaatgacccggtttgctacttggttaaatcactgggattcactgcacaacttgttgttccagctgtgaagtcagctgtcttttgcgactagagacaagagaatactggaaaggcatcgagggtttaggagagctgaggaaagggatctcttatcttgtctgcctgcattcactatggtgtatccactatggtgtatccctgttcacatggcttcttagagaggcccttcccagtgaaattccatagctataaaatgcagcaagttgcttaaggagtaagcaccaagccaaaggagtaggaagagacagaaggaagctttagttgttttattaaaaaaaaaaatagacagacttgtaaaactttttcagttttaataaaacaccgcctctcagagctcatataatttctgcctttcctttcacagtacataatcacagcacaaagaatattacaaattctttaagcaaaaggtttactggagggttttttggtttggggtgtttttggtaaaactctaaattagacattgagagtaagagtgggtggagatgttaaaatgttgaaatcttcatcattgtgttgggtttgctatttaaagttacatttgtagcgcctactttcttattcacctggacactattgtccagaaaacatcctccttaaatgtttaaggggggaaaaaaaaacaataagatcaatttcaatttacttgctcactggtcattctgaaagatatatgagttggaatagattttcattacttataacctttaaaattttgtaatggttatattatttatttttctgttgcacttatttccaaaaggtcaagataaaactgcattaaaaagtctatgacagagttaaagttctctttgaattttatagctattttaattattagaccagtaagagaccaaataacttttcatataaaataaccttaatcgattcatactgtgtattaataggaaataacagaagcaatctttatattctttctcattagaggaaattttaatgtcttattctatacacacatttcaaactaactttctaacttatgctccatggagaactacagccatctataggactgaaaagttacctgtttcaacatcctcatttaggaatccaaagctaaataaatattaaaaaacaacaacttatgtttataaactattacatcattttaattggtaaggaatctggaagttagattggctatttttcaatatttggatggctgtgtctatcaatatttttgtgaactagatgttgttataaacttcactgtaataactaagcttagaaaaattgctgtttctgaactgtagatgaaagatagaaacaatgacaatcattatttttaatttttcttttatgatttcaaagttataaacatctgatcatctagtcaaatgctatcagcataccctgtgataaagacaattacatttgtattgaaatataataaccccctttaagatgcactgattttaaccccactgaattaaaactacttttaagtgtatatttttggaaatagtctgttttatttttatacctgcatgtttaattgccaggattatttatagcaattcagatgatcagcattatagttagcagctgaaaactgaaataatttctcttttctgatcgatgcatatattggaacaaaaataaaaatatgcacacatttgttcaatagtaagtattgtaactatcagtgcttaaagttagtatagatatataagtaaagatagatatatgagaaatactaagcagtagctagaactataaaattagggactgaatattttatgaaaatatgattgttgtatttttgaaaataatgtcaggtaaagggaaaatacaataaactattaaattttcctttttccaaaaccatcattgccatatagcttatgaaatcaaattctaatgtgcactttgactttagaaattgaattgcctagactcaattggaaccagtgttattgacctctttaatgcctatggaaaccccaccatgattatttggttctcattaaaaatgaggttgaggagacagctcaaaataaaaactttgccttttcacctaatttataccctatacccgcccccccccacaaaaaataaacattaaaactggttcgactcaacccaaatttaattgggaatttgtttctatctagttataatgaagagttgatttagaactatctcactactcatgttttctatttctcacccttccagaggcattgaccccgcaatattttaagagatttgagaatattttgatcagggatataatatcatggctgtgtctttttaatcagcacaaatatagacctaatttttgagaacattagtattaccaaaataactttatgatgcaaaaaatgcatttagggaaagacaccatttgtttgggaaactgaaaattaaaggcatgcgcattgaaaatgtattaattcaaaaccttgtggtttcatgaactatttagcaaattaagtgctgtatttaaatgtttaaaaaatataagtgaccctcctgaaagttgtttaattttaatagaataagaaagaaatagtttcagaacttgatctactattgtaactaaactgtatgtaatatcctattaatattagtgtatgttttatctctctttttaaaaatatagcagtgtcatagaataatgacttcttgagagacactaagtgacacatggacacagtgttacatataaaattagaaatgttaattaaaacattaatttaaaaatatgccttgatagctttatctagcacactgcattctttttgagaaatgacagtgaaattaaatgaatcagatattcattaattatattctgtctgtggtttgctgttagattttgaaatatgttgaaaaattacttcaagcaaatactatcaagagttcaaatttacctgaaacaggacctattgtgaaaaaagaaaagagggaaaatgggccaatatttatgagaatttaatgtacacttggcactatgtgagaaactttgaaaaagaaagctatttttcattgttatcttaacatctaccttgaaactgaagtattatcacattttaacaacctgagaaagatgaaatttatgaaaatcacaaaattgctttgtgggaaggcaggatttgaagtatatcaaattttactatcaggtactacgtctacctgatggtaaagactacactctttttacttaattcctgtggtttctaaaatacaatcaataatcttttaacaagtttcataaattcattttttcagctatttgtttcttgaattttaaaaatattataacattggaatataaacaactgtccccatcatggggatagaatttgaaacaatagtctgttaaagttccatcagttttgaagcagagcaagagataagctacttatcttgagcaggatgatctcaaaatgacttcctttcttattcttaaatataaatctaatacatgtaaaaagaaaaaaaaagtttgtttttatgaacaaagttcaagattataattttttagaaatactcatgagcttataatttataaataaaaagttatcatgctaaccttttgaccatctgtaagctggtaataaaatgtctttattaaaaaaaaggtcatgctaggccatgttaggtttatactacatcttatcaatgttatgtaaaatttctagacaagtgtatttgttttagttttccctgaaattttaattttccaattattttaatgtcccttggtatttgagaggagctctcattcatgcatcccaaaagacatcgattagctgaatttgtcatgatatttactaaacatatatatgcatttgcgctgacaggattgtgtccaaaacctattgacattgaggttgaaggaatactttctttgaatatatgtactaccattacaaaaattatcactaaaatcttatccattcagtagatatttgttgaatattagtaaatgaataattgaatcaatagatgaatggcacatgcgtaagcttttcatttttgttgcatttcctggcaaagctccctctgtctagaataacttctacctttttgtttctgtaaaaatattctgcaggcactaaagcctagttagtgcctagttagtgcctagtttgtgcctagttaaatccaatatgaccgtatccttgaaagtttccttcatttctccagatgtcccaagtataaatacaagcaaagagcttgttatattctgtcttgcaggctggcaaagatctgtctccagatctagacagtaaactttttaaagaaaaccggaggattttcaaaactgtgtgagtttgtaactgaattagagtgccataaatactatgcttcataattgacataattaatgtattttatactttcataatattgtacttggctaaacttttagcatatttttatataatgatgccaattgtgataatgttgcacttatacaatatattgagtaccatattatttcttatgttacaaaaataatttacccaccattattcaataaacttaactttcagtcagctacttactctataatgctcatttttataggatttatataaccagttattaatgtgtttcagtttaagtggtactgtgccagaattcttaaaggagggcttttgttccattacactatgagaggagtagttagagttgaaagaggacagatacaagtgtttctcaggaatgcttactgaactaaagaaagccagagacttctttggagtgatatttggaaagtaagttgagagtgcatttcaaagacttgacaatacatgatgttccattgtgggtggcatgagggatttgttttaaattattttcattctacttcattgacaatagagtttttacaaatcagattatgaaaagtgttcagatactctgccacatttttaatgcatttcatctctaaatgatagtggagaagtaacacaatttgcataccgggatcatagttcataacacattgtaatttttattttcacagaattagtataatagtgctgactatgtgctttttgaatagatgagtgaaataaatgaatgcatagatgattgaattggtctgtcatcagctgctatgctcaacctctttaacacactgttcattcaagtagctgatcatacaccaatatgaatctccaaaaacacaatggagggatgagaggacaggcatagtgtacatggagtgaagaacagagaatctatcatgatttatgtacaatcatctccatcatttatgacagcatgagtttctttttatgtaaagatccctttcattctaaggtaaagtgaagctgcatgccctgaatcacactgaggtcacactttaaatgaatgctcttttgtggtagttgcagtttgacaagcagagttgggtcttctttaattttatctagagcccaatatgtacaggaatataatatatatgtgtatacaacatacatataagtatatatgtgtaaacacacaaacatatatgtaataacagtaaataacaagtaataaagagtgggagactgcttgagtgtgagacacaaattattatcaaatagtatagagtaacccataaaggaccacagtatttgtttttgaatatgtcagtgtccctataaaatggttagatttgcaatgaatgacttggaagatcatcttatttaaaagtatgtttgtaagtaggccccctaaatctttctatatgatcatgcagtcatacatcaaatacgtcctgagaaaggcatcattaggcaatttcatcattgcacgaacatcatggagtgtacttacacaaacctagatggtagagcttactacatacctaggctatatggaatagcctatttctcctaggctacaaacctgtgtagcatgctactgtagtgaatactgtgggcaattgtaaatatacaatggtaggtatttgtgtatttaaacatagaaaaagtacagtaaaaatacagtattataatcttatgggcccaccgtcatgtatatagttcattgttgcccaaaatgttgttatgtgatgcgtgactgtgtatttctctgtctacacatacgcacacatacacacacacacgagcacacactttactgaggtcttaatacataacagtcactctgctagattctgaggatacagagatgaacaagacatattttcctttttctttaatattttaagcaaagtttgttcataagcctcttatcacactccagtgtcctgtattatctaaaacatatttggcaaccttattttctcctgatcctttcccatgacaactctgaactcattaaataaataacataaattatattacaatgagtagagtctatacttgacatttaaaagacaaaacaaaacaaaacaaaaactttgggccatggtggaatcaatctaaatatatcctttttgccactaattactgttttccgtaagagtaggacttaagtttttttactgtaaatccgtgttaaatttaaatagcattattgacactattaaaaacagtgttttccttttatacatagatattaccaaattaccattcacaggctatgtattgtaagaggtaagttgttttccaaagtctggttggatttttggtgttacagtcacatgttaccctaccccacatggaaccaatgaagcaaacctaagaaggcacttttatagttagggatataatgacctggattctcaccaccctacccctttctctagagacagtagagaccttggcttaagagattcttagaaggtcagatcaaatttagagaaatctaggagtactcagggcccactgttagtgttttcttgtgggctcctctgtctacagctacgtctatcgaaagcctagaaatagactacctttctcatggcctttaatcttgaaaatgaagaagggactggactagatacattcctcctttttaaaaaaaaccattattggaacctgcattcctaggtctaccaatggtaccagaatgttttgctttctgagggttatcatgcaaaataattagagtgcctacctctaagcatctgagagcctctaaaataaaggataaagaacatttaaagatatgtccctctgcatgtgctgtataaaaagagatgctggcactggggaaagcgttatttgcttatctggttcattttaacctcacagcttaacattttgatttgtaatgtgcaagctacttggagctgaactgcacatttttatttagcactccagcacgttcttggaacaaagtgaaccagcaaatgattttgccctttcatgaataaaagaagctttaataaataacatttcattataacagtatttatgataaatatttttccatcatataaaaatgtcaacaattttaacctgaagaataagaactgctttgcattctattgtatttagcaatgaaccactaaaaccagaacttaaagcagaacttgctggtatacttaagtactttcttatcagttactacattgctgtaattgaaatattgtatataattaaaaaatgaaaattgcccatttttagattaatagttaatggcaataattattggcaacatcaaatgcagaagatctgtttttaaattaaacattttagcctctgatttttttaaaaatgtaaatatctacaaagtaaatatacaacccaattgagaaaaagtaaacaaattgaacacttgcaatgatcaatttttgaataacttagtatatctgaagcatataacctaaatcatttcagtttatctaaatgaagttttttaaaagataatctactttcttataatgcttctggttttgagagtcacaatgagatcttttcatctttgatatataaaaggattattgtcaaatatttaatgtgattaatgagactctactcataaaatacactggaattcaatttattttagaagtgtttcaggttctgcctgaaattcatctggattactttaaatataatgaaatagatacataagtaaaccgaagacagcgactgctcaaagcgtttcacataccctttgtttcttcaatattatactctgctagcactccatcagtcctacaaatgggaattttcaattgtctaattggatctaggattggaggcttatgacagaggagctgccgtatatgaattcacattccctgctgcctcaaccatagtagggtacttccatatgtaggtggtgcatatggtgaaaatccatatttatgcacatttataaaattgtggtaagattatgttttcatagtgagatggaattataaccttgattgaattatgccttctgatgaaatccaattactgatttatttgttctccataggttggacatagacatttcttcctagtctatgtaagaaaattttatatgaagaaaggcttaaacaaaaaggttttaagaaaggagatttcaggttattacattgttcctttgtgtacagaaaaggcacattgaatttagtctgttgtgcttcagaaaaatgatctattgttctctctatggcattatgaagataatatcattacatgattcgtggtgggtttgagtgttttacactaaaatgagtgctcaatataatcctaaagaaaaatattaaaaatattcaccatatgaatattttcaaatgtcctgtctaaaataacaaaatacttgatatattactgatgttgttaatcattgttaatagtttattttaaaaacagtttaacattttaattttaatttatgcaataagtactttcagttcattttcctaaactcttaccagtatggtattttgaaagtgtttgctagttaccagaaatataagtgtaacacaaaacaatgcaaaatatttatccatatgtttgatgagctatttttgtcttcttaccctaaagtaagttgaaatacatcggaggatggtatgtttatcttttaaaatatataatttctatgcaccaacacatgtgcatggaggtgggggtggggagcctgagctggatagatgattttttattttttcagaagtaatgattagtatgttttattttctattttagttttatttttaatttttataatcacagatatcacagatgtttttctagatgacatctattccttctagtaccaacatgtatcttgacagattaagagttctctttagtacacatttcattgtatgttgactatgaattttttatttttgtgtgattgaaatgtttttgttttaacctcacttttaaagttactttcattagctagagtattctaggttggaaattcatttcatttcggtactttcaaaatgctgttaaattgactttcaacttctaccatttctgttgaaaagtcagctgtgagtctgatgatgctctttgaggttaatgtgtgttttctttttgctgtttttatgttttctcttactcttttattatcagcagtcatccaattatgtgtctagatggtgtccttttatttctactgtttgacatttggaccattttcaaagcatggcttcctgtctttcattactttcagaaaaattttggtcactatctctttagatatagctttgaccttcattttttccttcttaagacctccaaataaagatgtatgtagcttttcacactatgtcatgttctagtaaactgtactttttcttttaatgctttttccatttatttttgttctctgtgttgtaatctgtatattttatttacagctctcttcccatttatgaatcctcttttttcaccatgtcctatctgtaaactgatttatttattcattttgtatattttttatttttaattttttgtgtacatagtaggtgtatgtatttatggggtacaagagatattttgatgcaggcacgcagtcagtaataatcacatcatggaaaatggggtatctgttcacttgaccatttatcttttatgttacaaaccatccatttatgcccttttagttatttttaaatgtaaagttaaatgagtttgactttagtcacagttgtgatatcaaatactacatattattcattctttcaaactattttttgtgctcattaactgtccccactccctctcaacccccattacccataccagcctctggtaatcatccttctactctttatctccatgtgttcaattgttttgatttttatatcccacaaataagtaagaacatataatacttgtctttctgtgctgtctctctgtgtgttcacttaacataatacctccagttccatccatgttgttgtaagtaacaggatctcattcttttttatagctgaatagtacttcattgtttatatgtaccacattttctttatccattcatctgttgacagatacttaggttgcttacaaattttgactattgtgaaaagtactaagacaaacatgggagtgtagatatcccttcgatatactgatacgttttattttgggtatataccctgcagtgggattgctggaattgctggatcatacagcagctccatttttagttgtttgaggcatctccaaactgtttttcattgtggttgtattaatgtacattcccacccacaatgtatgagggttcccctttctccatatcttctctagcatttgttattgtctgccttttgaatagaagccattttaactggggtgaggagatatctcattgtagttttgatttgcatttctcttatggtcaataatgttgggcaccttcttgtgtgcctattttccatttgtatgtcttcttctgagaaatatctattcaaatcttttgcctgtttttgatcagattattagatttttacctatagagttgtttgaacttcttatatatactaattattgaacccttgtcagatgggtagtttgaagatattttctcccattctatgggttgcctttttactttgttgattgtttcttttgctgtgcagaaactttttaacttgatgtgatcccatttgtccatttctgctttggttgtctatgcttgcggggtattactcaaaaccttttttcccagaccagtgttctgaagcgtttctccaaagttttcttgcagtggttttatagtttgaggtctcagatttaaatttttaagccactttgatttgatttttgtatatgatgagatttaaagatctagtttcattattctgcatatggatatccagtttcccagtatcattattgaaaagactgtcctttctccagtgtgtgtttttggcatctttgttagaaattagttcactgtgggtgtgtagatttgttactgtgatctctattctattccatttgtttaagtgtctgtttttatgccaaaatcatgttgttttggttactatagcattatagtataattcaaagtcagtaatatgattcctccagttctgttatttttgcttaggatagctttggcgattctgggtctttgtggttgcatatacattttagaatattttttcagtttctgtgaagaatgtcattggtattttgaaagagattgcattgaatttttagatttctttgggtagtatgaacattttaccagtattgattcttccaatccatgaaaatgaaatatctgtccatttttggtgtcctttttaatttttttcatcagtgttttatagtctaaattgtagagatctttcatttccttggttatttcataggtatttatttttatgtgtggctattgtaaatgggattactttttatttctttgtcagattgtttactgttggcatatagaaatgctaccaatttttgtacattaattttgtatcttgcaagtttattgaatttgtttatcaattctaatagttttatggtggaatctttaggtactatgttgaataagagttatgaaagcgggcatccttgtcatgttccagatcttagtagaaacactttcaattcttccccatttctatgatactagatgtgggtttgtcatatattgcttttatcatgtgaaggtatattgtttctatatgcagttttttgagagtttttatcatgaaggatgttgaattttattaaatactttttcagaatcaattgaagtgatcatatggtttttaccctttagcatggtttaaccctttagtttatatgatgtatcacactgattgatttgtgtatgttgaaccatccttgcattgcagggataaatccaacatggtcatgatgaatgacctttctaatgtatcatttaattcagtttgctcatattttgttggggatttttgtctcaatattcatcagagatattggcctgcagttttctttttttttaatgtgtctttgtctggtcttggtatcagggtaatactagccttgtagaatgagtttggagttattccctcctcctcagttttttggaatagtctgagtagtatgggtatcagttcttctttaaatgtttggtagaattcaacagcgaaggcatcagatcctgggctttttttttttttttttactaggagactttattattacagctttgatctcattacttattattggtatagtcaggttttggatttgttcatggttcaattttggtaggttatatgtgtccaggaatttgtccatttcttctagattttagaatttattggcatgtagttgctcataacagccactgatgatccttgggatttctgcaatatcaattgtaatgtcttcttttccatttctaaatacatttatttggatcttctctcttagtcaggccagaggtttgtcagttttgtatatcttttcaaaaaacaaactttttgtttcattgatcttttgtatttttctcttaatttcaatttcatttatcttgtctgatctttattatttctttttttctactaattttgggtttagcttgctattgcttttctagttctgtaagaagcatccttaaatcatttatttgaagtttttcctctttctgatgtaggcacttacagctataaactttcctcttagtactgctttagctgtatcccatatgttttggtatattgtgtttccattgtaatttgtctcaagatatctttcaatttccttcttaattactttattgatgcactggtcattgaggagcatattatttaatttccatgtgtttgaatagtttccaaaattcctcctgttattgatttgtagttttattccattgtgatgaaagaagatgcttgctattacctcaattttttgaatgttttaagacttgttttgtgacttaacttatggcctgttcctgagaatgatccatgggctgaagcaaggaatgtatattctgcagattttgggtaaaatgttctataaatatctattaagcctatttgtcctatagcacaagttaagtctgatgtttctttgttgatattctgtctgggaggtctgtccagtgccaaaagtgggatgttgaaatctccagctgtgattgtattgaggtctatctatctctttaataacatatgtttttctatctgggtgctttagaattaggtgcatatatatatatatatatatctacattgtatatatctacatgtgtatatatatatatatatctacattgtatcctgttgctggattgactcctttgatattatatagtgaccttctttatctcttcttacagtttttgtcttgaaatctattttgttagatatatgtgtagctactcctgcttgcttttttaaaatttccattggcatgtaatatctttttccaaccctttattttcagtctatgtgtatctttatagtagtgtgtttcttgtaggcaaatagaacatggggctttatttttttatccattcagccatactgtgtcttttgattgaaaagcttattctatttacattcaaggttgttattgataaatagagacttactctacagccatgtgaccctgaattcacccaatctcatctgatcttggaagctaaacagggtcaggcttggttaatacttggatgggagacttactcctaccattttgttgttttctgattgctttgtggccttctcttccttttttactgtcttctttccatgaaggtagttttctatggtgttatgatttaagtttttggtttgtattttcagggtatctgttgtgtgattttcaattcgaagttaccatgaggcttgcaaatattatcttataatctggtattttaaattgatgacaatactgattgcataaacaaacacacaaaaggaaaattaataaaaactccacacttagctttattcctctgctttttaactttctattgtttccctttatgtcatattatactgtctacataacaattgcagtgttatggtattctgtgttttactgtgtgcttactattaccagtgagtttttatctttagatgattcttttcttgatcatcaacaccattttcttttagattgaagaactttctttaacatttcttgtagaacaggtctggtattgatgaaatccctcagcttttgtttgtctgggaaagtctttacttatccttcatgtttgaaggatagttttgctggatatactattctaggataattttatttttcgttcggcactgtaaatatgtcatgccactctctcagcctgtaaggttttcactgaaaagtctgctgccagacatactgggactcacatgtatgttatttgtttcttttctcttgctgcttttaggataatttctttatccttgacctttgggaattcaatattaaatgtttcaaggtagttgtctttggcttaaatctgctaggtgttctataaccttttacttgaatgttgatatctttctctaggattgggaaattcttggatattacccctttgaatatactttctatccctatctctttctctacttcctctttaaggccaatatccattagatttacccttttgaggctattttttacatcttataagcatacttcatttttttattattttttcttctgtctcctttgactgtgtattttcaaatagcctgtctttaacctcaccaattcttctgcttgagcaattctgctattaagttactctgatgcattcttcaacatgtgaattacatttttcaactctagaatttctgcttgattcttttcagttattttaatctctttgttaaatttatatgattggattctgaactccttccctgtgttatctgcaatttctttgagtttccttaaaacagctattttgagttctctgtatgaaaggtcacatgtctctgtttctccaagattggtccccagtgacttatttatttcatttgttgaagtcatatattttcctgcatattcttgatgcttataggtgttctttgctgtctgaccattgaacagttaggtgtttattgtagtcttcacagtccagacttgtttttgcctatccttcttgagaaggctttccagctattcacagggacttgggccgcaagcccaatatcactgaaatttttgcagacttgtaggggtcctgccttggtggtctttaataagatctgtagtaattctctggattaccaggaagagactgttattcatttacctcactttcaggtaaacaaataagagtctctttctttctgggctgacccagctggaactaagggtatggttatgcaggcacttctgtggccagcagcactagactttgttgggactgacctaaagccagcacagcactgggtcttgcccaaggcctgctgtaactgccacctggctaccacctatgttcactcaaagtcctaggcctccgcaatcggcaggccaggtttttattcttttccccagggcagtgagattccccaggctctcggtgactccagagatggtttctgaaagtcagggattagagtcaaaagtcttaggaatttgcctgatgttccattctactgcagctaaggtgaaagtcagaccacaataggaagtccttcccactcttccttctccttttcacaggcaaaggagcttcatctggtgggcatcaccaccactggcccatggtggagttctgccaggccactgctagtgttcacttaatgcccaagagttcttcagacagcttgtggtaaacgctgcacagcctgggactcacccttcaaggtagcgggctcccttctggcccaggacaggcctagaaatgctaggagcccgggcctggactcagggaccccaagtgcctgcttattgctctgccccactgtgtgcaagctggtacctaaggtgcaagaaaatttcccctttacttttccctctgcttttctcaaatggaagtcttttataatagccaccattgctgggaatcttctgggtcacatctgaagccagcatgtctcagggcccaaggcccattgtgtactctctggggatcgttgcaggttattcagtgcccaagagctctttagacagcaggtgatgaatcttgccagaactggattgtttcataaaagcaatggatttccttttggcccagagtgtgtctagaaatgttatctggagctagggccttgaatgcctctgcccagtaccctctcctactgtggctgagtaggtatccacaatacaagacagagtcgtctttactctttactctccaccccctaagcagaaggaaggggacacttttgttcctgtgagttgcactgccttgggttgggggaggatggcataagctcttcttcagctgccccagctgatgtctccccaggtcacatgtcaccttagtcctctggttctgagtccagcctagcactaggaattgtagtccttgcattctagactgcctttcacatttacctaggaccccagagcactttggcccatgatggcaagacttgtccagaaacttgagttctgaccactgggataggcaattcccacctggctaggtctagttcaaatgctccctctgtgcacaggcactggctgagtccagcaaggcttactctccactattgcagggcagcactgagttcaaagtaatgtccacctgttgctgtgctctccctcctccaagtgcacagactttcctcatgtttagccactgccataggataggggaggggtggtatcagcaattaagactgtctctcagaccctcctcaatgcctctttcaatgatataacattaaaaccaggtactgtgattgctcacctgatttttgtgtcttgtgatggtacttttctgtgtgcagataattgttataatttggtgttaggaatatgaatggtgtaggcttctattccatcaccttactccaccctcttaaaccaatttattgaattaataatttcagttattgaaatttccacttctagtatttccatttgatttattttcttatattttaggtctcataaaatttttaaaatttctcatctaatttctcaatattcttgaatatcatatttagtagaaagtctgaggctgataactccaataacagggttatgtgctggtctgtttgttaagaatttttaaattaaaatgtctcatacttttttatttaaaagtgaaaaatgtgtatcaagaattgtagaagttttgttatcttcctttagagaggatacatcctgtctactggaaagcaaatagggtaagagtaaatcatctaatccaatcacaggctggaatgactggagactaattttaaaattttacaagactctatgtattccttgtatgaccctgttcctatgttgtaggacctgtggggcctgtgggccttgactctttaataaggtcttttcttcctgcagagtccagaataataaattttatcttctcatttgtgtgtgtgagattgctgaatattctgccctaattttcagcagctttctgataagcattttacttctctctctgcaaacaataagattttaacaaatgccttggtgtggcacatacttttatctgtatgccttttcaccaggacgtgggaattacgtgttcttgttgccttgacaaatgccttgagagcaaatatggcttgtacaaggtcaattcatttctgtgtggtttccctctatctgggatgttggctccacaagtcctagctagctctgcaactcttctttaagaaaagttaatttattttcatatttatttatatttactcagcttgtctaattgttttcagaaggagtgttaattcattacatataatttaatcatagtcaaaagcataagctcttcttttatatcttaatttttatgttgaaacatttagtcaaaatgtttaaaagaaaaaaattatattcttatggcacagtagagatatataattgtacccatagagagatgaatatagcaaaacaaaaatgttttagaatctttagccagtgcttttttattgtcacagaagtaatattattcttgccaaattaccatctttcacatcaggaattaaacaaccatttaaatctattttgtataaaataacaaattgtagataaaactattaatctggcacaaattacttgtaactgagttccaactaagagctctttcttatttaatagcaaaaacattattaactgaacaagaagtagaggcagtagcaatttgacctctgcttcattgaggtgacatttttcaggcctatggttttctgagtaatccccatttctattatttcatgtccattataaaaggattggaaggtgctacagctcactactgcatgtgttacagttttcactgttttcactaaaattgcctataaatcttgatagaatatattttattaaagatgctctgcagatgtgggaaacactgtattagaccagatcacatgattttaagatatcattcaaaactgcctgtgagacattgtttctgatttaaccatcagtattgttgcagcttatggttaatatatcgggtagttctcatataatccaaattagacactatttactctgtgagatgtggattatttgtcttctgtgttgtttctaatgtgcactgtaattttaatctgtgccagatgatgcaggagtgaatgagagaaatgccatcttcccaacaccgatgaccatgattggctcccaacacagcacggtctcagctccagcctgatcaagtaaaagttaggttgtcagtgctgaacattctgaggctggagaatccaagtttgtgttttttgtttttgtttttgttttccacaatcccttccagtttaagatctgttttaggcacaatgagatcctgttggacggtctgagtgaaaattcatttaggtttgttcagaagttagcgtggatttagataaaattctagactcagtggctgcttggtcatgtccaagaagggaggtttccatttgtattttgggctgacatccttaatctgtccctcaacccaaagtctgatgacttggttttgactttgttcctcaacactacatctaccaccatgggaaggagtttattgcatggtcaaaaacaagcttcaggagaacgcacctcacagccagtcttcctttccattggaatatcttagtcacaagcacctagattcatccaagttgtttttttgtatcaataacttattattgtttattgctcagtagtatttgatggtatagatgaatcacagtttccatgtcagttgggacaatgacataataagctagatggcatagtaatccagaatcacatttcacctctgagatacccttctatgaagggcgtgagcctccatggatgcatacccagcctccttcccaggaagctcatagatttcatctgactgtgggaatctaggtcctggcaatgggctgtagtgggacctcagcaagtctcttgtcacatctggagaaaaagataatcaagcctgcttaacagctgtagggtaccatctgcaggactttaggcatattatctatacccaagatagttttgaaggaagagaagatgttgagaatctcttaaactcagccccaaaagatcacctcatttctacttcatagacctacaaaagcatgttagttcttaattctttcaaacttcagtgctttctttactccccacataccttttatatttgacagaaaggcattattccactttttcttcatgagtactgatgaccaggaccaccttctcacagatttccctggtctgcttgaagttgttcttgataataatttcagtaaccttttgatcatctcctaactaggcttgcgtttctccagatgatgggatgagggtgtgtgtgtgtcatattggagagacctactttgctccgattctggtcttctcagtggaaacttcaagctcacttctgtctgcaacttgattttccctctatctatgtgctcttacaagcatcaaaaatgattatgaatgaagaaataagtcaggaatcggaattccttcccctccagttttccttcactgcctgctatctctttttgtcataatgttctatggatggtgctgtgatagcagttggtatacaatggtttttatattaaagttttttgatggacaaaaagatatactgtacatttttactattgatattatttttgattgataaatcataattttatgcatttaagatatttaatgtgatgtcttgatatatgtatacaatgtataatgtctatgttaaactaattaatatattaatcaccttatttatctattttctttatggtgaaacatttgaaatgtactctattacagatgctcctcagcttatgatgggcttatgtcctgacaaactcatttaagttgaaaatattgtaaatctaaaaggcaaactcatgtaaagttgaaaaatcataacttgaaccattgtaagttgtaggccatctgtactttgaaatgtagcatacattattattaagtataatcactcttatgtgcaatagatcccaaaaccttatctcctatctatctgaaactttgtactgtttggtcaccacctccccatttccttcagcttccctgcttatcctctggtaaccatcattctactctatttctgtgagttcaactttatgagtccactgtatatatttgtggacttcataaggtccactttatccatctataaatgagatcgtacagtatttgtctttctttgcttggcttatttcacttagcataatgttctccatgttgttgcaaatctccacttcccctttttaaatatttattttattttcattaatcattgaggcagaattgtacatattcatggggtgcattgtgatgttctgatacatctataaattttataatgatcaaattagggaaattaggatattcatcaacttaggactgcctttgctccattccataggtttagcatgttgtgtttccattttaatttgtctcaaggtatttttaaatttcctttttgatttacactatgacctgttggttatttaggagcatgttgtccaatttccacatgcttgtgtattttcctagattttttcctattattgatttctaattttatatcattgtgctctgaaaaaccgcttgatatgatttcagttctcttaaatttgttaagatttgttttgtggcataatatgtgatctatcctggagaatgttccatatgcacttgagaagaatgtgaatcctgttgctgttgagtagaatattgtagatatttctgtcaggtacgtgtgatctaaagtataattcaagtccatgttcccttatttattttctgtctagatgctctatttttaaaagtggagtatcgaggccccctattattatagtatctttctttagataatttaataattgctttatgtatttatgttctcagatgttgggtgcatatatatttacaattgttatctcttcttggtgaatcaattcctttattattatgtaataacctttttgtcttttaaaaataacatttgacttaaagtctattttgtctaagtgtaactactcttattctcttaatttccatttgtgggaaatacttttttccaatcatttcacttttaatctgtgtgtatctgtactagtaaagtgagtctcttataagaaaatatggttggatcttgttttttaatccattcagccaatctatgtctttttattgaagaatttaatccatttacacttgaggtaattactggtacataaaaacttgttgctggcattttttaatttgttttttgattattttatatgttttttttttcttcctctctttctgtcttcatttgtggtttgatggttttctgtggcggtatgctttgaaccctttctttgcatattttgtgcaactactgggggtttttgctaagtgggttaccaggaaatatcctgtaacagactactttaagctggtaacaacttgcttttaattccatacaaagactctacactttcacaaccccacacatactttttattaatttaatgccaaaatttacattcatttttgtaatttgtatttcttagcaatttattgttgctgcaattatttttaataattttgtcttttaattctcctagtagagataaagttgctttacacaccacccttacaatattagagaattctgagtatgaccacatattacttctaccattgggatttatttttaattttaaaatgttattttaattattcattagtagcctttcatctcaccttaaagaactacttttagcaattcctataaatcacgcctagtggtgatgtatgctcttagcttttgtttgtctgggaaagtttttatttctttctcatttctgaaacatagctttatttggtaaagtattcttggttggccatttctttttattccttcagcactattaatatagaatttgcctctcttctggcctgaagtgtttctgctgacaaatctgccaaaagccatattgtgcctccactgaatgtgatgtttcttatcttttgctgctttcagtattatttctttgtatttgatttttgataatttgattataatgtatcttggtgatgtcctctatgggttgaatttgattggcaacctgtgactgagatgcctgtacctggatgttgttgtctttccccagatttgggatatttttagctattattttctcaaatatgctttctaggcttttttctctttctttttcttcatgaattcctactatgcaaaagttagtttgctttatggtgttccataattcctatagaccctcttcattctttttcattcttatttatttatttatttatttttgctcctctgatcgattggataatttcaaatgtcctctgagctcactgatctacttgatcaagtctgctattgaaactttctatttaattttttagttcactttttgtattctttagctccagaatttatggcttcataattttttattatttatgtttctttgcaagcttctcattttgtttataactttttcccaaattttacttgattttctatctatattttcttggaatttcctgaacttctttgagtagtgttctgaattttttgttagtcattttatagatctccatttcttctgggtccatcagtagagctttattaacttcttttggtggtgccatatttccctaatttttcatcatcctcatgtacttacattaatgcctccacatttgaggagatggctatttcttctagcctagtctagcttaaaaattctagatgagacagcttgtagcgaccccaaacagaccttaaggttgggttctctaattagactgggtggattcttgtgctctgaatttgaatggtatttctaactgttctccatggttcagtgaggctactatctggactctgccatcaagtagagctgctggctgggctctgcagtcatctctgatcagacaggtttgcaggttgtcttccatggctgggtggcactgctatttgaaatctgcagttgggaagggccatttgctgggatccaaggctggtgaagtacctaggattgctgcttggtcacagaagtaggcagagccagaggctatgctttacagatgtgcatggacttagacttgcctgctggcttaatgtgagctgaagaagagtatcacggttttgtggagttactggtttacatgcagttgctggtttttggcagtactagatgatctattcacgggtactcactgacctgcatttgcctctcacctagaaaaagcttaacgagagcatctgggctgggtggaaaagctggctagggattcaagcctgaaagatccatgaactggcgtggagcagtggctcacacctgtaatcccagcactttgggaggctgagacaggtgaatcgcctgaggtcaggagttcgagaccagcctgaccaacatggcaaaaccctgcctatactaaacatacaaaaattagctgggcatggtggtgcatgcctgtaatcccagctacttgggaggctgaggcaggataattgcttgaacctgggagatggaggttgcagtgagccgagattgtgccattgcactccagcctgggcaacaagagtgaaactctgtctcaaaaaataaagaaagaaaaaaaaaaagaaagacctgtgaaccatgtttcctgtagtgtgatgctgtcagctagtctctctggtttgacaccattatcagcccaaatatagagtaactaccaaggtctgcaagctggtcactattagctctatctctgttctttgtttctaactaaactcaggtaatctagccatgctggcatttccaatgtttcccatgggatgagacagatatcagtctcctgaaagggttccaaaattgtagggaaacttaatgtttgcttccaacttatttttcctactgtagaaactgtgggttcaggaaaaatcttagtgtgtgttcctgtgccagcttgggagaggggtggcacaatcaaggagaatcattcatcttaccattgggatcaaaattttctcagtgctttggtccaaagaaaggagtgtccttgactcacttccaaggtgtgggatattcagaattatcttcttgcctgcggatagttgctggttagatttctgtggtaggtaggagagagtgaagctggagaactcctattctgctgtcttgctaacacactactctgtgtgtgcatgtgtgtatgtgtgcgtgtgtgtgtgtgtgtgtgtgtgtgtcaccaaacatcaattgaagacatagttctgtaacactatacctggacaccctcaggactgaaatcatttttgtgccattaagcagttgatatattaacactactgggttcaattttcttgagtattttgtaaagaatcacatactaaatgtaatatcttttctgcaaaccttcttctagtctctagttttgtgttactgcattgaaacttaaagtcacattacaatccccaaaatacataattgtcatgctaagttgctaactgacttttaatgattctgtaattccaaatagctaaaagcatgtgaagtttaaggagctccaataatggctataactaggttttccaactttcttctgaaaatggtagcaaagtaacaaagttaacatttgatgagtgactagtctgtggttggccctatgctgaatgatttacttgcattattttatattattaccctcataaaacatcatcattcctactatacagatgacaaaactagttctagaatggttaaataactttctaaggtcacacaattagtatgtagtacaaccataaattcaacccaaacttcacaaattccaaagccaagtttattaaccattgtgctataatgcaagtttgaagtctggaacatcttcatgtactcatattaatcactgagcagcctttgtttttcttatcagtcttagcaggtatgatatcttgtttccaagcttttaaaagctttatagcatttgctaaagtgttcatttttgaaggactagatttaattacagctgtacagcgtctaggaaaatatagcatccttactcttttcgttccatttctcatccttatttatcaatgtctggtttcaaaaagctctatgacctgaatatttccctctaaaaatttatatgctgaaatcttaaccctgaaagtgatggtattaggaggtgaggcctttggaaagttattgggtcatgaggggtctacccttatgtgattagtgccattacaaaagttccctagagagctacctgctcctttcaccatgtgggaacacagcaagaaggtgccatctatgaactagaaagttgggcctcaccagacttgccgctaccttaatcttgaacttcccagctttcatagctatgagataaaaattttgtgccttataagccactcagtctatagtacctatttcaatacaacagctacagaaacaaagataggaagaatcaccaactctttctttttctttttaagaatatttgaattgtgtttattctaagatctgcccccgatttatacttttccttttcctttttttttttttttttttttttttttggctagacgctatcattaattgctagaaaccactaatgtgttttccatctgtataaggttttttttttttttttgagattgagtcttgctctgttgcctaggctggagtgcagtggcgagatctccactaactgcaacctctgcctcctgggttcatgcatttctcctgcatcagcctcccgagtatctgggattacaggtgtatgccaccacacccagctaatttttgtatttttagtggtgatggggtttcaccgtgttggccaggctggtctcaaacccctgacctcaagtgatccacccaccttggcctcccaaagtgctggggttacaggcatgagccactgtgcctggccataagttttctttttctttttgagactgtaatataaataaaattttatgattttaagatgtctgtttgaatgtaagtcttcatttatctgggatacctgtccagagtataatttaattgttgagtcacatgatagttgcatgcttcatttttaaagaaactgttttttagagcagttagttgtaacattttgcatacctgctaacaatgcatgaatgatttagtctgttcacctcctcaccagcatttagtgtcattactatatcttattttagccatttttatagtagtgatatctcattgtggcattattttgtatttctacaatggctaatgatgttaaacatcttttcatgtgcttatttgtcatctatagatcacctttcagtaaagcttctctttctgttttttgaatattttctaattgtttttatttagtgttaaagttttatatttctttatgcatcctagatattagctatttattagatatgggatttgtacatgttttcaagtctgtagcttgtcatttcatcctcttaactagaaatgtttaaattttaatgaaatctaacattgatatttgttcttttacaccacttttatttttaaaaaggaaaaggtaaggaaccgagaaaacaaggatttacccaaatttttgcaggaaagaaaatcaggtttttgcttcattaattgcttatagtgaggtgttcaatagatgggtatgccaaccatcttttccctattagcttatccctagactattcttatttctgttgatatacagatttagcataaaatattttcttgtataatcttgattaaatccttacttgctcattgtgatcctctgtaaatcacctgttattattataaacaagcacaatttcaactacttttaaattttattttatattattacaaaagtattgagaatgcatcagttttaaccaataatataaaatttttggctttgtgctgattagaattaggtgggtttgtgttgaattctagattcaaagtgaattaattacttgaatagcaaaaataataccattaggaatgacactgaatttgtagagaaggaaattgattcctagaccagaacttggctctgcaatgaacaatattaatatggttattttagtgtaataaaatttattgttttccgatgatagactcaaatcaacaaaagatggaaggccaacttttggtggctgaacatgctgggaatgttataaacttgaaaatgtaaaaataaatttatagttcactaatgttagaaagtagctgttaaaatgagactagaacattaaacaggaatttattaatctttttaaataataatattataacatatataacagtttggaacatataaaactgcctatatttgataattttgcctataaaaatgttgacttcatatgattaaagttaatactaaaataattatcaacattagagggaggagatagagaatgatgagaagggatggtataagtgaatgaagtcttcatgattctggcaggacattgatataaaagggtctaaggaatcatattaaaagagttttcctacaaagattatcctttatagttattacatttattataccaattaaattcagtttgtaactgtctaaatacttttaaacaaactctttcaaacacatctttgaataataattgtactaaagatttttcatttttttattaccctcctcatttgcagcattgcctttctacagcccattggctgaaaaacctagaaagttgtgccagatacctaacaagagaaacactaaagaaggagaattaaataattgatgtgatttattctgtaatcaacctctattatattcaatttgatatatcttcctggagtttccactgacataaccagtaaacaaattttcagaggaaaacacaaaaaatgcatattattttctgcttgcaaaaattctgtttagagtaaaatttgtgtctgaaaattaattattgatgatccaataaaaggatcatgtttcagacccaaatgtgattgtttttacagtaaattatggcaggaggatagaatacttggttgatggaatattagggttaacagcatttgagaaaaataatagcatgataatttttctgtgacagacactttcacaatgtctttcatttgacttgtttgaagccaccccaatttttctaggggagttgattaaaagcctcagatttgatgctacatagattccagtttgaatcttgatcctcatattcaggagctgagtaacctagtataagttacctaatatctgtaatccccaggtttctcatctataaactgaaactaagaatatctatctgacagtgcagttggtaagatatagaaaataaatcacaatgcttggtacataatgatccctcattaaatgacaggataatatctaatgatttattattgaaaccgaattattaaaattgagttaaagctctcaggtggtttccaaattgattgactgtaactttttcattgatatcatgttctctttaatgactagagacatagattaaccctggatgtgcctgtattataaaacaagtaatgtccttgactctgacgatggtatctaagctttaaagaaagagatgtaattagagtgcaaatttggaggccaggaactcatcacctttactatagtccttactacctggttttcggtagagcaaggactccacaaagggggagaacagaggaaaagcaggcacatgatggctctaggagggaatgcgaatagctacaaggtatcaaggcatcctgttggtagaaatccctgggaattcctcttggtactgccctagcagtaataaaatatcaatactactacttgtcaatattgatggagcatatactatgtagtcactacgttgaaatctttctgaatattatttaattctcagactaactttataagatatatataagagcatgatatcagatgtaccagagtccatctcagctctatctcttagtagctgtgtcaccttggtagattatgtaactccttgaggactcttttcttcttctgtaaatggggaacttttcttgataattataatcgtggacagaagtactgaggcttaagaaagactcaagacctcccagcaaagcaagtatatgcaaatgtagaatatggttttaggtgtatatatattcttaactttcctttaatgcttctctctatacaagagtaagaatatacctaaaatatggtacatagagaagtgaatattgtgtatatattgattagagtcagggcaagtaaaaggtaaatttagtacaatggaatcattttgatacttttgattttaaaataggtaaaagttctaaatttttacttactaaaaaagaaatcatctgagttatttcattcaaatgacatattttagtaattattaagtgcaagacagtatttatatggactgtgtgaacaagatcacttatgaaaaaaaaatatcctgtggtcgactttaactctgcctttgtgacttgtacttcagtgtgtctgtttttataaaaaggtctagaatcaaaatctgttactgtcaaactagagttcatcagattgctaggctatgccccaaagtgttggattagtgggtgagaggtagagcatgtgaatttgcattcctaataagttcccaggtgacacagatactgctgatctggagaccacacactaagaacagctggctcagatcaatggttctctattttaatgttgcagtatttccatgtggttggataagaagtttggaatatgtgttagtccattttcacactgctggtaaagacatatctgagactgggcaatttacaaaagaagtaggtttaatggacttacggttccatgtggctggggaagcctcaaaatcatggtggaaggcaaggaggaacaagtcacgtcttacatggatggcatcaggcaaagagagagaattcactcagggaaactcctccttctgaaaccatcagccctcgtgagacttatccactgtcacaagaatagcatgggaaaaatttgcccccatgattcaattatctcccactgggtccctcccacaacatgtgggaattcaagatgagatttgagtggggacacagccaaaccatatcatgccacccctggctcgtcccacatcttatgacctcacatttcaaaaccaatcatgccttcccaacagtcccccaaaatcttaactcatttcagcattaactcaaaagtccacagtgcaaagtctcatccaagataagacaagtcccttccacctatgagcctgtaaaatcaaaagcagcttagttatttcctaaatacagtgggagtacagacactgggtaaatacagccattccaaatgggagaagttggccaaaaagaggctacaggccccatgcaagtctgaaatccagtggagcagtcaaatcttaaagctccaaaatgatctcctttgactccaagtctcacatccaggtcatgctgaggtaagaggtgggttcccatggtcttgggcagccaagcctttgcagggcacagcttccctcctggctgctttcatgggctggcattgagtatccacagcttttccaggcacatggtgcaagctgttggtggatacaccattctagggtctggaggaaggtggccctcttctcacagatccactaggtggtgccctggtagggactctgtgtgggggatctcaccctacattttccttttgcactgccctagcagaggttctctatgagggccctgcccctgtaacaaacttctgcctgggcatctgggtgtttctatacatcttctgaaatctaggtggagatttccaaaccccaattcttgacttctgtgcactggaaagctcaacaccatgtgggagctgccaaggcttgaggcttgcaccctgtgaagccatggcctgagctctatgttggccccattcagtcatggctggagtggctggaactaaagtcaccaagtccctaggctgcacacagcacagcgactctgggcctggcccattaaaccactttttcctcctaggtctctgggcctgtgatgggaggggctgccatgaagacctctcacatgtgctggagacattttccgcattgtcttggggattaacatttggctccttgttacttatgcaaatttctgtagccagcttgaattcctccccaaacaatgggattttcttttctaacacattgtcaggctacacattttccaaacttttaggctccattttccttttaaaactgaatgcctttaacagcacccagtgctttgctgcttagaaatttcttccagcagataccctaaatcatctctctcaagttcaaagttccataaatctctagggcaggggctaaatgccaccagtctctttgctaaaacataacaacggtcacctttactccagttcccaaaaattttctcatctccatctgaaaccacctcaacctggatttcattgtccatatcactatcagcattttgggcaaagccattcaacgagcctctagggagttccaaactttcccatattttcctgtattctgagccccccaaactgtcccaacctcttcctgttacccagttccaaagttgcttccacattttcaagtacgttttcagcagtgtctcattcttggtaccaacttactgtattattttgttttcatgctgctgataaaaatatacccgagactgggcaatttacaaaagaaagaggtttaatggacttacagttccacatggctggggaagcctcacaatcaggcagaaggcaaggaggaggaagtcacatcttacatggatggcagcaggcaaagagagagaactcgtgcaggagaactcctctttatgaaaccatcagatctcttgagacttattcactatcatgagaacagcatgggaaagacttgcccccatgattcaattacctcccactgggaccctcccacaatatgcaggaatttaagatgagatttgtgtgggggcagagccaaaccatttcagtacaaataattcattattaaatataaactagaaattttgagaaaagaagtaattaaatgttagagcatatttgtatttacccttgttatattgttcctgatgtattaaccaatatattgggaattgtgcatacgagtatgctgtacatactaatgtcatgcaccttatgtgttgaatctaaaaataagcttgagaatagctaggatacaaaacatttgttatcttcctctttttttggctactcacttataccttttatctttctttgtcactgtcatgtcaaagtttccagtgacttctgctacgtcactgtctgcacacgtcttcctttctctactactcctgtcagtatcttgggtgttctcagtagctagtaagacagagaaggaggaaagacatgtgacaggatatgcaagaataaagaaacccatggtgtttgtacagcatcataaagatgcaagagcaagaaagatgcaagtagcaagatgttggacaagagtgcaggtaaagcgtgttgcctttagcagaaacaagcatacatgaaccattaataccagagagagaaatggctgtgaatggaggacactggacattcataggtcatattttacaatgaacgccctcagaaggaggaagtagtaattttttgaaggcatgaagttaaaatgaaaagttattaagagccaccgaagagaatgaaacagtcagccgactgaagcaagtaaaactgactaccaactttgaaaggataattgttgctagaaaacaggtttcatattggcaaacattccaatgtgcttttattttgttttgttttgtttttcttccatcgacaatatgcaggatttaaaaaaaaaattaaaaaaaaaaacaggctgggcctgctggtggttcatgcctgtaatcccagcactttgggaggccaatacaggcagatcacttgaggccaggagttcaagaccagcctggccaacttggtgaaaacccatctctactcaaaatacaaaagttagccaggcatggtggcacatgcctgtacccccagttacttgggaggctgaggcaggagactcaagaatcacttgaacccaggaggcagagattacagtgagccgagattgtgctgctgcactccagcctggggtgacagagcgagactctgtctcaaaaaaatgtaataaataaataaataaatggagagtgagataaactcaagattgatccaagtatgttggagaaaccagagtgcatctcatttactgtactcatctaaaggttctgtcatggaaactatgtcaatgagaaaacataacacaataagtatggcaagaacatattcttgcatgtcagaatttagttgggaatttatgaggaaagtaatctttttcaatgtgacaagtgtttgtggtttagagttcatagaaaataattttgaaatagcttgatcatttttgacccactttcagtaatataattcacacgtaaacaaaaacccagtgggcaaagttttgattctttaatgtattaagtaggaactttccttaactaaaaacataaaatagtcaaaatcaattgaaagtacatgtgacttaaagtattcaaaaacaacacataatttaggttaggaaacaattagaatttggaaggatgcataagagtgaaaaaattaaatgttttgtcaatattgtactcagagtcttgaaaagaagatagctatgtagaacatttataaacagtgtttatgttttaagtgaaatatgtgccgaaatttatgtaatatctgggacagatagactattggcatgaactcatattgcagtttctgaatatgtcacctgatgaactaaatttatgtgaaaaatgcaaatatagcatgaagataaatagtattccaatgaataaaaaatattaaggtatcatgatttattagctcagttatagaaaatgcaagtataaccgctacacttgatagcagtttcttgtttgaagataaaactgtactgtcagactactcttcttagctaaaatacaaagacaataaaaaaatttaaaaactatatcctccatttttttgttaaaattagaaaacagctaagatcctggaaagccaaatgggtggatggttttgtgaaggctgaatgaagactgagtaggatgcattgagaaaaggccccacaaccacagatctcctaagagtccagctaaattattcttctgacagttgaggcacaaaaccccgagatgccagaaatatcttacttcttaccataaaattaggtttgcaggtgcatctgcaggtggcagctgatgttctagacccaaaggcaaggctaagtaaagaaccactcacaggaagcacagtctgtctctttgacagagcaggaggagagtatcttttcatttttaagatcgtcagctgcccatcttcactagtaggaaagacgttaacagctaagtgaattaatgggcaaaactctgtatcctaagaatatgcccagatggttgtgaaagtcgttgtggtacttttcaatcaggtgaatgccgtatcaaatagcttgtccaagcaaaacttcttttagataatttttttttctataactgagctcataaatcatgagttcaatgatgagttaagaaagaaaaagtacagaagctttagaaatataatgcaggaaaataatcagaaaaaattggcagaaaataaaataggagatgaagaatgcatgccagaaacatagaatgagaagcagaagaaaatggcattttactatgaatttttaaaaatctctgtgaagcaaaagcaccaaatcaataatgaaggagcttaggaagagataaacaagaaaaaagaactatgaactggcagagtgcagcaaggaaatgaaataaataaaatgaatccaggaaaagagagaaattataagaagcaggactcgatactgctgaaaacaaagtaatagacatagtaggataaataaaaacacatctaacatgaaaatagtttagcataaagtttttaaagggtttagaggttaatcaatagatacatactgtagttttctattgactagagttagcatggtgtgccctttccacctttttacttttaactgttatctttacatttaaagcatatattttgtaaacagtatatagtttgatcttattttttattcaatataaacatctctatcttttccttgggtgtttataattttaaatttttgtaattattgattttaatatgtcctgttcgttagatttaattgaatcatctaactattcgattcctatttgtttcatgtgttctttatttacttgttttggtcttctttcagataaattgagtttttgttgttgttgttgttgtttttgacggagtcttgctctgtcacctaggctggagtgcagtggcatgatctcagctcactgcaacctctgtctcccgggttcaagagattctactgcctcagcctcctgagtagctggggctacaggtgcaccgcccagctaattttcttttttatttttagtagagtcagggtttcaccatgttggtcaggctggtcttaaactcctgacctcaaatgatctgcccgcctcagcctcccaaagtgctgggattacaggctacagcgcgtggccaaattgagtattttttagtgatctaattttctctcatttgttggcttaaaaacaacaatatcgtgtcatttaaaaaattattttactgtaattgacaaataatgattgcatatatttgtggggtacaatgtaatgttgtgttacaaatataccttgcggaatgtttgagcaggctaatcaatatatttattacctcacctacttatcatttctttttggtaagaccatttaaaatatattcttttattgattttgaaatatacaacacattgtaaaatatagtcaccatgttatgcaatagatcactataatctattcctcctgccttaactgaaaccttgaatcctttaggtaacatctcccctttccccactccaccctcctgccagactctggtaaccaccattctactctctacttctctgagcttgactttttcaggttccagctataagtcagatcatgcaagtatttgtctctctgtgctcggattatttcatttagcataatgtccttcatatacatctatgttgtcacaaatgacaagatttacctttttataatgctgaatggtattctattgtgtatgtatacagcatttttttctttatccattcatccatttatatacacttaggttgattccataccttgactattgtgaataattctgtaatgaacatgggaaggcaggtgtctccttgaaatactgatttcagttcctttgagtgtatacccaggagcagtactgctggatcttatggtgattccattttgttttttcgaacctccatactatattccaaaatgactgtacctatttatattcccaacaacagcgtatgaggatttccttttctctacatccttgccaatactagttatctttcatcattttgataattgatattctaacagatgggaggtgatacctcattgtaattttaatttgcatttccctgatattagtgatattgagcatttttcatacatctactgtttatttgtatgtcttcttttgagaaatgtctattcaagccttttgcccaatttttattagggttgtttgttttcctattattgaatgtctgggcaatgatttcttgaatatgaccccaaaagcacaggcaacaaaagcaaaaatagatgcatcaaatgtgaaaaaaaaattcttctgtacagcaaaagaaacaactaacagagcgaagagacaaggcaaaattgggagaaaatatttgcaaatcttatatctaataagagaagaacatctaaaatagataagaaactcaaactatgatttcatttttaaatttttactttagtttatatactttaacttttcacagtctgccttcatatgatatgatactacttcctatatagtaaaagaaagttaaaacattacgcttacttttctccccttctacactttatactattatattatatatatatatatacaaaaaatatatactatatattatataaatgttatttataccaccatagatttttaaaattatttttgcttaagcagacttttttttttttaaaacggaatttcgctctggttgtcctggctggaatgcaatggcatgatctcggctcactgccacctctgcctcccaggttcaagtgattcttgtgcctcagcctcctgagtatctgggattacaggcatgcaccaccatgccaggctaattttgtatttttagtagagacggggtttcaccatgttggtcaggctggtcttgattgaactcctgaccttaggttatccgcctgcctcagcctcccaaaatgctgggattacaggcgtcagccatcatgtccagcaagcaattctctttaaaaagaatttaaataatattaaataataaataataacaacatgtttatattcattcatgtacttaaccattttaatgttttatttattttttcctatagatacatatttctgtgtgttttctttttctgtgtaaaaaacttcctttaatatttttaatggtgcagccagctggagggaaattttaccacatttatgtgctgaagcatgcttatctcaactttttaaaaaattaacatatcatttttaaatgatcaaaatataattcacataccataagactcacccttttaaaatacacaatttaatagtttttaatatagtcatcatgttgcacagacctctaatttcagagcatttttgtcaccacaagaagaaaccccatagtcattagcagtcactcccaattcttacccactgcactcagccccatccaacccctggcaatcactgatctactttcttttcccatggatttacctattttgtgtatttcatataaatggaataacataacatgtggtcttttgtgtctgacttccctaacttagaataatgtcttcaaggttcatctgtgttgtagtacgaactagtgcttcaaatttttattgctgaatgacagtctattatatatatatatttgattttaccattcatctgttgatggactttatgttggttccaacttttggctattatgaacagtgctactataaacattcacgtacaaatttctgtgtgacatatattttcatttaatttgagtgtatatctagaagtagaattgctgggtcatgtggtaattctatgtttaatttttttgaggaaccactgaagtgtttcccaaagtggctgatccaactggttttattggttcccaatccaaccagcaatgcacaaagattcccatttcgcctcgtccttaccaacacttgctattttctgggttgttttctttttgtttttgttttaattgaagctatcccagtgggtgcaaagtggtatctcattgtggttttgatttatatttcactaatgacttatgatatggagcatgtttgcatgtgcttaatagccatttataatctttagagaaatgtctgtttatattctttgcacattttttaaaaaatctgaatatttgcctttttatatttgaggcttagttgttctttttatattctggacacaagacctttggtagacatgatttgcaaattatttttcattctgtgtgttgtcttttactttcttgatagtgtccttttaaggaaaagcgttttaattttgataacatccagcttatctattttttctttggttgcttgtgatttattgtcatatgtaagaaatcatggcaaaatccaaggtcttcgggatttatacctatgttttcaataagaattgtatagtttttagctctttttaaatttttttcttaacttttattttagtttcaggggtacatgtgcagattgtttatataggtaattgtgtgttgtgtgagtctgatgtacaggtaataagcacagcacctgataggtagtttttcaatcctcaccctagtcccaccaaacaccatcaagtaggccccagtgtctgtttttcccttctttgtttctgtatgtactccatgcttagctcccacttacaagggagaagatgtggtatttggttttctgttcctgtgttagtttgcttaggataatggcctccaggcctaaccatgttgctgcaaagaacataatctcattctttttcatagatatgtagtattccatggtgaatatgtaccacattttctttatccaatctatcattattgggcatttgtgttgatttcatgtttttgctattatgaatagtggtgtgatgaacatacacatgcatgtctttatggtagaataatttatattcctttgggtgtatgcccaataatggaatgggtgtgttaaatggtattttgattttaagttctttgaaaaatctccaaactgctttccacaatgccggaactaattatcattccaaacaacaccgtataagcattcccttttctccacaacctcgccagcatctgttattttttggctttttaaaaataaccattctggagggggaggagccaagatggccgaataggaacagctccggtctacagctcccagcgtgagcaacgcagaagacgggtgatttctgcatttccatctgaggtaccgggttcatctcactagggagtgccagacagtgggtgcaggtcagtgggtgctcgcaccatgcgccagccgaagcagggcgaggcattgcctcactcgggaagctcaaggggtcagggagttccctttcctagtcaaagaaaggggtgacggacggcacctggaaaatcgggtcactcccacccgagtactgcacttttccgacgggcttaaaaaacggcccaccacgagattatatcccgcacctggctcggagggtcctacgcccatggagtctcgctgattgctagcacagcagtctgagatcaaactgcaaggcagcagctaggctaggggaggggcacccgccattgcccaggcttgcttaggtaaacaaagcagctgggaagctggaactgggtggagcccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagcccccatggtaatactatgtcaaaacatgaagaaatgcatgagtcccatgttcctgtgccagggtacatgaaatggaaattggcaaatcatcattcttagtttaactatcacaagaaacaaaaaaccacacactgtatattctaactcgtagatgggaatcaagacaatcagatcacatggacacaggagggggaacattacactgtggggactgttgtggggtggggggggagggatagcattaggagatatacctaatgctagatgacgagttagtgggtgcagcgcaccagcatggcacatgtatacatatgtaactaacctgcacattgtgcacatgtaccctaaaacttaaagtataataataaaaaaaaaaccattctgattaatttgagatggtatctcattgtggttttgatttgcatttctctaataatctgtgatgttgagccttctttcacatgcctattggctttgtgtatgtcttctttggaaaagtgtctgttcatgtccactttttaatggggttgtttgtttatttcttataaatttaagttacttatatattctggatattagacctttgtcaaatgcatttttttcaaatattttccccattctgtaggttgtctgtttaatctgttaatagtttcttttcctgtgtgaagttctttggtttaattaggtttcatttgtcaattttgtttttattgtaattgcttttggcatcttcatcacgaaatctttgccagggcctgtgtctggaatggtatttcctaggttatcttccaggatttttacagttttgggttttacatttaagtctttaatctatcttgagctgatttttgtatattgtgtaaggaaagacccagtttcaatcttccacgtatgactagccagttatcccagcatcatttattgaatagagagacctttccccattgcttgctgttgttaactttatcaatgaccagatgaatgtaggcatgtggctttatttctaggctttctattttgttccattgctctatgtgtctctttttctaccagttcaatgctgtttcagttactgtagccttgtagtatagtttgaagtcaagcaatgtgatgccttcagttttgttctttttgcttaggatttccttggctatttggactcttctttggttctatatgaattttaaaatagtttttctaattctttgaagaatgtcattggtaatttgataggaatagcattgaatctataaattgctttgggcagtatcctattttaacaatattgattattcctattcatgaacttggactatttttccattcatttgtgtcatctctgatttctttgagcagtgttttgtaattcttattgtagagatctttcacctccctggtcagctgtattcctaggtatttgtgtgtgtgtgtgtgtgtgtgtgtgtgtgtgtgtgtgtgctattgtgaatgtgatttcattcatgatttggctttcagtttggatgttgcttgtgtataggaatgctattggtttttgtacaataatttaatatcccaaaactttgctgaagttgtttatcagatcaaggagcttttgtgcagagactatggggctttctacatatagaatcatgtaatctgcaaacagaaatagtttgactttatcttttcctatttggattcattttatttctttctgttgcctgattgcttgggctaggtcttccagtactatcttcagtaggagtggtgagagaggacatccttgttttgttgcagtttttaaggggaatgcttctagcttttgcccattcagtataatgtttgctgtgagtctttttagatggctgttattattttgaagtatgttccttcaatgcctagtttgttgagggttctgactatgaaagatgttgaatttctttgaaagccttttcttcatctatggagataatcatgtgatttttatttttagttccatttatgtggtgaaacacatttgttgatttgagcatgttgaaccaatcttgcattgcagggataaagcctacttgatcattttggatttacgtttttatgtgctgctggattcagttggctagtatttgttgacaatttttgcatctatatttgacaaggatattgaactgaagttttattttttggttgtgtctccgtaaggtttgggtgtcaggaggattctggcgtcatagaatgagtaagggggagtctcctcttcaattattgggaatagttttagtaggaatggtactatttctttatatctctggtagaatttcactgtgaattcatcatatcctagacatgttctggttggtaggatttttattactgattcaatttccaaacttgttattggtctgttcaggaattccatatcctcctggttcaatcttgggaggttgcgtgtttccaggaatgtatccatttcttctagggtttctagtttgtatgcataaagctgtttaaaatagactctaaggaattttttgtatttctgtgaggttggtggtaatatatcctttgtcatttctgattgagtttatttggatcttctctcttttatatctttgtctagctagtagtctatcaatcttattttttctttaaaaaacaaactcctggatttgttgatcttttgtgtggttttttacatctcaatttcctttggttcatctctgattttggttgtttattgccttctactagatttggggttggctggcccttgtttttttagttcctctaggtgtgatgttaggttgttaatttgacatctttttttgtttttttttttaactttcattttaagttcagaggtacatgtgcaggtttactatataggtaaatttgtgtaatgagggttcgttgtacagattattttgtcacccaagtattaagcctagtacccattcattgttttcctgatcctctccctcttccaatcttccccaatttgataggtcttagtatgtgttgttcccctctatgtgcccatgtgttcttatcatttggctcccacttataaatgagaacatgcaaaatttgatttcctgttcctgcgttagtttgctaaagataatggcctccagccccatccatgtccctgcaagggacatgatcttgttcttttcatggctacatagtattccatggtgtatcacattttctttatttggtctatcattgatgggcatttatgttgatgccatgtctttcctattatacatagtgctacaataaacatacacattcatgtgtcttttattagaataatatgtattcctttgagtatatacccagtaatgggattgttgggtcaaatggtgtttctgtctttagatctttgagaaatagccacactgctttccacaatgcatgaactaatttgcactccaaccaacagtatataagcatttctttttctctacaacctcaccagcatctgtaatttttttgctttttaataatagccattctgatggtgtaagatggtatctcattgtagttttcatttgcatgtctctaatgatcagtgatattaagctttttttcatatgcctcctggccacaattatgtcttttttgaaaagtgtctgttcataaccttttcctattattaatggtttttaaaaattttttttcatatgcttgttggccacatgtattttttttaattgtactttaagttttgggatatatatgcagaacgtgcaggtttgttacataggtatacgcgtgccatggtggtttgctgcacctatcaacccatcatctacattaggtatttctcctaatgctatctcttcaatggcccccaatcccctgacaggccctggtatgtgatgttcccctccctgtgtccatgtgttctcattgttcaactcccacttatgagtgagaacaaacaatgtttggttttctgttcctgcattagtttactgagaatgatggtttccagcttcatccatgtccctgcaaagaacatgaactcacccctttttatggctgcatagtattccatggtgtatatgtgccatattttctttatccagtctatcattgatgagcatttgggttggttccaagtatttgctattgtgaatagtgctgcaataaacatacatgtgcatgtatctttatagtagtatgatttataatcctttgggtgtatacccagtaatgggattgcggggtcaaatggtatttctggttctagatctttgaggaatcatcacactgtcttccccaatggttgaactaatttacactcccaccaacagtgtaaaagcattcctatttctccacatcctctccagcatctgtcatttcctgactttttaatgattgccattctaactggtgtgagatggtatctcattgtaattttgatttgcatttttttaaagtgcctgtttacatcctttgtgcacttttgggggtttttattttttttcttgaaatttatttaagtttcttacagatgctggatactagactttgtctagtattctcccattctgtaggctgtctgttcacgctattaatcattttctttgctatgcaaaagcgctttagtttaattaggtcccatttgtccatttttgcttttgttgcagttgcttttgacatcttcatcataaaatctttgtacgttcctgtgtcctaaatagtattacctaggttgtcttccagggtttttacagttttgattattacatttaagcctttaattcatcatgagttgatttttctatatggtgtaaggaaggggtccaatgtcaatcttctgcatatggctagcctattatcctagtgtcatttatcaaataggacattgttcccaattgcatgtttttgtctgatttgtcaaagattgaatagttgtaggtgtgcagcctttttttttggttctttattctgttccattgttctatgtgtctgcttttgtagcagtactatgctgttttgattaccgtaaccctgtaatatagtttgaagttaggtagcatgatgcctcctgctttgtttgtttgtttgtttgttttccttagtattgccttggttattcatgctcttttttggtcccatgtaaattttaaaatagttctctctactaccctgaagaatctcaatggtagtataataggaatagcattgaatctataacttgctttgggcaatatcaccatttttaggatattgattcttcctatccatgaacatggaatgtttttccatttgtttgtgtcatctgtgattcctttgagctttgtgctttgtagctctccttgtagaggtctttcacctccatggttagctatattcctagatattttattctttttgtggcaattgtgaatgggattacattcctgattttgctctcagcttgactgttgtttgtttatgggaatgttagcaaattttgcccattgattttgtatcctgagactttgctgaagttgtgtatcagcttaagaagcttttgtgctgagactatggagttttctagttaaaggcttatgttgtctgcaaacagggatagtttgacttcctctcttcctatttggatgccttttatttctttctcttgcctgattgctctgtccaggatttccaatactgtgttgaataagagtggtgagagaaggcatccttgtcttgtgctggttttcaaggggcatgtttccagcttgtgccatttagtaatatgtgggttatgggtttgtcagagatggctctttaatttcgaggtattttccttcaatatctagtttattgagcatatttaatatgaatgagtgtttaattgtattgaaagccttttctgtgtctattgagataattatgtggtttttgtctttagttctgtttatgtgatggatcatatttattgatttgcatatgtaccaatcttgcatcctagggataaagcctacttgatcatggtggattagctttttttatgtgctactttattctgtttgtgactattttcttgaggatttttgcatcaatgttcttcaaggatattggcctgaaattgttgttgctgtatttctgccagattttggtatcaggatgatgctggcctcattgaatgagttagggaggagtcttttctcctcaaatatttggaatagtttcagcagaaatggcagcatatgtgccatgtcacgatgagaagaatgtatatcctgttgttttggctggagagttctgtagatatctatcaggtccacttgaatcagtgctgagtttgggtcctgaatatctttgttaattttctgcctcagtgatctgtctaatattgtcagtgtgtgtatctaagtctctttgaaggtctccaagaacttgctttatgagtctgggtgctcctgtgttgtgtgactatttaggatagttagctctttttgttgacttgaatcctttactattatataatgcccttccatgaattcgacatatttctaacgttttgatgtgtgcttttagtgctgtaaatgtctctcttaacagtgttttatctgtgtcccagaaattctgatatgttgtattttgttctcattaatttcaaagaatttcttgatttctgccttaattttactgtttatccaaaagtcattcttgagtaggttgtttaacttgtatgtaattgtatgattttattactattgttttatatttttattgtgctgtgttctgagagtgtgtttggtatgatttgatttttttttaatttactgagattgtttcaggtacaattggattgtcagttttagagtatgtatcacatgcatatgagaagaatgtatattcttttgttttagggtagaaagttctgtagatgtttgtcaggcctgtttgatcaactgtcaagttcaggttctgaatatctttgttagttttgtgcctcaatgatctgtctaatactgccagtggggtcttgaagtcttccacttttattgcgtggttatctaagtctctttgtaggtttctaagaactcgttttatgaatctgagtgcctcttgttaggtgcatatatatttagaatagttaggtcttcttattgaatacatcctttactatcatgtaatgcccttctttgtcttttttgatcactgtcgtttaaagtctgttttgtctgaaattgaactatcaatccttgcttttttcagttttctgtttgtttggtagatttttctccatctctttacttagaacctatgggtgtcattgcatgtgagatgggtatcttgtagacagcatacagctgggtctttcttctttatctaacttacccctctttgccttttgagtgagacatttagcctatttagtttcaaggttaatattgatatgtgcaggtttgattgtatcagtgtgtcattagctagttattatgtatagtttgagctcttaacatttagatctttgatcctttttgaattgaattttccatattgtatgaagtttgggtccaacttcattctttttcatgttgatatatagtcatctcagcactgtttattgaaagatcttttttccattaaatttttcttgacacctttgtaaaaaaaatcaactgatcataagcataagggtttattttctgaccctcaaatcaattttattgacctttatgtctaatattccagcactacacattcttgattactgtagtttcttagtaagtttagaaatcagataatgcaagtcctccaaatttttttctgttttatcagattgttttggcttgtctggttcccttggattaactatacatttgagaatcagcttgtcaatttcttttaaaaagtaagttggaattttgataaggatggcattaaatttatagatcaatttgatgattagtgtcatttttacattaagatttccaatacatgaatacaaaatgccattccatttatttgatctcctataatttccttcaatgacattctgcagtttttgtgtacaagtcattcactacaagtgaaagaatgcaagactacaagtctttcacttaaacatatacctaaatattttaatctttttgatgttgttttacatggaactgtttctatagttttgttttggaattattccttattttataaacatataattaattttatgttcatgttatatcctataaatttactgaatccattcattagtctttaatagaatttttatggattacttatttttgaagatcatgtcatcttgaaatagatatagttatattcatttcttttctactttgataccttttttttcccttacctaattgccctggtcaaaacctctagtatattgttgacaagaaatggtgagagtgggcatctttgtcttgttccccatctcagggatgaaatgctcagtattttccagtaagtatgattttagctgtgtgttttcctagatgtcctttacaagattgaggaaatcccatttgattcctagattttgaggatttctatagtgaaatgatgttgaatttctttgagaaatgttgtttctgtgtctattgttgtgatgatgtgggtttttttattgtattgatttgttgtattatattggtttttcatctgttgaactaaatttgcaatctagagtaactccactaggtcataatatacagtcattttttaatactgctggatttggtgtctttttattatccttaggactttttttatttctattcatagatatactggcttgtagatttttcttgtaatgtctttgtatttggtgtcaggataattctgccttcatagaatgagttgtaaagtgttccttctgttttttgctagagtttgtgaatgattgaaacatttggtagaatttatctatgaagacttttcttggtgaagttattttaaaaaataatttactaatttgatctctttgttacaagtctatgaagaatttctatttcttcttcagtctgtttggtagcttgtttattcctaaaaatttgtctactcatctagttcatctaatttgttggcatacagttgtacacttttaatgttttttaattctgtaacatcagtagtagtgttccctgtttaagtcttaattttcataatttgcatcttctcttttttttccccttggtctgtttagctaaagtttcatcagttatatggattgcttaaaataattggttttgttgattcttcctattgtttctctgttctctattttacttatatccactgtaatatatattatttcttctgcttgctttgatttaatatttttacatttataatttcttaagatagaagtttatgatattaatttaagatatatatcaaacaggcattcacaaatataaatttccttgtaagcactgcttttacatcccatgaattttggtatgctatattttcacttgtatttatctcataaaattaactaatttctcttatgatttcttctttgatttattgattattttagagaatatcatttaatttctaactatttgtgactttcccagatttcttcttgttattgatttataattttatgcctttgtggttggttagcctttgtttggaaagatattttgggtgggtataaaattctagattgacttttttttcaatattttagagttgctgttccactgcttttttcactagtgtttttccaatgagaagttagttgtcgttgcttatctttgtttctctttacgtggcatgtcattttttgttttccaagggaaggagcaattgttggctgatttaagatttgtttctttgtctatgattttaagaaatttgattatcacatgacttgctgtagttttctttatgtttctcgtgcttgggatttattaaacttcttgtatttgttagttaacaattattatcaaatttggaaaacatctttttcattatttttcaaatatttttaaccttctctctctcaagaggcactaattaaatatatattagggtgactgactgtgttccatagcttaataatgctcttttaattttttctcttcatgtgttccatttggatactttctattgctatgtctttaggctcagtaatctttttggcaatatctaatctgccattgagcatatccaatgatccaatatattttacttctcacatactgtagttatcattaataaacttttaagaactgtcataatgtagcttttcttgctaattttaatatctttgtgagttctaggtgagtttagattcattaaattttctcctcataatggtttgtattttttttcatacttatatgcttgatagtctttgattagatgatagatactataaattttactttgttgagtgctagaaatgtttgcatttttataaataatcttgagttatgttctatcgctcagttaatttacttgaagcaattagatctccttgttttttttttttttttttttttgatagagtctcagtctgttgcctaggctggagtacagtggtgctgtgtcagctcactgcaacctctgcctcctgggttcaagcaatgctcctgcctcagcctcccaagtagttgggactacaggtcccaactacaactcccaagcaccatcacacctggatattttttgtatttttagtagagacggtgttttgccatgttggcctggctggtcttgacctcctcacctcaactgatcttcctgccttggcctcccaaaatgttgggattacaggcgtgagccaccacacctggccagggtcttgaattaaatatttattttcagaactagagcagcagtttttccacagctaagtatttcttaccaccaaagcaggaccctctgtgtagtctacctaaaagcttcataaattatttggtttttccgttttggaaagtgggaatagactgtccctgaccctgtgtatgtgctaagcattcttccctgttatcttcacagatgattttcccctggcctctggtaattccttatatgtatgtggtaatgagtactctgctgaatactagacgagaacattctaagaatgtctgaacctttgcacacttctctcctctctggtactttgtcctgtgaagtctagctgtgttgcctctccccagattcttagttctgtatccccaagtgagggagtttgaaaggctccacctgaattttccctccctgtatcacaacctgcaaactctctcaaggcagtatttgggataatcatgtctgtctttttccctctgttgctcaggatcactgtcctgggctgataatgtccagtgactttaaatctgttgtttcatttattttcctatttgttgttgtttttgttattttaagtgggagtgtattctcttggctggaatcatagttctacaaacatatattgatttgtattttggcatatgttgccaattttgttattgagatttttgttgttataaaatagagttttgattttattattagcttctaagatatcttattaaaccaaatagttaaatatctattaataattcagtgcaactaaaaaactttgtcacagtaatgtaagtagaatagatataggaattttagatgacattaacaatgtatttgaaagaagatctgggaatattaaatctattgtgcctaagaaagcatgcgattataatagtgtgaaaaaagaggaatgagataatatgtagaatattttcaatagaacatgtgctataactaaaatacatagagtacaaaaaattttgagatcagtttgttggagagataaactagagtaatatgtttatgctttttataaaaacaaccaaggtatatattcataggcaagtaagatgggtataagaaataggaattaattaaatatgtatgaatgtaaaaaatttgaaaagatatggaaatattaccaaagagcatcccacaaatcaaaagtataaagtttaattcatttgtatgaggattttaattttcaattgttgtcacttattctttaaaatcatttgttaactaacttcacagttcaagatttagagcagaaagttgtcttatggagcaacatatatatttgtgtttaacaagagtgaactcttccatcctgccacacatgagaattttgattaaacctttgaacgatgggtgtctaattgttttgatctatagctgttatcagtttttaaataggttataatataatatttagtatagtatcaagacagtgagagatttatcttttatgtcataatgatatatgcctattagcaatatgaaaaatctaccaattctaaaatatctttaaaaacattatagaaaaggattattaaaatacacaacttcaatataattttggctgtgtaatgggaataataataatcaaataacattgtatcttaatttatgaaatgtttttaaagcatttggttttatcaaaatagactcaggtgtaataatatggaattctgtatttttaacttatcaaagcagaaatacttctagcatgatttaaattttacaaaccatcattgtaaaatccagaatgaacatactattaacctcaagtaattaattggatttgtttctattgtgccatgtttcctttgcaagtcatgtcaagagactgataagaaaactcttgaattcatatgaattccaaaagttgttaattaatgcccaatcatagtcattttttagttgtaaatctagaagcccttgctcagaaattgatatagccctgaatataagggctggaaggtttagaacaaaaggcctgaatctgatataccagggtgaaccttcagagtctaacttcattcaggctatataataacatcagtgctctaggttctcattttcattccagattcatagtggacccacagttctgaatttttattcatgagtttggagccacaggatcctgcctacatctttgtaattgcttttatttagagttgtacttaccttttgttaccttaatcttttaatgaggttctgttcaaattatgaattggatcagcatataacccctgtcttgaacattctgtgtctacactctcttgagacatgttatttttcctgtcatcttatgcctgcagtttgagataggtggaattactctggtagtatatttttttaatagcttataagtcagttatttaaaaaaaaaaaaacacaaaacccggggactttgttatgaaggaagccttttggtaatgatttccatcaaaataagatatccaaaagagtcactgcaaaaaagtaaaacaacaacaacaactacgggataaggatataaaattagaaaagtaacaacttagggaaagaaagttttctatttctattagctgtgttaaggactctaaactctttattttgcttattctaattttgatattcactgaagtcagtaagggtacactctcaaccttccaaggattggaagagcatcctacattgacctaatttccaaccctacacactgctggtgtgattctattagtttaccacttagagtttgaggaaagttgtcattaaaatattaaaacttttgccaaagattcctattatatttatttagttgcatttggataaacctgtttgctggtaacagaaacaaattatataaattgtaacacagaagtcaatccccttttgaaagaaaaactgaatgatatccttttgtgagtcttaccactatgatgtaggaatttcatgccacttagatggcggtttcagggggctttcaggcggtttctctattgtacatacggtgagatggaagttagcatgctgggtatttattaaggaatgcctttggaatctacatctgtggaagggagagaaaggtaacaggactggtaagagcaagagattgaattcttggtgatcatgatcccagaatagagtaaccttggctgatctcataccatgcttaggtgctagcagagccctttgtatttcccttatttggagcacaatgactggactttatattcctgcatcaactagtcatcggatgtgccctaccccaactggtgtagctttggatggagttcctgtagttctacaagacaatacctgaaggactggcaactgaaggatgtctcttgtctgcactcctaatagttgaagcaatcaagtgtttatggaagggggagctgggtggtacatcacagttccatcaaaatgtatttcccaaacttttagctacaattctaaggaggtctccagaattacttaatcattaacgtgggatacccctcttttttctacattagccattgcagtaggtaccacatcatctactcccccaaatttaaaaataaacatatactaatgtacttttctgaaacagacctgccaagactatcattttcttttcaatttcattccttttcaacttcactaaagaccttctaaagaaccatggcttttttttgcttcagtgaaccatttgaacatatcataggataataattggaagcatacctttgaatgcacaggccattatttccttcatagttatgttcatttctttctttaaattctgaagaaagagagcaggatcttagaaaagttctgctaaataagatataggaaaacaaaggaaataaatgtgagaggaacaaggccttttagtacctgtcagactgaaagaggtccataactaggaatgtctgacatctcctatgaccacaagggtgtcagaacctgcttttgaaaataagtaaaatcacacttaaaattaacaatttgcaaacctaaatttatatctttaatggaagatctcaaaatatgactacagaggattttcattaatcacctttggctcggtgcttttgtctactgtaaaacaatttgtcatttatttcatcagaattgacacaaattctggaaggatggaaagatttttaagtctgtgttagtttctctttggagaaacatgtcagtgcagtggacttccataggttaatttattccctttatgctttagagtgggtccagagcacagccttttctatagcgaggtggaggtgacagaggaacaggaattgaatgccttgccctcaacgagtttgtaatgtttcatactgctgatttatttctgttaaaaagatactaaaattcatgattatgattttgacccagatgtaatatgctggggctcttgattttcaactaaattaagcaacaatactattaatatcattgtttattattattactttgctgacagggacagaggctaaaagtgaattctgacacttgtaaatatccatattttaggatactgtttaattatgatctatttctaatccaaatgctccagtggaatgtttgaataagaatcagcagctctttatggatataaagatctagttatgagcattgattgcaagcaagggttttgaggcctggtaagaactattatatcatatcataaacatatatgagagagaagagagagaaaaagaaatgtgtgcatctggctcaatttgaagtccttatcaaatatagagagagggcagggaaagaagttggccatatagtaagttcaattttttaagatgccccagaaatcatttttctatgtattgattcaagcaattttctaaagatttcttcatggacagtataatagttggagttttcattagacagttctctgggaatagagattaaagtccagccctcttgaagaataaagtagtaaatctgagtcacaggaggctaacagtgcaatacagaggccaggagacagcgcccactgtggagcagtgtgtgaagaggcactacagcttatgtttggacgtgacactagtagaatgtgatctttcttcccctcctccaattattcaggtaaaactggaagagcaataattgtaattatcctgttgacctctcagttttgcttcgaagactactcaacctaacttaattatgtttacttccaagcacaaaatctttcatgccccaacttgaggtcttaataaggacaaaaggaatattttttcaggtgcactaatgtcattgcagttgtccatggagttagtgattatttgagttctacatgcccagcatatatggttgcaactgtatttctgggcttctgtggtatcgataagggtttggtgagatgctaaaaggtccttgggaaatagtaacatcaacaacagcaaatgcattttagctaagtttttcttttgtctttacctagactcagtaattaccttgttctgtacagtactatcaagaggctacctttttatttgttccaaaatagatattaacagatggaactcacactgtgtaaaataattctattgacaatagttcgatgtatcaaagatgaaggtaaagaaaaaaagtgcactgatgaactctgagaggtgatattgttaattgtttgatagtcttatatactagcaactttgtatgactgacacctctggtactttctcccgaatattcctgtattttgttttgagaaggtcttttgtccagaaaacatgtcccttgggtttgtagctgaactcatcaaactcaataaaggcatgcttctttctattgaaattccttttccccaatgttatgctatgaacttactcctctttctctgggtttattttgttcttactttatcctgattttaatgacatctctgattcttcccaattctgtttagaaacacattaccttaatctcaagaaaaatgtgtttcttttttttctcaataagacattgtataaacagtggaatttttcacaagtaaagacatcaagaaaaactctttacatagaaactaattgaaatattttatcctaagggaattttagttgacattagatcagttaatattactgacttgctatcatgatgttcattgtaaaatctaaagtacaaggcccttgacaataaattttaagtcataggttttataattatgggtgtatttagtaatgtccagagtagtttacatccaagacaaaaaagcatattcttccaaatagtgtgaaacataccctacaaaagaagaaaacctcagagtcagataacatcaagagaagagtccctgtccaatcaggcacaaagacattgggccttctgaagtcattctatgtgttagcattcttactgtaagtggaaaagaaaacatggacttatatcatggaaaagaaaattatgaacttatatttaaaagagtaggttactaattcaagacttccccagtgaaggcatcacagaaaggagacagggtatatatacaatgtggaaacagcagtaaagacatactttctttactgtataagcagtcatgtaatttgtcattgatagaaataagttgtctgtggcgtatttgcattgcaaaaattcatatcattaaattatacaccatcccaaaataatagatactgcctgtaaaacagaaagtattcctctctaatattcattaccttatataaaaaaatagtataaaacattttcagcaggagatatgttgggaatctgagttctttcacacaaagagaattccaaggaggttaaagaaagaggtcaatgtgttaccttccacatctgaaattttatcaccgatttatgacatatttataataatctatgccatataaaaataaaatatcaaccatttgagaatatcatggcaattttgttaattaagtattagatataattaacttctcattcacagtttgtgaatacaattattagttgttaagacacatccttatggaaatattttaattatcttttatgtgtctttaagtgtgggattacttggacatattactccccaatctttcctcacctccaaaatggatatcctatacttcctcctggtgttataagaaacagtcacacatttgaaaacactttaaaacagtaacgcattatgtacatgttagaattatgtatgcatttgttattgaccttgtctgtgattagcttcttaaaattaccaaattaatcttatttacttctaagtacttaaaaacactttgttgttattatagattcacaaagtgagacatgaaaataatactttccaatctataaaatacaataaaaacctttgtagttgaaactatttctctataaaagtaacacctctttataaatcagtcataatttctgtttttcttctttttataagagctgatatcctctttccatagttcttctcatttcagattaaaaatcaaaacagggcaggaaggaagcatgtggagtctggcgccagattgccttggttcatatcacttactagttgtctgacttcaggaaaatatcttactctgtcagtgcttcagtttcctcatctataaagtacttacaataatgttatgtcctcctggagctgtgagaataaaatgagataacatagacgaagaacatggcagtgtgcctaggacataccacctacccagggaatgtcagctttcattacgctgatccttctctggaagttttgaaccaattcccatctccaatattgtgcctactgtctaacatataaagcgttacttaaagatccggaccatcaaaagacttattatctgtatttaaccttccagacagttttgattttgtggcttctaggctgtcatcctccagagccacaattcaattaggtagaaaatcttaaatctaacattaacagggtgtatatattgagggactttttaatgcctcacaatatacatactcaggtatttctcccagtgctccagcaacactgatctttattctgaacctagaatggatcaagccaagttccttccagccttggagccttggctctgcctctttcctttgcctgcattgctgttccttcacatcttttcatggctcactcatttcagcattcagatccctgttaaccagccccctacctccaacacattaatggatcttcatagttatctatttaaatttcttctgtttttatgtcccatcatgagctattaatataagtttaataaaagcagtggccatatctgacttagtccctaactacagcattctcagtatactacagtgtctgatatctactaactattcaatacatatttattgaatggagaaatgaaaacatgaattgtttatatgtttactcttcaccctgtagtgatagactggagttttaaatatcagaatgattttgtgtgtgtaaggatgtgtgtgtgcacaaatagatgggaaaaaaaataatgtgtctctatatgtgggtgagtttacatgtatgtttttcttagctcagccactgtctgcctagtcagtgacattccagtagtagcaagcacacttagtatccagatattgattcctaaacaccatgcttcattaaaaggaaatttggctcccttgaaaaaagattgcttccagggctggagcagggaaaatgcaagatgagcctgaagcctcttgtagtgacagaaagtgaataagttctcaataaaataaaaaataaaaaggatgaaagcatgtcaaaagaacactcgtgccaacctgaaaaagctcccaatggacaaagatgagacagtttgggcaataaaagaaacaataatagtatcaggttataactcaaaaataaaataaatatatataagtccataatgacataaataaatgatatggataaataaataaatggacatagaaggggacaatttttccttaagaaatcaaagtaataattgtagaaggaatgagggaaatagaaaatcacccttagaatacaacagtaagaaatgctgcaggcaagatcccctgatgtataccgaaatcagtgggcaaaactgtaaggagaaaaaggactatttatatcttcccaaaacatttattaattattttggtggttctgacatatgtctaaaaactttttaataaatttctcactagtaagttagttaatttctctcatcttgagtatgagctggacttactgacttgcttctattagatagaagaccatgaacaaagctggcagacatgaccttaaccaagtgatcaaggttaatatcaccagtattaagtcatgttggtatcatgcagcaatacactgaaatggccacatcacttctgtgggactgtctccaaatccataacctcagtttaatcatgagaaaagtcaggcagacctaagttgagggacattctatagaatatctgaccagtaatcctcaaaagtaccaaggtcatcaaagacgaggaacaactccgacattgtcacaaaattggagaatattaaggagacatgatgactaatgcaatgtggtatcctgagatggatcctgaaagagaataaaaatattagacaaaaataaggtgaaatcctaatcaagtctgtggttcagttagcagtatttaccaaaactaatttcctaatttttttaaagaaacatgtttatgtaagatactagcattagcagaagctaaaaggcataaggaaactctctgtatggtttttgcaacagttctgtaagtttgaaatcattttaaaataaaaagttaaagaaaacagtgaaagtattttaaacccagtttctagtacagattaagcattcaacaaagctttttaaaattaattagtgtgtttgatagtatttttttacataactatagaattatcttcattgatttatatgtaagtctagaacttccctctagtcaaaccatctccattaagtgtgcatgcagttttcaaggttctattcttttgttgattctctcttccaaaaatgaccttcgatttttgttccctagctacatatttttcatccttcaaaatccagctcaaatgttacctatctgtgagcctttttgagtgtctataaatctttctaaatatccttactttagtattgatgatattatgctcgatgtcttctatgccttccttgcaacctgaaaataggaacatttcagaaggaaaagcagtatctctacaattcgtaatacccacttagtgcccaaagacagtagacattcaataaagtgttcatagattaataaatgacagaatgaattactaattattctgttttaagtatttggcttggtcatcatattcagttatgtgatattagaataaaagatttataacctttttttatttcttaactctcccaaacccataacaaaggtttatttcatatatgcaagcgactgccctcacacccaatttaaacagtttgtttaatgctgcacagttatgattcccagctgtacctagagtagagtgaagaagtggagtgaaggatgatgcaggagaacattgtttatttcattcattctggctgttttgtgagtaatgttacactgtctttcaagatcacttacatagattctctgccagaggagagggatgctgacttttaaaaatatttgccataatgaaattatcttccttatttaggaaaaacaattttagaaaacttttatgttacattccacagtaacaataaaatatgttcacattttggacatatttttttatttatggcaaaaataagatgtagactgacttcatgctttgataaatattcattcaaatatttcctgtcaaaagaagcacaacaaaatgcttgattattttaaaattaatgccttacaattgtctaggtgatttgttagtatttattactcttcataaatttgaaatatcgaaaatgtttattttctttaaaatattttactgattttcagcttaaaaaccgaaaccattaaatataagggaaatactcttgtgggactttttacttgaaatatttactataataaaattcatattaatttgtatcataaagtctatagcatcaatattgtattcataattttatggtttatatcagtttatattttagctattatttttatttagtgtcctgttagtcctattctattcatatgattggtgattggtaaaaatgcatttctatacacatgtatatattttatctttagtagctcatacagctatctacatatacctatatattacatttggagaatatttctagtatcagtaatacattcatattttcattaattttataaaaaatcatactttttcaattttataaaactaaagctgaaacaactaaatactaaatgcatactatgggagtagattattagaaattagtcctcttgtaaactatgaacctagctgatcactacctctccaatagtttggaaactaattttataaaataaatgtagatatttcttgcattaacaataaaaccgtcagtcagatgcagtggtgtgcacctttatttctagctactcaggaggctgaggcaggaggatcacttgagcccaggagttcaagactgtggaggaccatgattaatcatgtgaatagccactgcactctagcctggacaacatagtaagacctatctctaaataaataaataatactgtcaataatcattacattttaattatatctgccacagaatatgtgccagtttacattcatctaaatcacttgacttaaacaacattttaacaaattattcatatgcgcttatatctggaaatgcactgagaggtaatcaaagtatcaccattgattgaatacctatatattagccactttgtagatattatatcgcatttgcactgcaacaaccccgcctatggacataattatctactttgacacacagagagagacttagaggaaatgaccagcctaggctaagtagcagaagatttcaaaaacacaataattttggctccaaaaccaacacattttttcattgtcagttttgatgctaggaatggtaaacatttagtattgtatccttacatagtataaaatcacctgaagtcttcagatcgaaccttcttgggttgtgcatttagtttttggattacaatgtgattgcagtaaacccctgaacttccaaaattacaggagtcaaaagtcagggcttttaaaataaaatagtatttgctttatgtcttctaggacacaaacaccatggtccatttaacaaattgcatcttaattctttcacacaagattctgagatagtcagtgttatcccttttttacatatgagaaatcagctctgagttaagtaattctgcccaaaccacaaaggtatcaaagttggggttcaaataagtttttgctgactacaagtcttgtgttccttaaaaataaaaaatgtagacagtcaagagggtttctagaatttgacaaaagaagaggcagtagaaggaacagaaaacaaaaaaagaattatctagtagaaaaatcagatcattcttgaggaaattagtaacgggcaagttgggctctacatgcattgctagaggctaagggcacagcattgaccaggtgttgatgttaaagattacttccctttaggccgggcgcagtggctcacgcctgtaatcccagcactttgggaggccaaggtgggtggatcatgaggtcaggagatcgagaccaacctggctagcacagtgaaaccctgtctctactaaaaatacaaaaaaaaattagctgggcaaggcggtgggcacctttagtcccagctacttgggaggctgaggcaggagaatggcgtgaacccaggaggcagaggttgcagtgagcggagatcacgccactgtattccagcctgggcaacagagccagactctgtctcaaaaaaaaaaaaaaagattacctccctttattgagatggtctctcactataatcactcattacaaaatactaaagaagatagctattaaaaataatgtttcactaaaatatatttctagtataatatttgttaccttcaggacatagaaaatagatatagaaaatgtggaatttgcataacaatcatgattttacttccaaacacttatatagttggtttcagcaggttgtaatgagaatacgtaatgagatctggtttaaagtaagaaaataaaatatttatagacatctcagtgtctgatactatgtagacaaaatatttgattgatatttggaagtatttttttcacttttcatctaaatgttccatcattgcataccatgagcctatgaggtttttagtatcatgacactttgagattctaattttgaatggaaactggaaaactcacttgtaaaatatcaaccgtcagcttcccctgaggaataaataattttatgataattttaatgaatcagtaattgtttatgaagttaataaaccattttttttctgaagtggtgtaggataataactgttagagtagatttgggtaatttaattcctcaatttttaagaaggcagctggatcatcaagaagcagagaaatagccgagctctaggagccagagtgagaaaggatgattctactatgtagttcatagctctttcttatatcttaaatcaacactttaaattactttatgccacctcctagaatgagaggaaacttgaattaaagaacatactttcatttagttaaagcttaaatgaagatttgatggaaaatacactatgctatttatgtgaataatcttatcatatctgctaaacaccccaaggcctagaggtaattgaattttagaaaaatgctaacatgtctgctgataaaaactgctttaagtgtagtcttcactatctaagtgccaatatgctaaagaaataaacctctgggatgagtatttaagagtcataatgcagctttatgtcattaaaaaatgatcacaatgtcatagggttgatgactgtgcagaataacaaaattctctagacggcaatccatcataaacttggaaaataaccgagtaacttgtcaaaattcctttgcccaaaaagtctagtcttttaagttgctacggtaattactacatttgttggaggtatttaggagatgacaaattccttgtgcataatgaacctttataaagagtattctaagcattctaatttttttaagttgcctttgatttgcataactgatgtctgagttcagtgtagaaataaacttgactggtaaattcaaaggacatgagaagactgaggaaaaaattaaaagttcaagacaaaaggaaagaattgccttttataatatttatatcttctacttttttcgctactgttttcaggatgttaaatacttagtctgaattgctattcagagaacagcaaagggagtgagaatcttcatgtagaacaatcccactgagtttaaacctcctggttttaatttatcattgggaatgaaaccatatttaattatttatcattgcgacatgtcatatgagcaaaggaataaattgtgctaccatttcttagttgcatccatagtcagttgaactagattcattcactgtctgtaactggggagttgtggtgagaacagattagatacctctaacatgccatgagtctattttattttatttttatttttaattaatttattttttaagacaggtcttgctgtgtcacccaggctggagtgcagtggtacgatcacagcttactgtagtctggacctcctgggctaaagcaatcctcctgtgtcagtctctcgaagtgctgggattacaagcgtgagccaccatgcccagctaattcttacttgtattttattttattttactttactttactttactttactttactttattttattttattttattttattttattttattttattttattttattttattttatttttgtagagaggagttttgctatgttgtccagactggtctcgaactcctgggctcaaggaatcctattgccttggcctctcaaagtactgggattacaggcatgagccactgacccagcccttaagtcttttttagacacaagtgagcagacaattatgagcctggaaatattccttaatgaggaggagagccaatgggacagtgacaaatagggctaagtccattaccttgagtattacagatcaacactgcagccaggattcaattttcaaacaagcttcagatctgaggtactaatatttaggggagctccaggagtattggtgaggactcaaaagaactccctgagagctggtgatgagaaaacaggttcagaatcagaagacccactgcatgggtgatcccatcactagagaattgcagaacataataaaaacctagccactgggaaactgaatggccattcagtaacagaataaaagtctaaatgtgtaatacagggtaataaggaaaactgagcatcaggtagcgaacatatttacaaagcccacatgaccttcgtcaaataaattaacctctgtattcattgcatgggacactaataatagtacttacccaagaaggttttcctgaagattcattgagttcatacaggtgaaacttagaacagtccttgtaagttttccggaatttttgttgttgttgttgctattgttattatgttgttcttgttacaggtgcctgaagttaaagttgagtcttaaactctggttgtttaagcaataaaggcaagaacaaaattctgagaccagcctcactcaggagcatctctgctagaactcttgctcctgcctgccatgaccaaaaatcgtcaggaaatgtggggtcgaatttagcctgaaggtttttaccacatctgaccctgatttctcactgaaaccatcagcattttcattgctaatattttgctgcatcttctggatgcaacatttagtagctgtatgaccgtgagggagttattaaacttatctgagccacagaaatgtattgccttctcctgtgactttgaatagtgctttcatattcccaaatgtctataatcagtagaaagttcaccatttggtaaaaataataagagtcactaagtaaattagaagaggattaaatgaagtaacaaaaattttgaaaaggtacagcagcaaagttgttgtgtaatggtaggactggttatgaaaaacaaaggcagttattttaggagcagaaactagcataaaatgggaatctcttttgcatctccattactttaagaatcctgcttcctcctcctagaattccttgcttctgtatagtcattgggaaaatatctgcttatagttaaatacttaggtgaagctccacctcctccagcaagcatttcttacccccctgatagagcttgctgctttctcctctgaatcctccaaaaacattgctcatgtctaaactgaagaccttgccacaaagtgtctaccattgactgtcaacaaggctcctcctccacctcataatgtcctctctttggtcagggtttggtggtggtggttgtcttaacagctttatttgaggtataatttacatatacacaaaatttacctgttgggattgtattttatgtgactttacatcctcagcctgcaaaatcatcctgatccaacacagaatatgccagaacaaaccatttttgatgaatttattttacaacaaagaaaaatacatgtgtgaatttgtaaaactgtattcctagtaagaaattctaaatccagcttaattgaacatatgtgtttaattattttaaaaaatacatattatctaaagaaagatcatattttatataacagtagttatttttagaagtaaaaaatagccaaattaattgcatcgtataaaacatgtttagtctgaaggctaccttagaaaattctaactgtatgatgttcaaaaacttctttttttagttatcataaaataaatacatttgaaactatgtctcttaattgtgtttatctgaacagttacagaattctggagatagtttctttggaaacctcatggtatatactgatgggacacccagtctatgaggaagagcagaaaaatcatgtatcaaagcagaacaatagtacttttttaattaagtaaaaagttatagcttgattgaagcatggagatcatttaatataactaatggaaaagtaaaagagtgacaaagttagtaaagtgttcaaggtcacatggtttgttggcagcgacaatgttaaaagcagagacgaatagaatcacagtgttaatattcactgaagattatccagtttagctacccatctggttattgaatcctctctcccacattcctttcaagttgttgcttctatgtttgaatactgccggtaacagggagtcatctagcctctgagataaagtatttaatctttggataagtattatactattaaaagttcaccttttgttgagaagcaagcttttctttgtaatttctacctactagtcttgatgttagctttcgaagtcatcaaaaacaagtcaaatatcttttaaatcggagagactttgctagttattaaggacagatgattgttccttttaacaaaataaacttttattttgtgatgaatgtttattttttatcaagatatattatgttctcattattaaacaacaaaaaaaccaccaattacccatatgtaacctttcttaattataactgtagttacctcctttttagtgtaagttttttcattgttacagatgcattcttacatttaaaattttaaccatgactaccacttatcatagtatgattattttcctgtgacagtaaaatgcaatatgcattattttaatacctgaacatttttgttaaataaatattcagaacttcattgaattacttgaccattattagcttttgagtctctctattttttcccaacaattaatagcagaattgtgtttacttttatgcacatattacctgccttttaccacacaactctagagtaagttcctggaaggaggtatttctagggtgaacaacttgaacctttcaaaagagtgatacgcatatttccaatttcccttcagtttaagccaccaccagcaatttatgaagaaattccttaactgcatcatttctagtattgggttttcttttgtctgtaatctgatcacatggcacacaataacttttatcttattggtagatttctaagcttttagaggtcagcaaagttgaatgctttgtcaaacattttctacttatatttccttttctccaaagggactgttcattatactcttggaatcttagtggtttttcttttctacttaataaactcttctttgtcatatgtattttgaataatttccctagttattttgtattttaattttgtgtgttaggttgtagtactaagccctgttgtggggtagggggaggggggagggatagcattaggagatatacctaatgttaaatgacaagttaataggtgcagcacaccaacatggcacatgtatatatatgtaacaaacctgcacattgtgcacgtgtaccctaaaacttaaagtataatttaaaaaaagaatttttaaatgctatgtatgcacagggtgccttccacagtcatttctccagtttttactcttctccatcaaaaggatagactaatatttatttatattttcctatcattttacgtgctttaatatttaactttaaaatctatttagaaaacattctcatggtgctacaaaatattattttcaaaacttctaaccagacgtctcaacgtcacttattatttttccattcctgactctaatttgtcacgcttccctgttaatacactattctgcagtttgtgtctaattacttctctcgtctctggctttttccctcacacagacacacaacactaccaccaccactgcaacaacagcaaaaacaacggcaatgcctaagccacatagtttcttttcttacatttgcaataatctcctaattggtatcagtgattttattaaaatagaaggatcacatatttatcaaaaattctatatatgcatccaaatttaagcattttgtctttttttttgtttgcacatccacgtacacacacacacacacacacacacacacacacaaatttagaagccagaggtcagttacgggccacaggatctgattgtggtgggaaacactgaacatattttgctgttaaataagtcatttgtgaaacaggtgattttcctttctttgtctaatcttgttaatgcttatttgtaaaatgtattgccaccctcacccacatttcttcttaatattgtttttcttatgacaagttatgccttcattgtaaacaagacaagtagtgagtctttaacacagtgaaagaagtacaagtgtttctgatgtagtaataacatttatgcacacgttcttgtttttacatcgtatatacatctaaatatattcctaaaaaccttctaattctacaaattatgccaaataataggggctaggggaaataaggattagagcaagattactcaaaatatgttaaatcagagcactagtaaaaacattaataaactaaaaaatgtgacatttaaattcccatgaatattgtgctagcatcagagtctgtcattatggcatcttaatcttaggggttaatatgttaatgtgtccactttccttgtaaacccttgatgaaactcactggtttattggcagatggtctcttagtttccatgcttgtataattgctaattaatcagcagtgagagtgatctttaaaatcagaaatcagattatgttattacctcacacaaagcccttctgtaacttcctattatgcctagaatgaatttcaaagtccttgtcctgaatcctttggctacagtctagctctgcagactcatctcttccgctttttcctttagtcatcgcactcctgccaactggccctctgtcattccctagattgcatcctgttcctcctgcctcaaaattttctggttcctttaacatcatgattttttctgcaccttttcacatagctagcattttatcatttctcatgtttcagggagactatccctgttcatctgacctcatgcaggtcttcatctcttctcctcctgcaaatttctccatctcatcttaaaacttgtttccctcataggatttatagaaatttataattattatgtttgctaattttcattggttccttccactggatcataaactctgtgagtgcaggacattggtactcattcaccatggtattgccaatgtttgaaacacaaatcttgacatacagatatgttcattaaacattttactctattaccctttcctgagcaccatgtatatttcagtgagcaaaacagacaaaaaaatctcttgactatttaaataagagaaaactttttcgtttatccttttttttttttttttttttattgagacagagtcttgctgtgttgcccaggctggagtgtagtggcacgatatcggctcactgcaacctccacctcccaggttcaagcgattctcctgcctcagcctcccaagtagctgggactacaggtgcatgccactatgcccggctaattttttttcatatttttagtagagacagggtttcactattttggccaggctggtcttgaactcctgaccttgtgatctgcccacctaggcctcccaaagtgctgggattacaggtgtgagccaccatgacaggcctgtttcatcttcatactttccttatagtgtacttctatgtctaaacatggtctataagtaaaaaactgaggtcatatgcactagactaatgttattccttcctgcatttaaataattttaataagatataaaattacagcttctgttttttcttccctatttttaaagcaatacctctttatattattgcctccaaatttactgttatgaggtatgatgttaacctgattctttatatattgaactcaccaaatatgtcaccatacaaactcctactaaagcaaagctaagttcaatagaacttgcaacggtaaagaagagtgtcacctggactgaattttaccatgtcaccaaaggggggaggataatataccgagttttctggcctgtgctcagttggtttcaggttgatctttcaaggcgggaaaatgattaggatgaggcaatttttgtgacctaatagtttatgattggtggatttagcaaaaagagacttctgaagagagtcctgataagtaaccttatttaataagggagctgcttgcccaggtaggcaaatattatctcagctaaacagacatgcagaaatttattgatgtaaatagtgattatttatatgcaaatagtggttattggtttacaatcttatcttttctgagcaaaacttttagggaataaacaactaattaatgttgacatagctattaataagttgtgtggttgcagtctcatgggggatgtgctattttccctcctcctttagaatattttctgtccctaagggagttattcttacatgtccagtgtgacactgtgaattctttctgatgtcttatgcatctttttataactattaaagttgttggtcattactaataaaaatagtccttatactctattatttcatttttactttctgcaactactattttatagatattggcccttgtgtttctattctctatttctattaacttttatattttacaaactgagagagtttcatgaccagttcactggttaattctagtgttgttctaccagcatctgtgattattcttaatgttttcttattcctaagtttttctcctatccctttttataattttgtagagattaatatgcatgttttattctcctgttatctggtacactaattctacttcttctgttataagatactcaaattgctttctaagatgtcttaattttttccctctgtgtttatattcccctgtaaacatcagcaaattactaaagtcttgtgccattctgaagattttaggaagtaaagatgagaaacatgtttctgagccatgagctagccatgtgttgatttatacattacagttatatttcctcatacagctgccaaaagcttagtagtaaagatgtgcagaaaagaaaaacaggcaaaaaaaaaaaagaaataaagtattttgcacaggtgatttgatagcttaacagctattgactggaattgctaaaacaattttaggcaagtggttaagacaatttgaccctatttatttaatctaaaatggcagagtaaaactctaagagtataatcattaattccttgattcacctacaaattttgaatgctgatgcagaactgtttacttcacaatctcttatatacacaccagtaagaaatgttctaaatctaagagatccacagggtttataaagatgcataaaaaaggctatataactgtgcattgagaggaagaaaagaaacatcatcaggggctatgatgcttcagaaagattttaaaacccggcaggagttgctaagtgcccaagggaaggaaaagcactcagactgtaaagagcagtataagaggcttagagttacagtagccaagtagtttggtattttgggcagtgtaaaataaacttgcctgggacagtcttggaagccagatcatggagtaatcagtattccataataagtttgtgttttacctgtgaatggttatcagccttttagagactatcagtaagaaagtgatttgatgagatttgcgtcttagaaagattaggtatgtggcactggggaggataaacaggaagtatgcatgactaaaatcagtaacatcgtttggaaagatattgctgtagctcgtgtaaaagatgatgaacatcaacattttagtgagggaatgctactgagccgttgaaatcttcccagtaagacatagaaatgattgttaatattatttaactatagttaatttacatttaaataggcacatgtgactaatggctaccatcttggatagcagaagtccagatcttaagggagatgtgtggtctggcaacgtagattttataggatattttaaaacatatgtatgtttttcagggaacattttaaacagcaagtgatgataagaatagggagagtgatagataaaggaaagagccacaagcaggaccctggtcatatcaatatttcagctttagactgaagaaaaggagtctgtggaaaccactgagagaagggtcatgttgaggtaggaggtggagcattagggaagactggcagggagcccaaggcaggaccagtttcatttcagcaggcttgtcaccagaacctactgaaaactcgtaagacttgaaaagagccaaatgtatttggcaactaggaggacatgattaagaaaaataaaatttatccatgatgaggataaacaccatgttagagagaataaatgagtaaatggaagatgagcttaaagtttataaaatacagaaaatctgagctaggacagaaagaattaccaaagataattacaatttaaaaataacaatgagaattaagtagatttgtgacatgaagggaagaaggtttgcagaaaggctttaggtatgaaagagagtgaaggttggtatgaaatattagagaaatgggaatggatgaaagctcagacagcaagattagtagctagaatgaggaaagaacatcttttcttttgaaatcagagggaaagagtaatagattgatgcgtattttctaactctcagggtggagtttcaaactttgactattacacattattttctaaaagatatgttttctcaatcccatgaggtaaaaatccagcacaataacattgtttgccctgcctataccattcccctcgatatgtgtgttttaaaaatgggaatataccattgcaaagaagatgagaaaataaaattaaaaggaaattaaaatggagatagcgcttagttttttatgtggtacttgttcaatctaaggggcttgaattttgaaaataagtataatcttgatttccatctttaaaatcctaggataaaatgtcaaaatattttagtaaagtagtttttgttgttgttgttgagtaatgtaatcttatcttcatggtttacagaaatgtccctacaacttctcaaagaaatttagtagttcattgcactttgacatcatgaaaacaagagaaaattcatgttaatttttgactggactaagtcacacaacagttcagtcatatgcaatattttttatgtaacacttgcagctactgaaacgtatgtattgtttcttgcctaaggaaattagaaaaagatctggaattcagagtgatagcaaaaatcagaccattatgcttttatgtggagtatatgttatgtgaaagattattgagataatatattagaacaatatcaagaaaaaattctaatcggattgcgtgtgaatgcactatttggggaaaagttatttcatattagattccagacaaagtacaaatgcaacttacatatgtgtgatagtatcttaataacaaataggagttgtttcttactgtgtcatgagattacatccgtaaacatgtatcttttcacagtcaactagggaagaaaataaaatgttgttcagggaaattcatttcctctttagtaatacatactaaagaatggagatctctctatattaaatattcctttcctttgtgttccttggaactcaaattcactgttctttccactatataactaaacttatcctttaggcaatatgccttcagatacatataaatatctaaaatttttggttgtatatctttatgttgcttagaaaactgtagttttcatacttagtgacgattttaatttctctttggatcaatgtcaagttgtagctctctctaccttcttgtttctttttaatcctcaacacatttaggggaaataatttttatttttcataaaaaataacatctcagaagttgaattatttccccatcactcctcatctcttccaaatcttctaaatataatttgaccaatcagtcattccacttctggtgttatacaggagacatagaaatgaaagcattcttaaaattctgcagtctcatgggggaagaaatcatttcccctccaaagtttattctaaaagtggaggaccaggagcaatgttttattttgacattataggtcaacatatttgcaatactgggtctcctgttctttaatagcctttctatccagtagcaattccatagatgataagtgtgtcagctcagagatttcatcagccttatcagtgcctgctacttgctattgcatttatgtagcacagttttaaaatgttaaactttattgtttttgtcctccagttagtatccccgcatctcaagtaatcaaggacaagcccatgtgctgaaaaattatatgatcttccttactcccttatgttaaggttttagccatcaaagttgttctctctctctctctttcttctctacgtgtgtgtgtgtgtgtgtgtgtgtgtgtgtgtgtgtgtgtgtgtctttctccctgtgagtgtttttagattccattgtaaatatttaaattttatttattaaatctatttacattttaaacatatttaaaatctgtctagacttcctaacataaattcttatatacttatttcaaatccaagagattgaaagaggtcataaaagttaacaaaagatctttctcagcaccaatgctttcattcttaacttctcagccattccttggtaagtgttgatttcatcactttgtggatagagaaatagattacctaatgcaaatatcccttacctcctccatctcttaattacagtgctgactaaaatatgtctctttttttgtgtagtgtaactctttttaaaatgaacttctgtggtttacatttgtggaagttatctggattaaatgaaatagatattagtaagcttaatttatttttatcttccctcttcctcaaagttctccagtagcttctgttttgtccactaatccctattgtcactgacattctgtactttgacaatgagaaataaaatgctgttctctacctaattctttatttgatagtattattaataaaattaactaaatgaaaaaataaaataaattagttttttcattctctatcatgattcttaaccttgattgaatcataattcacctgcagaactgatgtgtgcatgcatgtgtgtaagtgcgtgtgtattttcattttagcctgtattttgggtgagctacattcaaacaccggtctcaaactaaaaatagtattggtaggaaaacttaaattcaactctaaaataaaaattcatgtatttttccaagaatcatggataagaaagaactgagataataaagggtatgcataatgctgaaattgaatataaataccagtcattattattatgaaacttttggatgtcagtcctgataaaattacactgtgaaggtcatggcattgatcccacacactgttatagactctgacctgggaatgagaaaaaaggtgccaaggaagggagtgtcaaccacctttccaaggccaacattgaattggcatcactgatgcaaaaaatgggggcaatcaggatcagataactacaatgacatagatagaatcataatcatcttgctttaactcaagttttagtgatattgggggaatattaaattctccttgatattctataatataaatgctattcctgttattctagagtgagttaaagcatccccacaatactaaagttataatcagccctcaagcaagtaagtaatttgcatgtctaaaattaatacatattgaacactcactttttgcttagtctgtgaaggtagctttacaaaatactatgtttaatatgccagagagataccagttgtgaaataatagtttttcatattagctcttaaacacctagatactttagaaatcatgatgaattatctggatgtcaaagggtaaaaattaattccttgataattaaaataataaattgaggtaatatgcaaacaatgtaaaatttcccaaaataaaaatattattaaatataatcatatttgttaatgtaattcatgtttaatctatggttaaaacattatacaaatcaaattcatttactcataaaatgattagggttgaaaagatcatttaaaaagaatatgcatgtttaagtacctagaacaccctattcattttaattttgcagagcaaacatatccaaataaatatgtgagttcaatttcaataacatagaaaagtaaaataggttagataataagtatgcaagaggaactaacagcaacaaagaaatcatactcaagatgtaatactttttttctatgaatctctatcactaggacgataccagatcaatatagcttccagtacctttgtgaatttattgtaagatgagctttcatttacttgaattaattttctcatattcaactatatccttactttaacttctaaataaaaaaattataatgaatacattcctaccttgtggtttattgttattttttaaaggcagtagaatgaagaaaataacatttttataataaattctctctccatttaatcctttccaaatcttcttctggaaattgaattgcttagactcatcttgatgattaatattctcagtacatgtctttccccctcaatgaactcacagagagaaaaaaatataattatgttcattgggctcagtatattttattgacattaatgttgttaatttacattaactttgatgtcactacttactagcattaagtatagagggcagggcacagtggctcatgcctgtaattccggcactttgggaggccaaggcaggtggatctcttgagcccaggagttcgagaccagcctgggcaacatggcaaaaccctgtctctaccaaaaaaaacaaaacaaaacaaaacaaaacaaaaaacaaatatatgacaaattaacaatattttgcaaacataatggtattacataatctcaatagcgtttccacaattagaaaaattgacaatgaattatatatttgaatatccttggtctagttttgagatctcaaaaatatggcctctgatacttaaagtgattgaaaactatatataattatgataaactttgtaaataatttccaaaactataaatgcattctctgataaaattcactttcagagtaactttttaaatagtttaccaaatgttaatctctttttatttattttaaaagaaaactttgtttccacataattgaacaactatttagtatttatattgttgaagaaaaaaaaaacccttaactcttaatagttactaataatggtattgttgttattgatatcactgtgagttggagaagtatgatgcttaacaattttaaaagcatattaacactaatctttgtgttttttgtttctactttcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtacctgcaaaaatacagtttttaatttattttacctgcagaaggttttttgttttttcttttctttctttttttttttttagattttcaaatgccctgaaaatttaagaaatataagcttcaaaatctgaactatattataacagaaaactactattaggtacacccttcatgtcctatgatagttacgtccacttgcatttcctgccctggaaaatcataagtaattgtgaaagctaaagcaaaataaagtaatttaagtagactgctcataaattggaaacatttctatgtaatgctcaacataggttgctcgtaactttatgtgtatgtgtgggtgtttttcctcttgcctttcattttcttaattctaccttatcagagggtgaattattttgttattttcctatttaacctgcttgcctgttctgggcttctgcagcttactgcaaaagtgagttgcaccatctaattttgatattatcctttaacaaactctagtagattcttttaaattgagacttaaagaaagaaacaaaaaggattactatgagatagctgaactctgactgtgggcttaactacatcaactttactgatggtgcaaatgtagctataccttatagttatcaacagaaaataaactaaaatggcacacaattataaatacaatgtgtgtttttctctttctctctgtctttttccactaaggaagtggagacatcatagacaggaatgaataaggagtctgtttttgtctgtctggactcttccctttgtaactgccttgtgtctgaattatctatttgatcctttttcctttcacactgtactcgtcacttccttgcatcaaggctaattgactagctgcaaagacactgcagattctgcagtggttcaaaaatctgtcttttaaagtaaaatcttataaaatggatgttattttagctctagcaaattctagcctatttgataatatacacatctcggtctctgcaaacgctagactgttaggaggtgtgacatttttttttacaagcaagctctctttgctttcctagaggacttttatcagaatctttgccattattaggaaaagaactttatagctgagtgtccctgtctgctgggaaaagcctgtgtttttatggtcccttttttatgtttcatccccattcaacccttccccttacttgaactaagactttgataaaacagcactccacagcaacaatacttttctgcttgttgctttgctggcattttgttgtttctttcataaacggttgtttgtggattactctcattatattggtaaaagtttactgctacaaaaatttgcttgtttcttgtattctttcaaacgtgaacaagccttgattggggtagacaactaatagtaatatccaaagacacatttcatgttatataccagtctttcaccactaaggagatacagaacacagacaggaatgagtaagagtctgtttttaatctgtgtaagtttaggtgctactacttaagtctccttgtggtactgaaattctttccacagctgtacctctcaagtatttgcattttctaatagcaatgatattatattgtacactctcttattttatgtctatataggcaaccataagacagatgttttggctgtgatgtaaatcattttagattgcagcaagtctatagaatgaaactgtcatggaacatgtttttgatgtttattactaaagaaccttcttagttctattttctagagaacactggccataaatttcagtgtctctttagtcaatgacatttgtactgaccagaataattttgtgtctggagaagatgtctgctattatgagagtgtttgttggaagatgttcaacttctgaactaaactctagcctcacaagtaggtcctggctccttataggcatttgatctggatcctgattattaataaaaggcagtcaaggtttgccatctgccaggagtctgaaatttcccaggccatgtgtttctggaagatttctcttatatcagtctgctggccaagaattccttttctatttgtacattctagaattcctcttcagtgaaggcaccgagaataaacaaaaattgtattattttgtttgaactttataattttgaaagagtaatttcaatctccctcagaattcttggtatcttgcacaatgaaaactgaagtttcagcaacatgaaacgtgcatagcacacaaagatggcctcagtgcttgggccgtatcaaatcccattagagcctggctgtttatttgtgattttctttggtaattcatttcctaaggaaggtcaacatcttttggaatgacagttttcataaatcactgtgttgtaagtagcaaatatgtccttgataggacttttttctctcataaggtgtaattcctcattcttgtgatcattgaaagccatttgtgttttattttaattcacctaattttcatactcatggtatgcccaaagattctgggacacgtcatcattcattttattgaggtcattgaggccgaatgataaaacctgaaaacaacaatatccaatgaacaaaataaatgtaacatcctaaaatgagtaaagaaagaggttctaataaaaagaaaaaaaatccaaatctgatttttagaacacttagtagtttttaaatgtgagaaatgcatattcaaaatatactctttcagaaatttgtcacatattaacttatttctctggaaaaagaaagatttcatagtcatcctcaggtcatgggagctgtgagatttcagatgaatttgtctacacttaaaggctttcactgggcaacaatttccagatgcctgctctgccaggcctcgtcctgggccctgaggaggagacaccgttccttttctcgagagtcctaaggtccgattgtgaatacagaaaagaaaagtatcatgggaatatgaataaaggctgtcagaactgaagagataaaaatgaatcctcagaaaatgatgaagttaaatcatctggatttggcaaacacaaaatgttagtgggtagagggctggagaagggcttgaaggaaaaaggggaagaatgttgataggtttataccttgaaaaaattaacaccattaactgagataaagcctataagaaaagacttatgagaccaaattggacatgcgtagttttttgatttgttagtattaatacctaagagttagttacaaatgttggatttaagaatggggtctgggattgttatgtagatgataaggaggacattgaagcaaataaaatcaccttatcttcctgcagttctgacattggttttctttttgaccttatacatgttttacagatttgtgatttttagtatattaaatgattttctcaatgcagcatgtaatgaaaagatgcaggtctttccagataaatagatgggtatagatcattaaatattttctttcatatttaaggtagtccttcataaatcagggtattgaatttagttgggtttttttttttaatgagaagagtaatagcttatttctttcccataggagacagcacagagagcctctgattctctacactaagcaggaatcattgcactgatagtctctgatgaatttactgaacttggctttaaccttcttgataccttatttctctagagggaataactgagaatgacttcttaaccctcatttcagtccattgattggtaacttgacttttcattatttttagcagagcttagatgtcttctaagtccagatttaatttcagtttcagctgcttcagtaaatgtttatcagaagcagaccttgcttttcaatttttttgttagatcagtggttgtcaatctttagcatcgtcactggaaaggcttgttacaacacagactactaggacctacctgcagaggttctgacacagcaggtctgaagtgaggccttgggatttgtatttctagtgagtaccccaggtaatgctaatgctgccagtctagcaacagtgctttgagaaccactgattcagaggatgttgcaggttgtagagaacctacagctgtatattttatgttagatgtctcatactatactatgctaacctggttttcaggaaattttgactcattcccttaagtactagctgttaagtggtatttaatatatgagagtttcccaatttcagtaacatccttattatgtattcccactttggaaaaaaagactttgctatacattataaacagtgaagattccagagtgattagctgaagaaattttggttttaaagttctactaaaaataatgcagggtattttataattgggaggattcttggagatcaacctaatcaatcacctcattttacaaaggagggacaggaaaggggactcaattgtgcagtgggttggccagactgaaaagacctataaattaatagctagcaaccaaccttgatatagtctggataataataaaaattgtatgacaaaaaataacaacaatattaatactagatgatattcactgagtttgtcaccatgccagtaactgtgattagaattttacttgctttatctcacttaatctttatattatcctatgaaagtaggtcctattgctatctccacttacaaatggggaaatgaaagtattaaaaggcttaagtgacgtaataatatgtcccagatcacaaagcaaggaaataccagtgctggaactcaagagtctctgaagacatatgctggtctggctttagccactgcatcgatttgaatgggtgtcatttaaatcattaattacttatttgaattcaggatatgaattagacaaattttaagaagtctctggatgtacacattcagactgtctctatcatgaatattataatgccatttataattttgttgcccaataaatattaattgtgaccccagacactccttaccatggtgttgcactaagaaataacaaagtcattagaagctgtgaagtgctgggaaagagcacagagtgaagtgaagtgacagcaatgctggcttccagtccagttcaccacttactaattggacaagtgtctgaatctctctgagccttggttttttcttggctgttaatcaggcctgtggtctgaatcttacctacttctcaaagtctagtgatgttcaaattctgtaaaagtgtttttataaggtatcatgtaataatagtgttggcattattactgtgttatgccattatctctgtcttcctattgacaaacaaatgtacaaataacacaaatatgtgaaaagattaagcatcagcaatttaccctctagagttcaagacctcttttttcatttgaaaaatgccaccattgttgatatggtgtggctctgtgtccccacccaaatctcatgttgaatttaatccccaatattagaggtgggagctggtgaaaggtgattgaatcatggggtgatttctaatggtttagtaccatctccctagtgctgtcctgtgatagacttctcacaagatctggttgtttgaaagtgtgtagtagctcccccttcactctctttctctctcccgctgccgtgtgaagacatgcttgcttccccttcactcttctgccatgattgtaagttttctgagccctcccagccatgcctcctgtatagcctgtggaactgtgagtcaattaaacctctcttccttataaattacccagtctcaggtagttctttatatcaatgtgagaatggactaatacaattggaaacagaaacccaattcagggagagcaaaagaaagtatatttcagtttacttattttctttccacctcagtgcatataggagattttttttgacatatgtagtttcagtagatttgttaatacaattgtgtctttagaaacattgcctgttatgtgatcagaaaatcaaacagtctgaagtaagatattggtactagcatgttaatgcaaatatataacccaaaatatacactgctgaataaaaatatagaagattcttagtcgatatggattccagtaaatatattactgtctactggacatagaaatatgttctttagacaaatctaaattttttggaatgaatccacttactggctgtttcaagattcagttaccctgaaaaacttcacttttaactcttgtattcattgggttttccacattgggctttggaacaagtctgcaatcgcatgaactttatatggtaattattaaatgacattgtataccaagacagtctataaactaactcatagagccaccctctaaagaatgaaaacattttaacttctttgtggttaacccaattgaaattactcctttctatttgtttttattataccctgtttgaggtcaaatcctggatattgacagtaagtgagcctcaagtgagcctcaatatatgtgtaaccataacttaggtaacatcaaaattcagagagagagagagctaaagagagcaaaagaataagagttatagtatagtattaaagacgctcatttctccccataaaatacttatcccatattgagacatagctagatgagttatcaattatgtttctttatatatcgatttatcaataggaaagtttcttagactattttcttattctgccgttaagattaaaaagctgaaaaggatccccaaatttgatattttcaatgtagtcaatataaacaaatactttgaatgtctaaaaattaaattgaatcttattagtccacagcagggagtttaaaggctgttacagaatagagcatagattgtgtttagtcagctggcaaatggcagtcataagagacctgaaaaattctctcctgaaagaaagaattcttaaaagatggatcatgctgcactattagtatgataaagtggtttaagctacttggctattctgactcatatattaatacatcatttaacctccttagtctcattgacatggtttttgtcttgaagaccagcaaattataggtaaataatcgctttgaaacatgttctgttgctttttcctctcagcacaacatactataaaagcaaaaatattagatatatttggaacacacaggagtgaaaggcatttaccactctcaaaaaaaaaatcagataacacaaaacaaaaaagccacaagtaataaaacaaacctctaagtgtttagggatttttattccacaatatgaaaatacaggatgaggctcttcttctctatgtttaggtagagaaactgagtcatgtagtctctttaggttggcaggagtgagagagagagaaaatgtttagagagagagtttagagagagaaatatttagatattaatcttgtcttataatctcagaaaaattatttagtcctttgagccttgactttatcatcatggatgctgggctaatacctaggtgatggggtgatctgtgtagcaaaccaccgtgacacacgtttacctgtgtaacaaacctgcacatgtaccctttaacttaaaagttggaaattaaaaaaaaacaaataaataaaataaatagcaaaaaaatctaaacaaaagaaaaagaaggggattacggctgccagtcaccaggttctatgcctagcattgaaagagcatggtaaatagaaaactctgataccatttgaaagtgattatattcttaccctaaagcactttatattattatatttgattaaattaataatgcatgtgtgcattgaagaggctaaatattcctcaaagcaaataccctgtgaagttttagtgctagtataaagaatgagtttacattaaaataagaaagagacaaatgaatctttcatacgtgggttttgtcgaaaagattttgtggggtcattttattagagccctctaatccattattaacatgattaaatctaaagttaatagcattatgtttcagtgagcagtatattaattgaatttcattaaccataatactgaaatattaatcatttaggaataatagtaagtcatataaacactgtaattacttgaatacataacatgttaatataattgggaattatgaaaatacatattatgattagaaggctcagtaactgttttcaacataccctttctttctgcctgctatattcacttattccctgattacaggcaaaatgagtatcattttgttatcaaaacacaagcaaacaaggatacaggtaatgcagaattttaaatgttctttttctcatagagtagaacgacacacactgggaaatatcgaaaagtagagggtgagaggagggacaggatcagggaaaataaccaataggtacttggtgtaatacatgggtaataaaataatctgcacaataaactcccatgacacaagtttacctatgtaattatctccacttgtaccccagaacataaaagtttaaaaaataaataaataaatgttcttttcaagaatgagttcttcaagcacctaaaaagagtgttcttattttcattatcacaatttatgttttatacactcgttttttaatcaatttctaaatatgtcaaagttccaagtctctattgtttgagtcatttattagaatcctttgacaataattttgtactgtaagctttgagtatgtgagaactgacttacagaatacagctttctgaaggaatgctaaaacccacccagaaggagtgggtaagagaaatttatagttgtaaatttgtcaactggatgtataatctctcttcccttaaaaaaggtgataatacgtaagtggagtgggcttaactttgcctaatactcatctccttaattgcaacatccctttttgatttctggagtccctgagggaaattatatacattcatttgacttggagatataagtttaatcactaagcaacactagtaccattatatataaatgtgaatttttgacacattaatatttggatgagtaaagtaaaaattagaaataattacacatttatttggactttatatgttatgtatttcccactctccaaaatatcagagaattctcaattagcaatatattgaataattttcttcaaaacataatacataatttcaaaaagcaaacagaccaaagtgaattgtaaatatatttcaatattttaccctagtcaccttaggtcacaataataaaaattgctaccaaaaaattcagtattacaatttatcaagcattctcttaagatcattctagattgttatcttatttaaacctcataacaacccttgtggtaagttctttcattattgtcattttaaaaagagaggtggacttccccaatgccactataagtaactaagtacttcaactgccatttttctccctccagcaccatgtgggtactgctaaggagttgcagagttcattcttgttgaccctagtagcagccttcgaatctttgttgaacacttgtttaagcagtcactactaagtaacaggggttcagtaagtgaggaataaatgcatgtgcatgagtggggaatacagaaaatgttttctttgactgtttggtatgtattttcacatttatttggtagattccttccacgtatattgaactgttatggataaaaaaattgcggctcagagagattaacttgctcaagtgagatttgagtgtaggtttctctgttttcctggcttttattcttattttgccaaattgcctggatattttgaccctgacatgtctagaaacctaagctcttttgaacaggtctagaagtaaaacttggccaccaagcagcatagagagttctttccatgcttttgatggagcaagtgtcctgaaattccttcagccagaggcccctgactgaatctttgcccctgactgaagcttgagtgcattaagttactgatttaacaaaactggttatctgattttctcaattcctcttagattgttgtaggaagagactggcagtaataagggagacactgctggcacattgagaaatttctgggaagggggaggcgagaacagcacattcacgagagtgtaggagatttaatgtcaagcaatgcacatttcaatattaccctgttgggcggcctgatgcagcaagttgacagactctgggaggggcccatttctaaactgaaacctgacagctgagactctgcagaaatagatcccgccatccatgttggaggcagttatttggcagataacgtgaacccttttttgatataaattataaaatatgacgtgatatgatataaatgatgaagttaaacgtccctcttctttactaccattataatcatatcctatacgcctcctcatactcttagaatattatgttgaaaatatgttttactttcctccactttgtgagcttcacaataccagagggtatgtgtatatatgcatatacatacacaaatatatttatatatatatacacatgcagacacacatgaatatgtatgtatcttactgatttatccatctgcaatgacatagacttgatttatagtaaaattgcaattcttcatttccctccctctcctctctttaacgtttgttcattggggtagtcctcttaggctttgcttgggcatgctttcccccaactctttttgacatttgtttattggggtggtcctcttaggctttgtttggacatattttccctcccactcttaggtaatagatgtagtagccccaattcaaagttttatcttttcctttccatacactaactgtgtgtgtgagagagaaagatttgggaagtgaagagaatccagtgagaagtttaggggaaatgagaatccgtcaagcatagagtttccaattgctgttgtagctttcaggaagtccatggtcctggtaaacctctcaggcttgatttgacgtgcctgggcagacagtaatttctctctcctccttgggaacacagctgccccctagtccaacttcagttgtctacaaagaaatcctcctcacaagtccacccttacctctattgtctccatgctatatactcttgaagcattgtgaactctggaatctgtcatcaattgtatctggtacctgtaaaaatttcaactttcatactctgttatctatataaggagctctcacctctttaacaaatgttggattcctttttttcttctacatatacccaacagatttcctaatacatggtatgtgctcagtaaatgttggctaaatttaataacaaggactcgagactccacaaagacttgctgatggtctattattaatttttctatttcttaggttataaaatgaatcttaccaatcaaaacttgttctttatatctgctttctttctgtagctcacacacacacacacacacacacacacacactcatgcacactataccttcataaaaataatgaaaaaatgaactgcttttcttaaaatcatagatagtttcttaggtttggaggagattctaaaggttatctggaacaatcacacatacagtgtctattattcatgctcagcattcttgatatattaatagaatcactctcttctgctccctcttcaattttgctatagcagagcagcaagggaacaacctaagatgagagaagtaggaaagtgaggacaagggttttggttagcaaagtttcaataaaggatcatgtattttctcatttcttcttataactttaaaatttccttggttgcctactgtgatcaaaatcttgttaaaacatacttacaaatgagctcctgacctcaaggaatctaattagcaatcaactgcagttttagggtaaatataagtaattatgcttaacatgcaccctcacttttttctgttttctatacaatattggtttcccaattgtattcacctctatcttttgtgagagtaggctaatagcacctaatacctaataaatagccatatcaaattttgtaagacacagaaattaaagtaattcaacatcaataaaagaagatatagacaagtaccattgtgtttctgtgaagatggtaaaattgtattaaaaataaactatttcgtggtttggggaaaagtgtagtagattgtcatattaggcggatagtccattgcagaatacgatacacgcttcatcctgaatggaatcaatacgaaatattttattatgcacatatataactattaattctatcaataaaatgcttaaactttaaaaatgtgtattcgataaattaatgttaaatgttgctaattcatatttctcttgcatactttatcctagaacatctgaactcattaatcctttatcatctgaagagcttttgattcccctgacctcaacttaaattaccagccttaagaaagtatagatctagcttattccatttggtgcttttatgctaaatttaatgcttggcttggtggtaatatgcattaaatcaagggtttcagaagcacctgttttggatgaattttctctttactgtatcatgttctatttattcccaacttagtctgcctgattctctcaatcaaaaagcagaatcaatgtctaaccttaaaatcagagataattaaagtgcattttgacatcacctttaatgtgatgtcaccccattctcctaatacaaagtaactcctggagtcatcaccttttacagatatgtggaaagtgaagcttagagaagttgaggaaatttaccaaggactactgagattattagtccttgagtcaggcctgaaattcagtcatatttatcatataaattttcagtcatatttgtcatatttatcactttagcctcaatcataaagactttatgaaacaggaaaaaatataaataaaactaaatattttgaggtttgttttatataaaaggaaatatttcagggttgaaaatgatcaggtttggaatctagaaaaatatggattcaaatcctggctccacgacttactatttgtgtaacctatttaacctgaaacagaaaatggctatattccacaattattgtgagtattagaaattagaaaaaattcatgtaaagtgcctagtatatttagatctggtttaatgttattatcgtcatgattattaatttcagaacgaagtacaccagtttgatctatgtctaaagattcacatttgtgtcatgctttcaggttgttaggatcagacttaaaatatgctgatgcagaatataagagacaaacttgttgcattctggtgatgaaatctctgaggataggcttctagatacctgcatagtggttaggagggtgtaaatctgtgaatgattccctggagccaggaagcatgaccctgagctaaaagttgtctaaaagtcaggaaaaaggaaatgcaccaggattataagacagcaaagtttgaataaacataatctaaacatattataaatcaccaaacaaaatgtagcctttctctgaatagagaaagagaaggaaaaaatcatgataaagggaaataatcagagttaatcccatagaataatatacaggttcccttagggatattttaggaaggatgttttcaccaaagacagagcattgaaattcagtattgtcaatgtaagtgtgggatcgatgttcacctgttgtcctatctttttttaataaatgaggtaaagcagatagcttcctttgaccacagttaaggaaaagactgccacctggtgaatatttgaggctttcaaaaatatatgtatagtttcaaacatctggctggcaaaaacttaaaagtaataaaaaatattttaaattatttttctttacttttcagtggattatagttttttcactatgcaacactagcagaggtttcgttaaaatgctatcaataaaattacaagtttccatgaatttttgcaccattttattaactgcatcttttataggtcacttaattcatattaaaagttacccaaaaaatgtgaaccaccatgatctatatttctttgggtttctttttgcttaattgtctagcaaaatgaattttaaaattacattgtaggatgaaaataatactaatcaattccactcactgtatacctgatccaaaaagcagaaagtaggcaaaggttgtttttcaatgtactggcactctactgggagtctttgcttcttcctaggatttagctccttcagtatattttctgtggggcatgagaggtgagaaatcagtccctaattttttttcttctagtaaaatgttgcccccgaccacctatcctgatgtgtgtgtgtgtgtgtgtgtgtgcgtgtgtgttcgtatgtgtgtatttgcacattaaaatagaagttaagaagtctcttaatgtcttagctggttgctacagaacttgtaaattgctaaaatatttcattcttgactctaaacacttgagttcaatagagaaaaaagtccttttctttctcctcccatgaatttatcaacatcagttcaaaaatctgtatgatattttctttagttgtgaaaaaggaaagccatcattccatcaggaagagtaagaatgtccctccaacagttttcttttgcctggaaagccctgctacatggtaacatggctctccgtgtgtcttttttaattcccttcacactgtcaattcctagaatttttccaagtgttatttctgttatttttgtgcaatctcagaagagaagaaatttttaagacaatttattttggtagcattccttagttttatagccatatttttaaacctgaagactaagtttttgtggctgcaccttccctgagatgcttaccgatcaatacatcatgtgatattggtagttcacattattatcctcatttaccttaatttgttaattcttctttatggagtttttctcactttagtttgttccctcctatgattacttatatctaaaataataaaactcttattagctcttgatgttgcatttgggtcttttgaaataaaactatttttcagtccattgaactgtgatggtctttttagatactatttatttgcaaacttaagaataccagtctattcattaggcataaattacactgtaaacaaaatcttagtcttttctgttttcttccactagctacataattctatgtacatcctaggtactaagtaatagttttgggagtggaaaggtagatggatgaatatggtagatttaaaaaaccttataattattcatgaaagtaaaatctggcaaagtacaatctggcaagattaagtcaaacatcaaaggtcttacaggctttagttaaggtaacaattctgatttggatcacttccagaatgaaaccaagattattaacacctttgttaagaaattatgtgggaatatatatatttttcttcaatttgacctctactacaagacaatgctgcctaatattttaagtggagtacggggttctgaggagccttccacacctcgaaaagttagtcccatgtatagcatgcagtcttctttgcagagattgcaatattctatacaagtctgtatttgctaaaaatatatgtatataaagacttgctcccaattttctctacaaaatacagatatctgtgtatatatagatatatatatatatatatgctgaatctatatctctggggagtgtgttttagagtgaattttattttctccttttttcttttgacattttaaaaatctttaagcaatagaatatacagcttttttagcaggataaagtcagtgctgtctcaaggactatactgcttggacataccacaaaaacaaaaggcaatgaatgagaaggaaattattaaatacactggcagtttaaacataaatatagatatgtttctcagaaaatcattaattatgcagtgttcaactaaagagtcataaaatgtagaaatcttacacccactcaatagactagttctttcagtattcataatctaaaattttatctaatattctgaaatttactttctcattaatagaaaaataaaaacaatcacaaccattttctgtatctttatttttaatatcattagagtaaaattactttctcctccttacatttataaatcactctgccactgcctaagcactttcatcatattaaggtcacttagtcctgtgagtagacagtcagtgacgttttctctaaaagtgaagctagcgaatgatgtggtcaaggccatgtggctagttcgtggatgaaccaagatcatctaattcctcagttttatctcaattccttttgaaataaaagacccagccacatgtctactgttagccaatcataatagccaggcattcagacttcctaccctacacatgtatctctgactttgctattcctcattcatgaatcattctagttcccatcctagcattttggaccagcacattttttcaccaggatatattatccatgtatttcctctgcatttcttactcccaaaaaggatccataggaagtttttgattattttctaaaataatcaaatttgggaaaatccctgagagccaattttcccggtttagcatagatttgtttttaaaagtttgcgttaatttcgttgcaacagtctattaccataaagaattgctgaggcctcattctctatacatccacatgctccatattctgcgtgttctacattcaaagtgggttaagatgtgaggatccatgtaaatctttcctactttcctgctgcatccaatttagagaattctcttgtaatgtattgtcaacaattctaggagtctcaggccatttgaaaattacaggaaagcttgatagtatttgtttaaaattaacatatactaagatgtatttcactgcatgtaggcttcattagaaccttcaatcataggacttaattatatcaactttcattcattaatgtaaatctacattaattcatgtgctgcatgctttaaacaaacctaatgaagaaaaatggaaagtggaaaaaaaaatgattcatcttggtgtggttttaatctctaaaggacttgtttttatttcaaagtaaactatggaattatttgagtacatgttcgtttgtgcatttaaaaaaacatcaaatatatctagaaaagagaaatttacaaagcatatgataaaattaatcaaaataattctatttaacactgaacaataaatcagcaaaagacaataaagcacttatgcaatcttctatatttaatacagatcaacaaacgcccttcatttatattggaactgaatccttttggaaagcaatttagcaatgtttagtgaaaggaaaaccaaagaaaaaatttattcatattcatacactcattctctcatacagtcaaaatacaggagattttaatatacactctaaaattctaggtggtaactagctaaattactgtgtattttaattaaaatattgtgtaactattataatgatgttcaaaagactttaaaatctatcaggggagaaatacatgtcaaataacagctgaattccacatggattaaaagagatcacactgtaatcaatttaacatattgatgaacattaaatcttttgccagtgttactggtttggttgcacatgaacaagactataaagcttaaagtaagcagatatttagcctattaaaaaaccctgtggacatgcttttaagcctagtgttcattctcataggttggtgccctattttaatgaattaatacctggtctacactgaacaatattgggggaaaagacactgatagatttgataatcaagatgaaagtaatattaacaatctttatagtaaaactccacacagaaattagaacctggctaaaatatttgaaatgaatatgatagatcaaaaatattaacatatttaagacataataaaaaatagataagccctaccattcaaggaacatactatttcaatctttcacaaatatttataatgttataaatatgccttaccatcaaagcctgaagaggacaacatgagaaagaaaaaaaatatgctcatctcactcaaaaatataagtgtaaaaatcttaagcaaaaattagaaaaatatagtaatttatttcactgccttaacagataaaggtgaaagaaacacatgattctcactagatgcaaaaaaaaaaaaagcatttgataaaatttatatctatcaatgataggggaaaacaaaacaaaacaaaaaaaactttagcaaaccaagaatggaatagacaaaagatattccttaacttgattaaaagaatgtaacaaaaaatctacagtttatatcattctgaaaagtgaaatattaaaaacattcatgttaatatccgtaaaatgagctttctcattattactttttatgcaactctaccggaggccctggtttgaacaaaaccaaacaaacaaaaaagatatgaagactgaaaaagcttaaaagtatgttcagataatttgtctgcataaaaacaaaacatcatctacaaattattgtaaccaatatgaaagtttatgagtcataacataaaatattaatatataaaattcaaatgaattttagacactaatcaaagttggtctatacattataaacactagcatcaggaaattataatttaaaattatatacaaatgtataattatagaaaaatgtatataatatatacttataaaaagagagtatttcaacagtaacaaacatttgagttgtctaactgaacattgtgtgggagtttcaagaggaaaaatagaaaactttattgaaagccccttcatttctagctgaaatctgagtctcccttgcaggcatccgtcacaccactgggccttgttcatactcagctgttgcttctttttaatgtctccaccccagtagtaatattctatggaatctcattgcttggggattttagcatcagatttactgtcatgctcctcaacaatggtgttatccagattctctggctgtacacctggacaatgctagaattacactggcctccttaacctactttccttcttcccagacatttatctttaacttcatcatgcgttagtcacctcctactatggccatacttggattcggtgttatcattaactgttctacctccaacgtcaaaatttcttccctgctcactctatctagcacccacgcatactccaatatgttctgaccctcatcctttgtgatgttacttccctgatttaaaattcaatggttcatccttgtggtttcccacctgaagacaagtttgcctcactcattttgtaatattatctggtaaaattacatttttggtttagtccaatctctgcctattgtatgcttgtactcaggtggccagagagggctgaggaaagcatataaccatttcagctagttttactctaaaggcatgaccactaatttcaagtgggtgctcagtggtgcccagcaatcttactacatttcctgggtacccttccacttgcctaggggattcattcattttttttctatctatcttttcttcaacaagctccccaattcttttctcctcttcctcaggtgatgccttgttttctattttactaagaaaatagaaccaatcaggggaaaactcccatatgcttccaccaccatagctaccaacctgcctcaatatatgccttagtacttccggatttcacactctccttcttttttgcctactttaccatctattttctcaatatcttttactggtccttcctcatcttctccatctctaaatttcgaaatgtcagacagttcaaattttcaacaaacaacattttatttaaatgtcatttagtagattccccttcagtgtaatatatatacgtatatattatataggttttttttaaccattcattagcctttactattgcacaaaaatcctgttcaaggccaaattttacccttgcattactttattaatgttaatccaaatttatttaaatgaaaccttataaaggattccatctaatcttaaccaatttgaccataaggtgaaatctttacaaatcctttataaccccttttgctaaagggcagattagtgtcttttttttattttattttattattattatactttaagttttagggtacatgtgcacaatgtgcaggttagttacatatgtatacatgtgccatgctggtgtgctgcacccattaactcatcatttagcattaggtatatctcctaatgctatccctcccccctccccccaccccacaacagtccccagagtgtgatgttccccttcctgtgtccatgtgttctcattgttcaattcccacatgtgagtgagaatatgcggtgtttggttttttgttcttgctatagtttactgagaatgatgatttccaatttcatccatgtccatacaaaggacatgaactcatcattttttatggctgcatagtattccatggtgtatatgtgccacattttcttaatccagtctatcattgttggacatttgggttggttccaagtcttcgctattgtgaatagtgccgcaataaacatacgtgtgcatgtgtctttatagcagcatgatttatagtcctttgggtatataaccagtaacgggatggctgggtcaaatggtatttctagttctagatccctgaggaatcgccacactgacttccacaatggttgaacaaaaagtcaggaaacaacaggtgctggagaggatgtggagaaataggaacacttttacactgttggtgggactgtaaactagttcaaccattgtagaagtcagtattatatagttttgaaaaagaaaagtgaagtctgtcaactaaacaatctaagagttagtgataataaccctcaagttcctttagtgattcatcctagtccaacctgctggtgatttaaagttgctatttgtttgatgtctccttaagagttgtaatatatttctccagtatttacctaaaatacaaataatatttaattgttattcctgatgtatatatagcagtacacaataaagaagcagatgccatttcaggagatacacagcttaaattttcagcaacaaaaagcatgcattctaaaccttgacatctacacttacaaaatcggcccgccaggaaattattgttctacctttcagatgaatcaagcactataattgggactgtgtttatgtgaggagaaacaaatgaatctggtcaaactgaacaagacagttttctggtcttgctcctaacaatcctagtactgtcacataacactagtacctccatgttatttagtgatttatagattacaacatgctttcacatttaatcttcaccacagccctatgggaactaactttgagaaggctttgatatatgtttcttcagttcttgttccttaatgagaaatattttgaataaatgactacatttggaaatgagaaaataaaaaagtggggaagttaactggctttgtcacagctagaaatggttgaggcaggatttaacggacattttcctactctcgctacctgagctgttcccacgatgtcgcaactgccttacctagaagacataacatctattggtgaagaatttagactctggagtcaggctgcatggatttctgtatgaccatgaggaagttactgaacttctctgaggcctgtcattctcttttgtataaaaagggtaataataatagtacatgtaaacattattttgaggattgactgagatgaggtataacaagctccccacacagggcatggcacatggcaagtgtttcatacaggttagctattgcttatgttatcatcattagactccaagtatatttgcacttacaacatcaattaattgaagtagttttagccagatccttgttcatttgtatcaacacgtgtcctttttctaagataaatctgtcattcaatcataggattgtatttactgtgtgccctatataccttttcaagtcaactctataagtctttgctggtatttttaattcaaagtagacagaaaataggcttccaataaagaatagtctgtgcaatttcaaatgaatatttgctttacaggaagtaaaagtagttattgatattaagttatcattatttatactggatgcatcactaactaaagcaggatgtctaattgtttggcttcctttggccacattggaagaagaatgtcttgggccacatataaaatacactaacactcacaatagctgatgagattatttttaattgcaaaaaaatctcataatgttttaggaaagtttgcgaatttgtgttgggctgcattcaaagctgtcctgggccacatacagcctgtgggccatggacttgtactaaagcttgggtaaagttagatgtatcttgtaataagagcctttgatgggaaataagggaatctgcaattgtggagtatgcactcatcctccttactattcttagaaactccttttctgaaaatgggttcctcttgacttgtaggaaagttataataacttcccttcccccttcctccattaaaggcaaaaaagcagcccaatgacagttcaattttacaaaaggacgttataaaaattataatacttaagatgggttctgagtggcagaactggataggtgagagggaaaaggcaaacaccaatttaaaaagctgtatggaaagtttaatggtgaaatgctcagaccatgggaagcatactgaagtgtagtgcacagtagattttaatatagagattgacctaattatagaggattttgcacatcaaataaagtagttcagatagagataatactaaggacaatgtctgatagaaagtagaatctcaactaatgtttaaagagcctaaaataaggaatctttatataaataattattctacaactctctagcatgacaaaatgaaacttcaggagcatctctctggaatgatacatacaacattactgctaattcaaatattcaatggcatcacaatatttcacacaagaatatgtttctacaatttgttcaaacttttctcttttgaaaaacattgaggtgatgtccaaatttccatcaggacacaaattgatgaaataaatataagaaatattctcattgtccctgcttttctgtaggaagcatttcctgaggtaagacttctcgaaatttgtataaatactgcatactctcccataaagctgtaataattttatccctctagctttcaatgaatgggggagcctgtctccatagcttttcaaacttgaccatatgatggacaaatatttgtatttcattattgtttttatttgtttttccttgactattgagaaaaatcatcatttcttatatttctggccctttgattttcttcttctgtaaaatatctgcttataactgttgatccattggattgcttataagattttttatttacattttttctgtgtgtgatgttaagtatgtctcatatgttgcaaatgcattttattgtagtttagtagcttatttttttaactttatgtatgtatggtatccttggccattccactcaagaattgtataacaaaatatgtggtttttcattctgtgtttacaatcttgctttaagagctctcaatctcagggcagacaatctcagggcagacaaaaaaaattttgttgccttttgttttttacatttaaatatttaccccatctcaaatttgttgttatgacaggagatgaatagcctaactttgcttgggtagaagattgttttagtgccagttagtaaatgaactgctttttcaaataaataaaaatttaacttttcacatataaactttaaatacataatcaaaagtaaatctggtcaaaattctgttcaagtgattcatatctctcactatattcttgaattatagtctcaattttataattttttagccattcttggatatatattccttcatatcaattaatataacaatgttattaagttataaataaaacaatataaacaaaaatattctaatgaaatggtactaaatgcatatatttattgtaagaaaaatcaacataattctgatatgaagtcttcttttccactaacggaataatttttctatatttctgattttattttatgccctataaggttttattttttctataatctattcacacttattatatccattgtcacttaataatgtccaacttttttctttctgtatgtaatcagctctgttaataacttgtattactaatgttaagaaaagtatagatttttgtactgcatacacatgtcgaattaagctttattaatacttctaaacttgaagtctcttagtttttcaaaatatatgaccatgtaatttgccaaacaggaacaggttgtcttgtttcttaatattttattttctaatcttattgcattatatagaaactccaaaataatgatgagtaagataataagaataaacatttccatcttatttctaattttaatgaaaaaagttttcactctttattgtgagttttgctactggttttggtaaataatccttatcatttctaggaatagtgatgaaattcttcaaactctgtttcacatacaatatcatcacattgaaaaatattatttaccataatgaatgatagctaaaaatatcataattcctttgatacactgttggattcaacatactaacaattattttagtggtgtccttaccagaaaattttacattttattttcttttttgtttgatctttgtttatgtagaataggatttcttactttgttagcaaacaagccttttgtttattactcatttaaaatacaaaactaaagcagagaactgcaacaaataaaagttgttatatatacaatgattttaaaataatatggaagccaaaagtcagtaacttacgtgaatacgccaattacccctaactgaaatatacaggcccacatgtcaagtaaattaaggaagatctatgttgtacctaagagactcagtaaaataaagtgctattttttagaaaatttccaaccttgaaccctgcccaccaatttgggatttccccagaatatatttaatcgtacataattgttttcattactttaaccaaatacctggtgaatactatcagtgcacagactcatcatttgcttagaataagaaatttctctggttgtttatgcctcacttttgacttttctccaggtgttctttatctttcagtaacttttatttacattttagatcttctggatctttccccagatctccagaatttttctgcatgaagtaaatatttgtgtgtgtgtgtgtgtgttgtgatttatttcttcaacctgatactctaggacatctatgataatagaacattctggtttcttaataaatataaatgtaattttttaaaaatttcaaatatcatacattcctttccagaaagtcctccgaattttccaattacttctcctaaaaaacaactatctgctttgtgctttccagttaaaaattgtatttgtcttccaagtctaatttacttagacttaagagcttcttaacttagggatgtgctagatagaattcaaagatgtctgtgaactaagatgggaaaaattatatctttagttttactgacttctaaatggaatatgtaatttccttcaattatgaatgtaggccaaaagtcagtttccatagcagtgactgtgtctttgtcaatagtagaaatcatagatattttcctatcgtatcactattacactatatatctgatatatgtttattatttcaaaagtagtctaattatcttccagtgtaactttttatttaatgtactaataggcattcatgttaccacattgcatattttttaatgtattttacatatatttaaatatatttttatgtataatactatggattttgtttagaaatagtattctttctgaattagggtccacaggatgcttcagatctccaaagaaatccatggcacacaaaaatttaaaatctcctgatttagagccatatgtatgtaatcgtgccgaatttcttttaaggtgtttattataattattttctggatcaatgtttcatcagacatcaaatcaaactattagtgtatttaggccagtcacggtggctcacgcctgtaatcccagcactttgggaggctgaggcgggtaggtctcctgagttcaggagttcaagaccagcctggccaacatggtgaaaccccatatctgctaagaatccaaaaaattaagccaggtgtggtggtgcctgcctgtaatcccagctactcgggaggctgaggcaggagaatcgattgaacctgggaggcggagattgcagtgagccaagatcatgccattacactccaacctgggtgacagggcaagactctacctcagaaaaaaaaaaaaagaaaaaaaaaagctattagtgtatttaaagttgcaaccactctgaagaagtaaaaagcacaagtcttttctcttatccaccagtcttcataaacattctggtaaattattagccctaggcttagactaacaaataattttttgtctgtataagtgcaaatttgaattctgtttagtcttttaaagcagaagtttgagcctaaaataatactttcgagtttgtttagataagattgtaacctaacttattcatccatccatccattcatccattcatctatagatttcttcattcatatgacaaccacttgcttttgtataagtagtttgtgttcatgtgtgtgtatgtatgtgtgtgtgcacacatgtacatacatatacacacatatgtatataaatttaggttctaaattactgttgtcaaataaatttttaaatataactctatataaaattttaaatataactaagttgaaatttcttgtgttgatttgaattagaaatcaaacagtctctgtgtatgaaagagataaattttatacttataatcctgaggggtttttttaagtgttgcttttgactatgttagagtaaaacaatgatgctaaacacaaggggaagctaaagaacttagcacatttttattgaagcccttgaaaaaacaaacacctttttcataaagtttctattattttactatcaaccagaactttaaaaaggcatttgagtcacagaagtttcgtgttacaagggatattcctttgcatataacaaatgccccttactatctttaagagactttcacaagattatatagctaattaaacatagagccaggtgggtgcagtggctcacgcctgtaatcccagcacattgggaggctgaggtaggaggatcatttgagcctaggagtttaagaccagcctggccaatatagtgagatgctgtccctacaaaaatatgatctaggcgtggtggtgctatgcttgtagtccggctacttgggaggctgaggggaggtgggatcacttgagcctaggagtttgagaccagcctgggcaatacagtgagaccctgtctctactaaaaataaaaaaataaaaaaataaaaaaattatccaggtatggtggtgctatgcctgtagtcccaattatttgggaggctgagggagaggattgtttgagcccaggaaggaggtgattggtgttcatgtcactttagttcagcctaggccacagagtgagaccctatttcttctttttttttttttaaagagccaggttaggacatgtatccatttattcttaaaatctagtgtatgccaaacagtattatgtcagtaaattgtttttactcaatataactattttataaaaactgaatttaatagaatgaatacccttaaattgtatgaatgtcacttcagaatgtatttctctccaaaaaatttgacttcagtattaataatggttcaaacatgtatattttagtgacagagataaatttctatgaggtttttgccattacttttaacggcaaaaaacacaattacttttgcactaacttaatacatttgggtaaaacatcaggctctggattttaaaataggtgcttcacattggtgctgagtcacttcaaggtgaaatatgtagatacattttaagaatagcaatcagttataagttaatggttgcttgtatatgtcaataacatttaatgctgtgtgttatcaaaataattcagttattaatgtaactaatcttgcagtaaaattgagaaaaatattgaagagatacatttataaagtttggacagaataaaagccaaagcaaccttatggttagttacacaatacaaaaaacagggggatttatttggtttaatttcagggtcttcttttaattgcctcttctacttttgttttggattgctgagtgaaatttgtgattcaataacttggaatttatttttaaaaagtagtttgtttggagtatgtggtttgcttcttagcaatgtgagtatataatttaatgccaatatgttttcctgggtgtaatgcctttatgtctatagattttacttgagcaaaataagtaaaacacagtgtgattttcatctgcagggttatgtccttaaatatgctagatggaaaactttataaatttgagaagaaaagttaatggaaaagtagtagttattgagtgcctacaatgacctatttattttatgtgttaggaaaatgtcctcttcacttgtaacaatggaaccacaaaaggaaggaggaagagttgcgtatgggagacattgaataaagcaaaggagagggattgagatataaaatagactgcgttgagaacgaagcgtgaaaaggggcagcaagcccattttctgggttttctaaatgtttgtgaggtcaaatgacttatattttagacttccttaaattattgaaacaggtagtaaagttgataattaactgataattgcctcagctgcagtcaaccagagtccctgagtcatagcttttcgctgccctctccatagcttcagtatcgcccattctccatagcgggggtgctttgaggtggcaggctcggcttccctggaaaaccagtaagaaaagcctctttatcaacccttactcatagtcagctgaaagacagaagagagagggaagggccattggccctaattggatgcaagggttctctgaaagtgcctttccagtgctagaacgtgcaaatttgcattagcagcttctgcaatgcacttgtgttcacctttccatcccagacaagtgaacattagggaaacagaaatctgaattcagaggactctcagggcatcatctggatgagatctcttcttctctgatatgtttgctttaaattaattctacctcatgtttctgtgttctctttctttctctctctctctctctctctctctctttctctctctctctctctctttctttctctgtctctcatctttcctgtctggcagggtgcaatcatatcctttccttttccatggctacaagtctaatccaaaatgtaatagctatcagccttctttacctgcctccaaccatttcaattttaatgtattcttcaaaatatactagaataatgttactacttagaaattattccattattctcctggctaaattcttctataatgtcaccaatatttataaaataatgctattcaaaagcatctctaatcttgccctaatctacattgaagcattttaaaattatttagctttcttgacttatactatactctaaagaaagtatttttataaatgtatctctcatgtcttctctttgatgctgtcattttcttataactgttttacattgctagttccaaccagtgtaaatataaacacctcctcaaatccttttctgattaaaaaaatctctaaattaatttcccctttgttttattcatactcttcttagagcatttactgagttcttacattaaaatcatttctatagtattatactgtgtgtgtgtgtgtgtgcgtgtgtgtgtgtgtggagggagaaagagaggaattttctgctatgcttctagaggacaaaacacctttttccacccagcacattgccttgcacattgctcatgtatagtaattatttgttgattaaatgaaagccattaaagtgacttgatttattgttataagatttagtgaagttatcttctttattttttttgtttgtttgagcacctgcgaatctgtaatcctaggacataacatctgaaataagctaaatgtaccagccatctagggaaaaggggaatttaagtctctgtataccccaaagaccatttgtgtacaaatgaaaggctgtaacattaggacattctgaaagaagagctaggaaaacttagcaaagaaaaagggtgtgggagggggaggggggcagaagtggtattttggtctttctagagagagattaggtcctgagagcaaaatcttgagggggtcactttagcttgcattgtttcactatctgtgaccggctcttccttgtcgtctgagattgactcagtctctagttggaaggcttggaactctgatttaatggcttcgccctacagaaatggcagtcacctgtgtgcagaataaatcgatgtgtcatgtgtggaataccaactatccgctaggcactttgccaagtagaaaaagaatggcagccgaatgttctaacgcttccaaaagaacagtttgcatctgcagttttctgctccaagtatgtcaattattcgcttcttgctaaggaaagtaaaatgttgcacagtaccgtattcttgttaatactgaacaaaaaaattatagttagcaaataatttttatgttctagggctcatagcagattttacagttattattgtattctaactctaccagtcatatatatatatatatatatagctttctgctttatcaggttttggtatcaatgtgaagctttctgctatatatagcagaaaaactaccctgagattttggaaagtacttggcaaatttttagaactgaaagtttcagattaaaatttggttatcatctgatgtgacgctgcaaatattcatttcttatttttctgtgtatttctcatgataactaccatgatgttggatttgaagtaaatgaacatttgattcactttgcttgggagatacaggaaatctgtgctccagttttctgtcaaatacacagtcatctctgtgaggatatgaattgctttatcttcatttttcttaattctctacatctaatgcagtgccagacaatagactcagtaaatatttgttgattcaatatatgaataaattattgaatcaatcaaagtaattataagccgttttaagaaagggaattgcctgaagctgttgctatattagaaaaatcgcatttgcagtagtggagggaaagaactgaagatcccgaagacccgtccttttctttagaatggcttacattttatattaataattttctagtaaccatagggtccccttttcctttattaaagcttctattctattagctggttaaccatacagtcttttgtcagacccttctctctctttctttctctctctctctctcattcttttctcatttcaaaacaaaaataaaaggtacattttcctacatttgtgtatattttgaatagcatcttcgaaagtaaaagcaaaagaagcaggattgggaagcggaagccgttagaccctgatgcagagctgatgaatgttcccgccactgtaaacaggagctccggaggatacggctgcctagcaagccatgtcgtatgctgagtagaaatagctgggccctgtccatcctctctgcttgctcttccattgtcctgcattttaaaactgaggaagaacctgaaccggttagcaggtggaggctgctggtagactacactcttggtagccggacagcaagtccattcttgaaggggttatgaatgccacatctccattttctataggaagaaagcattcttattcttttaacgaagaaaacttcacattgataccagaatctgataaagacagcacagtgaagattagaaatccatctcccgtaggaaaatcgattccaaaatatttctcataagtgggagttgaacaatgagaacacgtggacacagggaggggtacatcacacaccggggcctgtcggagggttgggggctaggggagggatagcattaggaaaaatacttaatgtagatgacgggttgatgggtgcagcaaaccaccatggcacgtgtatacctatgtaacaaacctgcacattctgcacatgtactccagaacttaaagtacaataataatttttttaaaaattgccaaagtaaaaacattatgcatttgaccacgtggaattcatttcaggaaagtcagaatgtttcaatattccgaaacttattaatataatttgccatacttttaggactaaggaggataattatatgattatatccattgaaacagaaaaggcattagacaaaattcaacactcatttttgataataaataaaaaagttatttgcaaatggcataaatataataaataaaaccaacgtaattgcagtgggcagacaagttggtatcagtgcttaagaaaactgtgtgacacaaaaactctgtacctagaaacaaaatcaacatacatgtacgttattccttcatgttcaaaacagaaataaaatcttcataagagcaatattcttaatggccccagactggaaaccataaaaatgtcattaacaatgaaatgaaataaaatagaaattgaaatatttcgcagaattgaagcaacagtttttgctactaacaaaaggaatatatttcaaagagctaaagttgaacaaagaaagctagacataaagagtacatattttgtgattctatttatataaaattttcaaagtgtgtgaaagttacttatactgataaccattaaatctgtgagtatatctgagaaaagtaataactgagaagagtaacaagtgggaggcttgtgaggtgcaggcactctcaggttttaatctgggttgtgttacctaagcatgttcagatttttaaaagtcatcaagctgtatattaatatttatgcattttactatatgtatgttatactttaataacaagtataaaacgaatagtgatagcaatgaatcacaatatattaaataaaagaaagaattcatggggtcatagcaatatccaacaacaaaaaggagaagatggagaactttcatacacagaagaatgcaatataataaatgtagaagtgatgagagaataagaaaacctcagactttcaaaaaccatgtaataattgatgtaggcatatagttagtactccgtaacaggcaattattttcttaaaacacttttgttctgtttttattgtcttcatgcaatcggagaggacccaaacctgtcccctgagacctagataaacactaatattttgcctgcctggctgagtcagggtcccagcagagtcccccacggagtccagctaagacaatcagttcctgatgtctaacaatctatgaccagctgggtgccaggcaattaatggtaaagacaacatataatgttaaatttcgaatacattttagagtaagagtaagctctaaaataattataattatgtaatttaaaaatagttatttactgtattagtccgttttcactgttctataaagacactacctgagactgggtaatttataaaggaaagaggcttaattgactcacagttccatatagctggggagccctcaagaaacttataatcgtggcagaaggcaaaatggaagcaaggcacatcttacatggcagcaggagagagagagagcaagaaaggggaagtgccagacacttatcaaacagccagatattgtgagaactctctattacaagaacagcatgggagaaaccatccccatgatccagtcgctgctcaccaactatatccctgtatacatgaggagtacaattcaagatgagatttgggtgaggacacaaagccaaaccatatcattactgaccaacaaatggaccattcaacaaaccagtgcaatggtttattgagtattaaaactcaaacagcagatttattcttggtatattctcacatattttaataaacttactgtatctctctttaatacttttacactgttattttttgaaaaaaatgtatgctattcagtatggatatactatacttatttttaaaataaaattttctgcaatattctacaaagatatattttatggttaatgaatttgaaattcgtaatgagatttgggtggagacataaagccaagccatatcattactgaccaatcaattgaccattcaacaaaccaatgcaatggtttattgagtattaaaactcaaacagcagatttattcttggtatattctcacatattttaataaacttactatatctctctttaatactttcacactgttatttttttgaaaaaaaatgtatgccattctgtatggatatattatacttatttttaaaataaaattttctgcaatattctacaaagatatattttatggttaataaatttgaaattcttaacagcttaaaaagcatagaaatccaagatgaaattgtactgaatccagaaattgccttcaaattacatgtcacttaaacatacatctaatataggaaattatttagttacattgttttgtcttccctcattgtctgccacagaaaacactaaaagtacagtagtctcctcatatccaaggttttgctttcatcagtttcagttaccaatgcttaactgtggtccaaaaacattaaattgaaaattccagaaataatacataagttgtaaattttgcaccattctgaacagcacgatgaaatctcacgttgtcccactccatctcacctgggacgtaaattctcactttgtcaggcaaatgcacactgaaaccatttcccaaaccttagtcacttaagagccatcttggttatcagatttactgacacgagattgcagtacttgtgaccaaggaaactttatttaccttcacagtggcctcaaagtgcacaaaagtaaaacactatcttaacaggcagtgtggtcaccctagtactcataagcacatttcaaaaagtgtttattaccatcttcactattaaataattgcatacctctgtaaaggacattttaaatcgataatttcattcctattatctttagtgtttctcatgaaaccaatggatatcctatatggccagatgactttaaaatgtgtgtaattgtccacatataaaaatgtacctatatttaaaagtagcattaatgaagtgtcatcatgagtgtcgtttttctccatatggttttcctctgatccttttgtggtttccttcatttttccagcagcatatttcaatgtgacgtgagtcatcatttttttttgccatgcctgtttaactgcccttatgtagcattaacttttcataaatgcctctatggctttgtgccagcaaaaataaataaactaaaagtgctaaagcaacatagtgcagtgcaattcactcagggttgggtgtcagacaggtgaacctgtgtttattatataaggtctttaaagtatgtggaaattgcagatcagattgtagaccttccacttactcactgaggaactacatccataaaatgtgaataataaagggtgagggttaatgtacctggcagatgcttactaaatggcggctattattattttcatcattaccatccctagagtataacccaaaggaaatcgtgcataaacacattggtgacctgattcagtggaattcacactgctgactcgactcaatgcttgcttatttctaataaaacagtaatgctagttatggagcacctcttgtcatctggaaaatataccagaaaagcacagatgaaaagaggaagcatgaggccagcccacttatttttgctgccacatttagtcactaggctgaatgataggaaagcagaagctaaaacacagtaaaaacaaacaaaagacaaaacctaattgaggaattaaaggacttctactgcagagaaagagcttgggtttaaaacaaatcattaactgtttttgagtgtatttcttgattattttggacctcaacatctctgagaaagcaaagaaaagagtgtcagctggaaaataagttgggcttatttaaaagaaataaagacattcatcaagtaaagagtttccataaccacctattttaagatgctgtaaaatgtcataattcagattaaaaaaagaataatgcatcatattggaaagtttttttttccaattttgtctggtctttttgtaggggaaaagaccatatctctcctacaaaaaaaaaaaaaaccggccaaggacatataaaccctgttccatattgctatagcatggtgtatgaaattcacagacttgaacaaaagaataaatattcatcacctctgcctttttttttttaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagaggtgagtgttgccagacttgatccatcaaaatgccatagagtttaatcacagtgaagcaaactgctactcacaaaattagttttgggttttagagcattttctattcagctgtaagtggatgacatttattgtctaccggattaataattatgaatcacattgaagagtggtaataaatggtttaataattgatgtttttggcctctgtcttaaaatgtacacattgactgtggtataatggaaaaactaatgaattttagtatgtccagactgagatttctggctctgctatttataagtcttgtaactttagggggtcacagatagatttccttaagcttcagtattctcacctgctgaatggatttaatatttgaaattatatatatatatatatacgtatatatacatatatacgtatatatatacatatatacgtatatataagtgtgtgtgtgtgtgtatatatatatatatatatatatatatatatatatatacgcatatatatatataaataatcagccttctgtatctgcaggttccgcatccttggattcaaccaaatgtggatggaaaatgcagcattcataggatgtggaacattcagatatggaaggctgattttttcctatccatgggtcccgtagggccaactgctgcagggctagagcagccatggattttggtatccacatgaggtcctggaaccaatcccccacagatgcttggggacaactgtatatatagacaacattttcctcacaggtttttaggaagtgtaaaatatgtggatgtgtgaagactcttagtaaattatatggtattgttttatttatatcagtaaatacttattataaagtgttaataaaataaaagactttagtacaatagcagatgtaagtactaaaacttttctcatatcttgctcatttttttgatttgtcaggaataagaaaccaagtaagttcatcgcaagggagtaataaatttcttgtaaaatttccatatattaaaaatgctgtattaaataacagaatctcatacttcttacccttaatcagccagcataattgctttgtgtttgagtgagttctcaaaagactgtttacatctatctgaagaaaatattggttctctgttcactcttaaatgatagtaattatctattccagaacaatacttggaaatgctatgtaagatgaaaagagaaagagaaaaagtgaaagacttctgaattgtaaaatgtactcagtttcttttgaatttggccttaatgatcccatataagccctggctgctttgtctgttgctactcactaaatactcaaggttcaagatacctgaacttgctttctcaattttttcctctagttgtgtgattagttaagctaatctggttgtcatggaagcctgaaacaaggtgaaatgaacttttcccttaatactgaagtgaacagcttcttttgtgtccattccctctaactctaaaatcacatttgctattttgagtccttgtcagcagtattaactcattttcttaggtttttatgttttggactcagagatctaatattttaaagaaactagagtaattttactacacaatgataagatacattgatgaaagatgttcaaagtggtaaatgggaagataagaagtcattgcaggctttagacttgaaagatattgaaatattgatatggcctaaatcttcttaaagatccatattagcacagtagtatgctttgctttctttagtttttctttggagaagggggtttaaagaatcgacacgatgattgcaaagattttctcttatgccatagctgttcactgttaatattatcctacaaatgttgaatggagtaaagttcccaagatgtacaattcatgaaatgaaacagagaatgcagaagcagcctgctctgctcacctgttgctctttaggtctctctgcagccagtgaatgaactcagatttattttttgcctgcactcattttggtcatggcattgaagctgatttaacgtcatctttggccacaataaattttgtgaaagcctgggaacaaagtactcataaactcctttaccatatcctcataacagaatgctgtcaatgatattgcattaactgaagctgccaaattcctgtcaaagagttgttcgagatagaaattgtaatttgaatttcttgcatatttatatttatatttttacctgcaaagtaattaatacactttggtcatgcattaatttccttaataactgtttcaacatatatttcatggaacacattccaggaaatgcacggggcacttgggattcccaggtgtcaggtctctgctctcatagagcttatagcctattaggagagacaatgaaacattgaatatatattctccattttgttcctgaaccactaaaaatgttcttccttactgaacgtgttttctttgcttatgttcttctgtatatgttataaatataaaaagtggtttcaatgtcaaaacctatgaaaaagccataactctaatcccatcttcagtatctaagaagcaaagcaatggaaggcatttaataatttccaacacttctctcaagatgtttgtattcttgctaatatgaagttatggaagggtgataaagcctaataatacaagataaaacataacaaaaaacatatagcatgtaacaaaaaaataagaattggtgctattttttaaaagacacttttcttgtagatatggggtcttgctatgttgcccaggctgatctcaaactcctgggttcaagcaatcctccccaaaagatacaattttaaaagacattgtattgggatttttttcctttcaaaatgttttgagatttcaatggagaaaaaaatgaaaacgaaattcttacagagttgttctggagtatcttgcatttactatcaaagagaatatttttctctgattgaagattttcccaaagcaaaataacattggataactgatagcattatttaaaaaattcaggaataacattttactttcatatataccttttaaaatcataagttgtgttttaccgcatgtattcttaggttattcagaaattattaaattcaaatattaaaggttttctagtaagatcatgtgccttaaagaaaattctgctttagcatgtcttgcttcatatctttcttaccaaaagttttccttggtttggtctaaataagtctgagatttatctttagtccatctctcaggatttggaatgctttctcattaaccttcattcacatagctaagtcctgcacactctttaaaggtcatctcacgtcttgtctcaccgcaggagcattctatgaagcaaacccctccatagactctcttggataaatgtcctcattatacacaccctatattgcattgtgttattacttttccatctcctcctctaggcagtgtcaggaacacatccatcttactcaccagtcatactgtagcccctgacatacagaaggtgctcagtaatgaatgcacctgaatgaagtcacagatgctcttagatctggatggttccctgcatgtttctttgcctgaataaattgcactatttgggttaatctcctaataacagattccttatgaatcaacatattaaaacaattaatgttggcaggatttgattgcagacttgttctggtacttctctaatctcatccaaagagaaagctctgtgttaatttcatgccatagatatttttacattttcattttatatattctttctaagcagcagcatcatagaaagaagaattgtattacttctattaattctaggctaatgatgctgcaattgtactgatcatatattagcagaacaaacatcttctatcaattcaaatgaatgtattttagcaactgggttaagttgtttacatggtttattatattaaacctccaaatacacttctgaagtatgaactatttgttgctgtttttttttttttcatgaaaaaatcggagtcacagagggttatataatgtgcagtgttactctgttaaatattggggccagattgcaaatccagatcttaactacaaaaacttggctctaaccatcacaccatattgcctccacccagacatcatcctgctgaacactgggtaaacctgagaaaactgacgctgctagcctagttttgttgagcacatgaatttatttcatgactcagctcgcccgtaatgaaagccttgcattttgacatgaagttttctttgctttcacgttgtgatgaagcacttgatttctccaaagagtgtgaagcctactttccctttctttcttactccacttttacgtttctgtgtcaaacaataatctttcaagtaccattctgcgatgggacaggtttaaggtttaaggttgctcccttgaccaagcactcccatcccgatgccaatcatctaaatgaataataacaaaggaaattggaaacaaaaagcatgtagtcatacccttaaaactgattcttgccctgtgtgtaacataaaggcgaggacgactgaggacatgtcttagacaaaaaacttgtcccttggtttctggcatgatttttgcagatgcagagtctgtggcagttaaaattacttccatgtagtcattcctcttgcctaatatttgtaagattactaaatgtgaattggaagcttaatacatttcttaactattttttacagcaaagaccttccgtagtttttgttacatgattgacaatattgtgaagtaagtaattaaaaggtagagtagcctagatgtcaaataaaaataaaaagcaaggaaatagattatttgtctaaaaacattacaattcaaactctctatagcttttcaatatatttaatttgcctttccctttcatgaaggtatttcagcagctttgcaacattagcttaaattttggaactaatttgggtttcgtcctacacattaatgggattgttaaaggagaaaaatcaacatttgaacagcccgctgctcatgacctcctaaccttctgtttatccagtcttgggggaatggagaaaatgtgaagagattcatgtcaatcagacactatccatggcatggtaaactaaattgattcaaaatgttccacaattacagctctttaaagctctcttaatctcaagattgttggttctgtttcttgatttatttcaaaccccttgatatggaagcaagaaacaagactgctgtgagcaaggagacaggggaggtggggagaatgtagggacagaggaaacacatagggtgtagccttagtacaaccaagggacacctcgggtgagagttagagtgcatagcaagagtgctaaagcagttaaataacaaatagagcagacactgtggattgtgtcttcttaaaactgcctagaaccctacttgtctgtatatcatggcctttattttataaactcttttttgataagtgtatcactccaacaggtttttaattcaaatgttatttgaaaaaggcaataaataatcatttaaatccaatcttactacaatatgaacttcatgttaaaaatcaatcaacaaacaaattaaaaacaccactcatgttcttgatttacctgatatctgcatatctgagatctatagcaagatgccattttgtgcttctgttagtagttgagggacagtaacatctctctctacatattttttattctgaaattactaaccctcaaggttgtaccctacccatctttaaaaaaaatcacacaggtaagttaatgataatgttgcatccttgctgtctcataaggaccttgggttggtgttgggaaacaatgactttctcctcttagatccagtggattttggtgtctggtcagcagccatgctagacctttgcacttgctacaaatttgacggcatagctgaccattgttaaccactgactgtcttagaatcttttgtttttctccattactcttctttaatctgggatgtctaaaatatacctttcctattttattatgcctgtaaatgacataccggagtatataatttggggaaaaatatttcatgctatgaaaatttttaaaaaataagtttgaaaatctcatgctggccagctgcagtggctcacacctgtaatcccagcactttgggaggccgaggcaggcaggtcacaaggtcaggagtttgagagcagcctgtccaacaaagcgaaaccctgtctctactaaaaatacaaaaattagctgggcatggtggtgggtgcctgtaatcccagttactcaggaggctgaggcaggagaattgcttgaacccaggaagcggaggtggcagtgagccgagatcataccactgtactccagcctgggcaacagaaagagactccatctcaaaaaaaaaaaaaaaaaatctcatgctttggagactttttctcatggacatcaaataactcttagagaaggagagcaaagagattactgagagaaacatgagagaaaacaccatagtccttatggtgttccccgtcataactgagtcatttatgtaagtaaagttggtaatgccttttccttagtttggttttcttatttaacacactgggttatctgaatgagattcaattaccatgtccttttcccttatgcttcttctatgtttaaactgctttgaaaagattcatgtcctccaatgtcccctcaaataccactttctctgaaaaaccttcccttatattatacccaggttaaaattagttattgttttctcttttgtatggtagaaacattcctttattgcaaatgtcggtttttcttttcattatttgttttcacattttgcttctccagttgaacaccttgcctctaatattaacctcctccaaaacattactcacaacactactaaaggttttttgttttgttttattttttggaaaggcagatctaggaaaaactttcccagttatacaattgaaaatcccaagcccggggaaaccctcagtttgggtcatcataaatctgagcacaactgttaagcattgtaatgtctatcacataaagtccaactgccacaacagtcttatgtggattctgcctaaattttcagttttacctttcttaatgcccaccgtcactgcttagagtctgtatttcagccaggtgggaacattcataacattgttgcaatatttccccttctaggcctttatatcaggcatctcttgacgttggccctattcctttgttcatctattgcaatgggttttatctggatcatattagaatcacctgggaagtttgtaaacactacattgctgcatatatcccactttcaaactagttaaatcagaacatctgggatgttcaccacatctttgaaactttttaagtttcaaactctccagaaaattctaatgtgcaatcaaggctgagcactacttaaaattatcggttagggtttcacctgtgacttcaagcttctgtagatttccttgactctctcagggagagaagacaatgggtcccaaatgtatctgattatcaaactcgcctggacagcttttaaacatagcactttgcatgaagaaatttggcttcaataagtccttgcattcatgacatcccatgaaacttatttcaaatttttcccatctttctccatgcctcactatccaccctgccatttccttattctattatggcttcccagaaccagaagccatcctctctacctactgtacatcctgctcatttctcaggactctcagagcttttatttctttatttcccctatcttcaaaacagaagagtctggtaggaaatcaatatcctatttaaaatggaggagtagacctggggaatggaaagacaaccaggcaaggaattatcgatggctgttgatcagcacatagaaggaaagggatcatgcattaacattttccctgccctggaataagtagcttagggcatagagaaagaaaacctttccattcctaatacatataccatagacatatcttcttccatgtaaatttctgatcatctaagggtataagaactgtggggaaaatgttttattggtatcaagtaactcatctctctaccattgaaataaaatattatattaaaagtaaaagaacaaattggttgtggtggctccttcttgaaatcacaacactttgggaggccgaggcaaggcagatcacttgagccttggagttggagaccagcttgggcaacatagcaaaattctgtctctacaaagaaaaaaaaatttagctgggcatggtggcatgtgcctgtagtcccagctacttgtgaagctgaggtgggagggtcacctgaagccaggcaggttgaggctgcagtgagccaagattgtaccagtgcattccagcctgcggaacagaatgagaccctgtcaaattaataaaataaaatagaataaataaataagtaaataaggtctatgaattggatatagtgctcttttctgcccctaaccaaggatgtagtgttggacaacttatcctttgcatttctattttctcttctctaaaatatgttgccttgtgaagatgaaatgtaataatgcaagtacagaacttagcatatttcctggcatatttgctcatgaaagagtggctatctattattatcagctattattattattattattattattactattttttgtctgttcctgggtccccaatataaaaggataagcatatgcagaaaaatacaagattccactatatactatgcagcagaaagtgtaggaagtgttagcttcatcatttaacattttaatacttgttataaacactcatctgtttcttgtgggttacattactattttgaatatcaaaaagaagttggctgggcgtgctggcttacatctgtaatcccagcactttgggaggccaaggcaggcagatcgcttgagttcaggagtttgagaccagcctgggcaacacggtgcaaccttgtctctacaaaaaaaaaaaaaaaaaattagccaggcatagtggtgtgtgtctgtactcgcagctacttgggagcctgagatgggaggatcaattgagcccaggaggttgaggctgcagtgagccatgattgcgccagtacacttcagcctgggtgacagagtgagaccctgtctcaaaaagaaaaagaaaaaagtttgtttttcttaagtctattggtataatcagtactccaaactatttatattaagatatatattgtcaccaaaaaagtataatatatacattcatcccagcccctaataactcttcccattataggctttcaaaacaacttacattgtatagtacatacttggtattaacttgcccatctgaattgcattttaaaatatattttaggcgttggttatgtatgccctttgaacctgactgctacacctcagaatcttagctatactcatagaaaggattttcatacgtgagactacactgagcgatgtgaattgtgaaatctgtagaaaaaagatataaggcagaattcctgtagctaagttttctctcctgctgttctgtagagcatgctcaatgaccgattgctgagcatctgcctctcttttctccatggttgtgcacacacttgctgttgctaggcagaggcaatatggatcacagaatccctaatgctctaccccagccccctcctagggaccaaacctttcagtgcctgccactctgtaatggcagaagcaaatgcctattcagtacttttcagactggctcaggaacctatgacaagtcattaggcatttaatttaacactaggcttttagaccctggaattcaatccccatgagtttctttacagctaattaagttacatgtaataactgtcttctaattcctaactgaaagtgtttttttcccccacagttaaatttgaaattgtgtgtgtccaaaacatcgtataaatttgtccttttaaacaacactgttcaagaagtaacaagtgtgtcttataaaacataaaacagcaaattgtagtttcaaattagatataaaaacttgtatttgatactgctttaaataaatatttttaaattttattttcaaggaagtgtactcttctaattcacctgagaaaatgtacataagcagctctttatgatgcagctttcatttggcaaaaacaagaatcaaaaacattaggctaatgataatatctttgataaactacattgtgtattggataccttcccttggccctcaaatgaattgtttttcagcataaaacgggtacttctgactctgatgattgacaagaaagtgctagcaataagatcatcaggtttccattattcagatacaatcatgtagtttgtcaatgatggagaaggctttctcttgtttctgttgtacaaatgttcacatctatacttcaaggttattttctcttaggccattatttagtgactgatattttctctgtcattcatcacaaaacaccagaattgccagcttttagagttgcggccttaacagcttattccattcaatatatttcctggaaaaatacagaaagccaatagattgtcttttggaagtttatgaaactgaaacgttatagttcgcaagaaacttttgttgattttgagatataaacttctgcttgagttctcataaattatgcatgtgagagggaatgtttttacttattcctcaccctattagacatagtcataatttttctaaatagaggttaattattttatgtttgaatttttagaaacaaaagacacacagtaaaactctctaggattgataatgcctgtgctataatttggcagttcatgatgctgaagctgaattctgaagctgtgtgtttacaaatggcttctaggtggcatagaacagggaaagcgatcacatagctctgtggtttttgtttcacaccctattccctttctcctttggagtgttagggaacacggagtggcatgccctctgcatgcacagaaggagcaaactaagcccatcctccatggttccttgctagctcccttcttgtctgtaaatgcttgctggaaaaaaaaattctacacaacactgatacagtgttaaatgatggacattgttgttatttttctccatgcccttatctatgaacagtgattttcccaggcagctccgggacatgtagccctgaaacctctttttacccttttcttgattctcctctttttatcttattaattgccaattaataactgtacttattcctggggcacatagtgatgttttgatacatagaatgtatagtgatcagctcaggctaattagcatatccatcatctcaaacacgtggtccttctctttgaccactggggtgaagctggaaatcttgctggcagctaagacagagagcacatgaggaggctagcagaggggattggagctcccaccacagagatcttctctctgtctctaaacgcaattccataaaaggtgaatttttggtgccaaagactaagaatggcaaaatgagaacacagcaagccctaggccaagttcaaatttctttcagaagtttcctaaaacctggaattttgctcttgcttagataataaaatgagatttccaagagccaccttattgaagcccaggaaaatatttctaactttgagattttatgggagactttcctaaaaataaaacaccttaattgagtttcagtggaaaaataggatttattcagacaaagaagttagaaaaggtatatggggaagaaatactctgtgcagattcatggaggcaaagaagagcatggaacatggaggcacattcagtgacctttctgtcctcattccaaacccgtggcctctaccctcattttatctctgctgggcaagtgtgaatggctcctctgttgggtctcagctcatattatcaccttctcagtgaagacttccagaacacttgatctcattggtatccttttctcctacctattattcccttttatatcacaattttattatctttgcaacctttataaaaatccaaaataattttatttgtgtgtttatttattgtctatcgtcctccacccgtatctaagtgtcaccttatctgatttgattattagtgcagtttcaatccctgaaacagtgcttagaatatagtaagtgcaaaataaatgatcataaatccgggtgggcagaagctgaaattaggaaaaaacacaaagactaggtcataaagacctaggatcgtcaataccaaggaacctagttgttataaaatgctgtgatatttaatcatgattaaatatgtagatcaatattatctttattattttttgaaactcctattcttcaaagaagaactcattgtctttctctttaagtctggtccttctatcatctctgttaaagtaggaggcactcccggttattcatgttagaaatctgagtcatccttgattattttatatccatcatctccaaaagcttgatgggatagattagagataaatgcaaattgagaggtgctggctaatttcccttctcttgaatcagagcctgccttggctacctgcatgacccatagaatgcaacagaagtgactttattcttaggctcgctgttttttgggactgggtctcactctgtcatgcaagctggagcgcattggtgctgtcttggttcattacaacctctgtctcctgggctcaagtgatcttcccacctcagcctcccaggtagctggaaccacaggtacatgcaaccacacggggctaatttttgaatcttttgtaaagacaaggttttgccatgttgcccaggctggcctgaaactcctgagctcaagcaatccacccaccttggcatcccaaaatgttgggattacaggattgctttgattatttgggcattttgttttgttttgttttgtttttcatttcctatgaattttacaattgctttttctaattttgtgaaaaatgacattggtagttgaatccgtagttgcttcaggcagtaagatcatttttaattatattaattttgatctgtgagcatggcacgtttctccatttgtttatgtcatctactatttctttcatcagtgcttggtagttttccttgtaaagatctttcacctccatggttaaatatattcttaggtattttttcttgtaccttttgtaaatgaaattgccttcttgattttgttctcagctagattgttatcagcatgtagaagcgctactgatttttgtacattggctttgtatatactgaaactttgttgaattcatttattcaaatctaagagttttttgtgaagcctttatggttttctagctgtaagacatgtcgtcgttgaacagggttaattttacttcttcttttccagtttggatactttttatttttttcttttgcctaattgctcttactagtacttccagtactgtgttgaataggaggggtaaaagtggcacccttgtcttgttttagttcttaacaggaatgctgtcaacttttcccaacttattatctcattgtttcattggtttgaaataaaacaattacctctgactagatcctactctttcttcatgatgttaaaactgggtcttaataaatttcccctcatttatcaggttagactggttctctctcttctatatatagagcatgtacatttaccacattatgttataattaattgttttaggtctctccccttcatgagactctgagctccttgaatccaagaactgaaatctttatttattttgctatctttagcaactacaatggcactggtacattaggtatgagctcaatacatgtttgtggaattaatgctacattgttttttcttcaagtcaaacaacccatttgtataataccttgatggcagttcttctaagagattttatgttgaggaataacttgaccattggtgaggaaaaaataacaaagcttcacatataatttttgttgactgccttctatgcatacaatgaaggtaaatgctatatggggaaagaaaaaagaaatagtagctagctcctttggaggtggggaaagggacgtactacttcgataatatttaggcaaacatatacaaaataaaatcattttgtttgattttaactattttaatgaaaggaatatttgacataaaacttgataaaacaatttaaataatattgattgattgcatttcatttttatctcttatacagtttgacattcatctggtccaacaaatatttccaaaaatattattcacatagcactgattgtgtgattaaagttcaaatgcctaggaagctgtactagttattaaaatataacagatattgttgtattgaagcattttaatttttttaatgtattttttcatcttttatcattttggttttacttatgttttatcatttcttcattgactattgttgccaatatgtctctgtctagcactttaaactctagaggaagagttttaattttcacagcttcttgtgttaagaaaaaattattaatatctcaggaaataaaagcagcatcagtctttgatgcctctgtgtgctgactgtgtgaattgagtgttttagaatcttggccatccgttttcagaaaagacaatgaatgaatatgtaagaaagtctgtcatccaaggagattggggataaaattagtgctaataatagattatttcgaacagctaaattgtaagtgccaacattttcttgcttgtaatgtaataaattctgatgaaaatcatttggctaaaaatctaacatgttgtgtattatctcatttttatacaaaatataatatatagaattttttttcttaataactcagaacttcagaatagaccccagttattatactttgacatctggttgtaagtttaggatttttaaacactcatattaatagcatttttggcctgtatgaaaattatggcagaaatctttttatagttttgaagtcttgtccctcactatttgcctctacttgctaatgtcaaagaagctgccattttataggtacttattctgatcaattttcgactgggcaacctgaaaactactccaggctgaagtgtgggaaaatcaaagtaaaaattctctaagtaagaatgtgggaattagtttagaaatacaatgcatatttaatgcctgaatactgtggcatttattttaatatcttggagaccttgttttactttcttaagcttcagagagatcaaggttgcctaccaacttatatgtgagtatttaaaatgaatctgtgtgtgtgtgtgtatgtgtgtacaaagagctttgataatataaatggaaatgttcagactcttgaaaattaaagtataattaatataaacaatgaagaactacttctctggagttataggaaatttacagaaaagacagttaatttaaccaaacatttaatttttttggaaattatcaacataggaattcatgagggaagtgctgctaacatttactgaataatttaattataaacaaaacataacagcagggttttcaagctcttgaaaaagtattattatgtgatacttatcatatataaaagaaaatacgtgatatatatatatgtaagtaataaagcataataataaacaacctccccatccctgaaactacctcctgaggtaaaaatatactaatgtgttttttaaaataggcctaatctgctacatttttagagatccattgcattttcaaaatataagacctttctcactttaatgttttcgctggaaacctgaatagtcacaggggattagccagctgtctttctctgtcgtagtctttctgagtggccagcctctgactactgtgctttgttttgttctgtttttaatttttctattctggtgaaatacaaatataaaatttactatcttaaccattttgtgtgtgtagttgagtggcattaattgcattcataccgtgcaaccatcactacgatccactctagaactgcttccatcttccaaaactggaaggaaggggaaatgaggagttagtgtttaatgaatatagatattcagtctctggcatccaccattccagtttctgcctttataattttgactaattacctcataaaaatggaattatatatttgcctttgtctgattggcttatttcacttagcctaatgtcctcaaagttcatctgtgttgttacaaatgccagatttttccttcctttttaatgctaaacaatattccattgtatgtatttaccacatttgcctatccagtcatccactgaaggacacttgggttggttacttccatatttcagctatggtgatcatactgctatagaaatgagaatacaaatattcttcaacaccctactttcaattcttttgggcatacccccagaagtggaaattctgaatcatatagtaattgtatttttttaatttttgagaaacctccacaagtgtttttcacagtggctttaccattttacattcccaccaacactgcatgagggttcccatttctccacatcctcacctacaattgttatcatctgtttttgtaaacagtggccatcctaacgagtgtgagggtgcatctcattgtagttttgatatgcatttccctcatgagcaatgatgtcgagcctctttgcaagtgcttattggctgttggtatatcttctttggaaaaacatctacacaggttctttgcccattttcttttttcacctgtgtgtttggtgttagatctaaaaattattgccaagtccaatatcgtgaagtttatgttctacttatttttctaagagttggagagttttaggtctatgtttaggtctttgattcattttgagttaatttttggtatggcaagggtccaacttcattcttatttatgtgtatattcagttttcccagcaccatttgttgaaaaaactttcttttcccctattgaatggtcttggcaccatcatcagaaacaatttgatcacatatgtgagggctcatttctaggctctcaactatttcactggtgattatgtctggttttttttgccagtgctaatgttttcattacagtaacttagcaataagttttgaaatcaggaagtatgagacctcaagctttgttcttctttatcaagattattttggctctcagggtcccttgagattccatatggattttaggatagattttctatttctacaaaaaatatcactgggctttgtatagggattgtgttgagtctgtaaattgctttgggtagtattgacctcttaatactattaagtcttccaatccatgaatgtgggacatctttcaatttatgcatgtcttctttaatttcctccaccaatgtttcatagttttcattgtataggtttttacatccatggttaaggtaattcctacatattttatactttttgatttttttataaattgaatttccttaatttccttttaaaattactctttgattatatatagaaatgtaacttatttttgtgagttgactttgtactctgctaccttgctgattttgtttattaattctaactattcttttgtggaatcttcagggttttctgcatataagactacaacatatgtaaacagataattttacttttttcttcctggtgttgactttttttttctttttcacataattgctctgtctagaacttccaatactatgttgaatagaagcagtgacagcaggcacctcgctttgttcctaatcttagagaaaaagcttttagtctttcaccattgagtatgatgtccattgttgatttttcatatgtggatttactttgttgcaagaatttccttccatgcctaatttgctgagtgtttttatcatgaaagggtattgaattttgtcaaataattttcctgaatcaattgagaaaatagtatgattttttaaattcattcagttaatatagtatattacattgattgattttatatgttgaaaaatcagcccattccaaaaataaatgccatttgataatgatagtcttggtaggttttgtgtttccaaaaatttgctcattttatttaagttatccaatctgttggcatgtgactgttcatattcctctcctataatcctttttctttctttagaattagtagtagtgttttcatttctgattttagtaaattgagtcttctctatttattttagtcagtctcactgaaagtttgtcaattttattgatcattttgaagaaccagctttttggtctcattgattgtctctgttttctattctctattttgtttatctctgctttcatcttatttcctttcttctgttagctttgtgcttgtcttttccaatttattaagttgtaaaaataaactttcaacttgagatctttctgttctttaatgtaagtatttataggcataaatttcccccttagctctgctatccttgtgtctcataaattttggtatgttgtatttttattttcattaatatttattttctaatttttcttgtctttcttctttgatccgttggttaaaagtacgttgtttaattttcacaaatttgtgatttttccattttgcttttcatattgacttccaacttcatcctcttgtgttcagaaaagatactttgtatgatatcaatatttttaaatttattaagaattaatttgtgacctaacacgtggtctaccctgaaaatgtcccatgttcactggagaaaaatgtgtattctgttattgttgggtagagtgctctgtatatgtctgttagatctaattggcttattgtgttgcccaggtcctctatttcattacttaaaggaagattattctgtctgctcttgagagagggtattgaagtctctaaatattattgtagaattttttacttctacctggaattctgtcaaaattgatatattttcatgaactatcatcaggtgtgtcaatgtttataataattatatcttcttgtaataaaccttttattaatatataatgttcttttttcaccttttttatttaaaatctattttgtctgatattagtattgccactctttctcccttttgttactattttcatgtcattgccttttttattctttcactttcaaactatttacgtgtttgaatttaaggtgagtctcttgtagaaagcatatagttgagccatgtcttattcattccgtcaattcctgtccgttgagttggagagtttcattcatttacatttaaagttattgctaataaaggatacttacttctgtcattttgccatttgtttttgtttacttcctgcattactatcttctttcatgtatagctgttttttgtaattaccttctcattttcttttgtgtatattccatagctattttctttgtggttaccatggggattacatttaatgttctaatgttataactttctaatttaaattcataccatcttaacttcaataacacacaaaaatacagtttctttttagctccatctccatgcttttcagtggttgatatcacaaaattatctttatacattatatatgaaatataatctaatgatttttaaaatgcatttgtctcttaaattatgtagaaaacaaaatgtggaattgtaaaacaaagtaataataatactaactttttttttttgggggggacggtgtctcactctgtcgcccaggctggagtgcagtggtacgatctcggctcactgcaacctccgcctcctgggttcaagtgattctcctacctcagccttccgagtagctgggacaacaggtgcccaccaccaagcctggtgaatttttatatttttagtagagaaggggtttcaccatattggccatgctggtctccaactcctgaccttgtgatccgcctgcctcagcctcccaaagtgctggaattacaggtgtgagctgccaatactaactttttagttatctacatactcacttttactgtgatctttattttctcatacagctttgtgctactgtctaatgtcctttcatttcaaactgcagaactcaatttagcatttcttgcagagctggtctagaatgtatttctccctcactttggaagtacagttttgccagatataggaatcttttttatccaaactgctttcttgaggtatgattgacatggacaaagctatatatacttaatgtatataactcaatgattgttggttgagttttttatttcagctccagaatttcttttttgtttcttttttaattttgtagtacattaactatatcagcttactgccttctggtatctaaagtttctgatgagaaatctgttgataatcttattcaggatttcttgtatgtaatgagtgtcttctttcatactgctttcaagattctctctttgcctttgtcttttgataattgtattataatgtgtcttggtgtggatctctttgagattataatacttggagctcattgagcttcttagatgtttatagtcatgcttttcatcaaatttggggaaatgttggccattatttcctcaaatattctctctgcctctttctctcttcttctgagcctccacaatgtatatattggtccacttgatggtgtctcacaggttctttagactctgttcatcttctttcattttttccctctgttcctcaaactagacaatttcaattgtcttatcttcaagttcactaattttttcttcagtccgcccaaatctgctttcgaatcgactgttttttcacttcagctctagaatttattttttgtttctttttttaaaaaattctttattgatacttcctttctgttcatacatagtttttgtgatttctcctttagttctttaagcaccttcaagacagatgttttaaagtctttgtttaaagtctttgttatcaagtatttctcagaaacaacttctattgatttacagttaacgttttctccatctataattcattcattcaggcattcaccaattcagcctttcaagtactcattaaataacaaattatttaacaagaaattattgactgcttcctatattctagagattctcaaattaacttgtttgaaaaagtgaagccacagttggaatcttgggccttgccaaaaagatgtgaaaggaccttttggaacaaatagaccaacactttttactcacaataatgttaccaactacttagattgttttacctaatatccttattatggatgtggaagattaaagcaaacaaaaaaaaccgcttatatagtgtctttctgatttcaggaaatatttgctaatccttcttccctagaacttcataattataataacaattcatcataatatgataatgtaaataatttagaattacagaatacctaactacaagctcaatatacacaattaaaatgatttaaaggcatgaaataataaaagttatagaccctttttaccatttctaattcattgctcaaagttgggaattattgttgaatgtattaggggaaatagtcccagatgttttcctgtgtacatctccaaaaccagatatctgcatccacgtgcacacaaaacatacctacacacttatgggcctacacattcactgacacacccacagttttaaattgtatatataaatgggattatgttatgtgtatggctgtgttatttattttttcctttgaaaaatatgtcttagagatttttaaaatatcaataattacatatttactttattattttgaagtgatatatggaattcataaataatgaatgaatcattatttataaaattaatccctaatttgcggacatttaagttttcccaatttttcctatcataaatgaggcttcagttaactttcttgtaaaagaatctttgcatttataagccagtttgtctgcaggatagatttttagaaaggaatagttccatcaatataggtatgttttataaaattttatagttctaattttttccgtattaaaaagataacagccaggtgtggtggctcacacctgtaatcccagtgctttgggagcccgagacaggaggatcacttgagtttaggagttcaagaccagcctgggcaacacagcaagacctcatcttctctacaaaggaatttttaaaaattagctgggcatcgtagtgtgtgcctgtagttccagctactcagaaggctgaggcagaggattgcttaagctcaagaagtcaaagctgcagtgagctgtgatagcaccactgtactccatctgggcaacagagtgactctgtcaaaaaaacaaaacaaaaaaacaataatttgcatctccaccaacagtgggtatcaatagtatcaatttttcttcacatctgtcagcatagtaccattctttttaaattttaccaatctaataaggggaacaaaatattagcttaatgaataacatatatatttttttcattagccatttggagttttgcgttttttgtatgattatatcttgtctatttttctattggattaggtgtttattctcattgttttgtagacaacccttatagagtatgaatatcaatgctttgtttacatattgtagattttttgtatgttttttgtctgggcgtacaacattttacacttttctgtgttaatcatatgcttttgttattttaaaatatctcccttttttataaagggcctccctaaggacaagattataaagatgttctcctatatttccccatgtgtgtgcatgtgtgcatttgcgtgtttatatgtttgaagagagagagaatctggccactgtgtatttttatgggactcatttggtactaactcagtgtcgtagctcccattaagtactagtcaacacttcctccccacccgctgtatgagctatcccttctgtgtacacctatattaccttgtgcttatccttgtgattccccatccaaatatttcacatatactgatttggatttttactccctcagtgtgagattctcgagtattgggattctatcttagtcatgttcatcttttttttttcatgcaataattgcaataatagtaagtgtttatttactaattaacattagagctgataaaaataaaattgaaacaatagttgttacttgatcttaattaatgtatttatcgcttatgtgtagaaataaactacatattttgaaacctaaatgctacttccctatttccttggttactttctgaaacaaatagaaacatcttgtgtatgaaaacattatagaaaacaaggtatttgatggccctgagagttaaaacttaaaaataatccaagtgtttgttcttctagtgtgatgttaaaaagactgaccattcaacaactgtttggattaagtggacctttcaaatacctcataagggatgtttaccagtacggagtcagtgagcacaagaaatttgaatgctctgattacatccaatttaacctaatcaagccttttttgccctgccaaattatgtaattaatcgagccagtggtggaagaaggttattttaaaaacttttcatatgtgattgatttgactccagtgtgtccaagcattgaacacccaggctgattgggctgatgtggctagatagtcagggaagagtaaaatataatagagagaatcccaacagcaaaactcacctgggtctaaatcacttatctgagagttactactgtgtaactttaaacaaagtatttaaccttcctcagtctctagttccttacctgtgaaatagacattttattcttaccttttacatatctccatatactccttctgaaattgttatatcaaagaagttaatccataatcttctacaatatctgaataaatgctaataatggtaattcttgaataagattttttgtgcctgaggagggatgaattaaaataggccacaggtgtggtggctcacacctgtcatctcagcattttgggaggccaaggtgggaggatcacatgagcccaggatttcaagaccagtctgagtagcatagcgaaactccatgtgtatacccataaaaatatttttaaagtaaaaaaataaataaaatcgcctataaatcaccttactcttacagtaggagattgaaatataaaatgagaaaataaaatttatttaaataaaattcactggaaaagtctgtattctaagttatttataaatgaatcagtttaaagataaagttaaacaatcttcgaacatttagtttcacttttcaaaggcaaaattacaaggtttgcaatgttcagccaaatctacctatctgattggctcctcattctaaactgctttataatgttcatggatacatagtagggccaagagcaatgggtagaaacacctttgcaatattctactaaaaatggcatagtataaaccctaagatagcctctttgaaagccctaaattttaacattagtgctgaaatatattttgaatgccacttcacaacatcccttgggaataattttattaacaatcttttgcatttcaataaatgacttactggacaagtgttttgaaattaaaaatataataaataataaaataaattgagcttactactatatttgctaacttttccaagacattattgaaggaaataaagaaactagagggtttcttttttcaatgttctttagcagtggacaactattttctaaataagcacttatgaaaaatgggaagatgcagcctgtaaatgaacaaggtccttctcctttcttttctaactattcataggctgacttttgggaagctttgtgtatagtctgtgaggttatgaagaagcagctatttgtttggaatgtgtctcctaatagttcttttcttcaaattcttccaagtactcataataaatattttgccaggcagtggcaaacatttttacaccagcctatgagtctgttgtgtaaatcactgacacaccatgtgtttagagattagactgcaccaattgttaagttgcataaatatcctgagctgtgtctctgtatattattaaataagtgtatccctaaagaattgaaaatgaagtatattcagaatgtacccaagtgaaactcctgttaacaaaataggaaataggtgttcaaatgaaaaatgaaaaataaatatactcctgagtaaaacttgtataacagtacaagtgcaaaagattagttttgccaatatttaggtgtatctgtcattatctgaggtattgagaaataaatatttatttgtaaaacacttaaatactgattattttagtataaaataaaatgactatttaaatccatcctcactagataattcagaacaccagaaacacagaaaagttcagaacgcagaaaaaatgattctaggaaaaagcaaaataatactactactactaataataacctcattgctcggtttctcatgtccaaaacaacggacagacttaggcgtcccattactaggaatggcaagtatctggcattctctttcgttctaggatctgccctagatagctataccttttcaccttatattttagtggttgctttcagaatttcaatgtatacattaattagttttctcttgctgctgtaacagatttttgcatagtggctcaaagcaacacaactttattattttatagggcaatatgtcaaaaatatgatgcaagtctcactgagctaaaattgagatcttggcgtggttgcattccttctggaagctcagaggataatcattttccttgatcttcccatcttttcctcttcctccatctttaaagccagcaatagtagcaggttgagtccttctcagcagcatcaccttagcctcctgctgcctccttcttccatcttttaagaacacttctgactacaccgagcccacttagataatccagaataatttttctgttagaaatgttttaacatttctaaaacagaataatgttttaacattaaaacatattttaatgttagctgattagcaaccttaattccatctgcaaccttcattcctgcttgccatgtaacatagcatatccacatggacatctttggagggagggcattattctgtctgccacaataccctcaatttttcacaatctacttggagtttatattgtatacctcatgcaatatgtagaagctttgccacagaaaaggcccatttaccccacattgctgttctttatgctgtagttgacatatacattccatacattataaacatcacaagacagtgtcttaatttttgctttacacattggtatgcttatttttcaaataatagaaaaaatgatcttttatatacctatttgccttttctaatgttcttcattccttactgatttgagttttttttccagtatcatttcctttaaaccagaagaatcctctttagcatgtcttgtagtacatgtctgttggcaacaaatatttttagtgttcttttatctcataatgtctttgttttaccttcatttttttctttttataagacatggtctcactctgtcacccaggctggagtgcagtggcatgatcccggctcactgcagcctcaacctcccagactcaggtgattctcccacctcagcctccaacgtagctgagactataggcatgtaccacttatctccattcttgaagaatgttttcattcagtataaaattctggattgacagttttttgtctttcgtagtcagcattttaaagatactgccccattcccttctgggctctatatttctgatgaaatgtcagcaataattttaattggtgttctcctgcatataatatgccatttttctcagactgcttttaagatttttttttcttttttgttgttttagaagtttgactataatgtgttgtggcatagttttcttcattgttattctgtttgaggttttcctgagcttcttgattccgtaaatttatgtatttcaacaatttggaggaaactttatgccattatctcctcaaatattcttttcctgactcattctctttctgttattcttctgagacttcaaatacaccttttgatattatcccatggatacttaaggttctattagcttattttaatatttccttctcttttttccttagattggataatttctcttgatttgtgtttggcttgtcttactctttcctctgtcatatctattctgctgttaagctcattcagtaatatttttatattttaggtattttattttcagttctgaactttccactttgctgttttataatttctatttctctgctgagatttcttatgttttcatttattattaccatattttttcatttgccatcttgagcttagttataataactaaagtctatgtctgctaaatccattatctgggtcatctcagggtcagtcttcattgattgtcttttctcttgagaatggatcacattttcctgcttctttctagaaggagaaattttgcattgtatcttggatgctgtaagttgttgtggagactctagattctgttataatcatttcaagttttgtctgtttgtgtgtatgtgcgtgtgtgcgttttgtagtttaaagtcagtatacttaaaatctcagttcagtacttctctaaatcccctttacctagactgtctgcagtctgccctacgtatgcatggctcaggattctgcagagaatttgggaatcttttttctgactccctcttttatggaattctctcttcattttctagcagttgtggttgccctgaatactgtcatatatttttgtaggccattattattcatattttcagagttcttgccactccacaatgtaccacagtggtagcctgccctcaggctactagctatatacaagcaaacaaataagtaaataagaaactcattggcctggtcctttcttccaagtttttactgtcttccagaatctgcctgtttttattcatttttataattaaaggttagtttttcattgtgttttcttcaaagttatagctgttcttttcgggggggttggtctatatgttagttccctagggcttccataagaaggtaccccttactgggtagcttaagcaacagaaatttattttctcacaactctagaggctagaagactgagagcaacacatagagagggttggattttcctgagacctctctccttggcttgaatataactctcttctttctgcatttacacctggtcttccctctatatttcattttaacttaattacctctttaaagactttatctctaaatactgtcacactctaaggttctggggttaggacttcaacatactaatcttgggtagaggacacaattgagaccataacagctcataaagaaatgtttcagccacaccacagctgacagagattcagacaggctactccctttcagtatacattctagacccacgttgctaataaactcatgttggtgtgtaaaatacaacctatgtccattcctcttcctactattaagtagccaatagcatttaaaatgtagacttaaaatctgtatgtttctaatgtagaaatagtcctctattctaaaactattttctgatatcgtcatctattagctgttcactctgtgaaaagcttcagtataaatctctaaatcaatataattcactgagaattatatcattaaatttttgaaaattgttcttgaaactgattttctcccttataactccctgtaaaatgttgtgaatatgaagtattgtcatggaaataagttactatcttctgggcagcctcacttctgatgtttttgttttccacctacttgtgttattacacacttactctaggtcgccagatcaaagagtgtgcgtttggttatataaacatgtattcagtctatgatattttaccaccgtccccaccagacttctctcttagtctcctatatcaaacatgataaaaaaacactttaagaactcagacgtacacaagagaagcagctatgaggaaaataaactcacaaaggacaatttaaaaataaaaatgtttttttccagcttcctagtttaaaaataccatgctcgttgagacttgtaacgattaaaaatagcccttgagtagagagagtgcgtggttttttttaagatctgtttatctgaaattttatgttaaaaatatttaagaatcaacattcatattttagcagtaatgtcttttatgtcctcagaatgacctcccctcccaccacatacacaaagtactaaccacttcctcaagatactatgtaggttcagagttcaactttattttgaaaaagaataactcagcctagaagttttcttatacaaaacttgactagatactcaaagccagtgctctcttcatgagctaccccgtattggcaaatgtatggtaaagaaacctttgctaatgaacagttggtatgaaatagaagtgcaaattcaagtgagtagttttaaaattaatgtacttataattttaggattcaaaattctcctctaacagaaggtacctcatctttaatgaatttattcgtctccttacttgtaattcccgtatattttagtacttagaatttttttgtaccttgaagggtaaggtgattgccaaagcattattccatctaagaaactatgcaggaagtcacaccaacaacacataacaaattaagatatgttttaaacaatattttctcttggcttttgatttgcagcaaggagaaaaaaaagttttcatgtttctcttagtctgtaaaaatacaaacactcaaaaacaacatattacattctaacaaagttttatcaggtcttgaggctcttaaaaaggacatgcaaaatgcctatgtgtacgccttggctcctaaaatggagtggggcactgaggcacattcccacggttcctctgagtcacttcgctgtatctgtcataggttggcagggataattcctagcaagcaattcaaacctccatatacagttacaagaggagagagatagacaatttttaatataggccaattctggataatgaccaagatcacatttcaactggtagatttcgcaagtgtcttatctgacaaaacagcctatgatgttatgatctagtgagtaataattccttatgaggtcggatgcggtgtccagaaaaagcaacatatgattaaagtttgtgaacccacttatctcactgtagttgcaagtagatacagcaatatttcaaattgttttaagctgtgtaatgtcctcaatgcaaatatgtgcattgggatgggacggcaggaagaaggaaagaactaataatatttttgcacctggtactgtaataagctcttcacatcctttatctcatttgattcttccccaaaaggcaactatttttataatctgcattttaaagacagatctttctggctctggagtctggacacttcatataatacatgctttttctgtaaaatagaaaattctcttattcatttactaccattcaacctatgcaaagatgcattactttgttgatttccttgatttcctacaggtctatatgttgacatagagatatgcatatctggcctgcaaatggcattgtgctcttggctttggcaatatcacgtggctcatactataccttccagccatatccagcctaagatacaaggaataagaaaggtggacaagtctggaaggtggtcctagacaagtgctttcagctctctttagaccatgaaactcctgcaaattattgggatcactctgaactattctaggagaggtgcaataagtatctcattgctttcatcaatttatttatgcacacacatatgcatacatgcctttattcttcattaaacaaatattgtttgtgtacctatacgtattaggaattgttaggctttggtaatgctgaggtgaataagtagagttcttgcccttgtgtaactagcagtctagtgggagagattataaaaaataatggctcaaattaaagtactagtgcagtctttgaaaagcattatgaagaaggatatatggagcaatgtaacaatgccagagggaatctgaactaggaaactgactgaataggaggaaaaaagaagtaaaggagcggtgagggattacaaatagtagacaaagggagcatcatgtggggtgatactttgatggcagaaatcagtgtggctggagcacagagagcaaggctagtgggtgagctaaccctaaagagtagtaggcagaggtgagattgggcgtgtcctctttaagaattttagtttttatcctaaatgctaaaagcagcttttaaaagattttatgcagctatgtgtcatgattaaatgtgtgattttgaaaagatcagtttagatgttgtgtttagaatagagtggggcaagtaactgaaatatgtcagataagaaataggcccagcacagtggcttacgcctgtaatcccagcgctttgggaggccaaggtggatggatcacctgaggtcaggagttcgagaccagtcttgtgaacgtggtgaaaccctgtctctactgaaaatacaaaaattagccgggcatggtggcacatgactgtagtcccagccactcaggaggctgaggcaggagaatcgtttgaacccaggaggcagaggttgcagtgagccaagatcacaccactgcactccagcctgggcgacagagtaagacaaaaaaaagagagagaaaagaaaggaaagagagagagcgaaagagaaaaaaaagaaaagaaaagaaagggagaaagggagggagggaaggaaggaaggagggaaggaaggaaggaagcaagcttgggtgcagtaataaaagcagagagagaaatggaggattcaggaaaagtcgtggagtaaaggaagggaatgcatagggataaacctaggcaattcctatataaaagttgaaatagaaacaaagaatgcacagattcctcctaaaaatatagccacttcttggtcactatgtgtatgacctcttcttcctggactcacctctcttatagcagagaacattgatttattaatccttaggatcagtaagtgattcctctacttgaccctctagaataaaaactaaactgcaaaacaaaacatccatgggttttttgagggaggtgggagtccaccttctccttttcttttccattatgtatgttcagatcactatacctgatcctatgtaaaattactcttcttcctcagttttttaagactgaaacgttcttttagtccctttataaaacaccaagtaagacatggaagacagacagtggaaacagctatctttctttgaagggactatgttggttattcagataatgagaaactgtctacaacaatcccagggactccataagattaaaagaaagaaaagaaaagttgttaaataaagagccagtactttataactgaaagtttagcttttatttcaggcaatctttagaggttgattaaaccaggattacttgtttaatgccttttattatctagataaaagaatgtaaaatggtacgtggtcatgtaagtaatacagttcctttgcaaattctgtaactactgacttggaattgtagttatataatctttaaatcattttggggttgacttaatcccaaaactcttctccctcacccaggaaggcccaatcaataccacatctataaggagctaactctgcttctgctgctagttttgtgtccctggaaattcacctggcttccatggtcgtcagattcctggttgaaaaaacaaaaggttgaaaaatgaaatgcttgatgatttttgaagtgccttatacctctaactttctaagaacaacaaatcttagttagcctgacatagagggtgcttgtgtgagcatgcatgtgttttgtctgttcaacttttttcagtcatgtgcatcttcaatgttggaagtaaacctcatgcatttctttctcttttgaggaacaaatacaaatgcacaataagcaactcatttgcagtgttaagatctcaggcacatgagatatttgctaatatgcaggttgtatctttggcccccctgacatctatttcagcctctcacccttctctagacatgctttttccaggtcattaagttttacaaagctcctttggcagaacctctctcaagccaatccattagtgaaatgctcccacataaaaactgaccaattctcccatgctcttgaggataatattagcaaggggcaaagtaatctgatttcctattcaaaaatatgctatacagaaacgttactgactgataagctgaactacttcagtcctatctacttttcaagataggaactattaacaccagtgatcgctcactgatagcgtgacaatgaaaaaatgcatgggactaggtatcattgcctaggcagggctatctgcttccaaagtccatcctaggaacagaaatcggtgactggacatcccatttctaaagtcttggagatctccgttattgaatcttcttttagcactataaaaggggctctataagtgggagagaggaatgcaaatcccctgtactatgtagcattgggtaatagtgaaaagcagtgtggggatcatcagttgactgcccacttgtcaatctttggagagaaaggcaatcaaggacataaccacaatccctatcttctggaatagacctgttgagggttcttttgaaatttctaaagatatccatcatctatgactttaacaacacttggactgccttttccaatatcgtagccactagccacatgaggcatttaagcactcaaaatatagtttgtcaaaatggaaatatgctgaaagcgtaaaatgcacacgagatttcaaaggcttggtacaaaaaagaaaggaaaagaatgcaaaatatctcattaataaatgtttatattgcttatatcctactatgaaataattttagatatgttaaatgccattattaaaattaattattaaaattaattttacctatttctactttcttttctgaaatatgtctattagaacattttaaattgcaaatatggctcacgttttattttgggggacagcactgtaccagacttatacattaaatgtctatagtttactggtcaaggcaaacaagccaagtattaaaataaaaaattatgtaaagaaatatagaaagatattcactttaaatctctttacagattactgtatttttttcttagatatctttgctatatcttacagagacttatatcttgaatggtagtgaaaataattaaagtgaacttcaaatttattcacattttggtgattcatttattctgggagcacagggaataaaactttaaatgtaacagaattcaggaatctttaaactggaatcatggatttgtttattccattattaattaataaattacttcacattgaatacagttaagatctaattgtcacaatatttgtatcatacttaacaattttcaaagtactatcattgcttataccataaacccttagaaaatgttgcagagaagttctgtttgaaataaccatttctatgatcatctatttaatatgatgttaaaataattcatggaatatattatctttaaactctgttccaaaaagttatttgtgaatttgtacaatgcaaacaaaaggaagcttcaaaatgggcagcaataatagacctctagtataaaaacacaaatattttaagcaaaaggtatgtagtactattttatctaaacacattctgcgtgaccttttagatcattgacttaagaattaatatattcacaacagtagactttgttttgtggttactttgtgaagaagattttttaatgaagtttcattttaaagtacaaaatcagcctttgcctggtataagagagaataactaattacaaattatacagcatcatataggccccagaagcttatttctcaattaccttcatataaaagcaatagtctatctttccattcaaaaaataattgctttcattcacttttttccctttcctaattgaaaatctgtaactgataaaatccatggccagatatctctagtcatacagattttataccttagagacaagacagattcaagacccataaagaagatcatcagctaacatttttttgaacagaataagggacaaataatgtgtttggaagtagaaagtatgtatttagtaatgtattttgccaggaaacagtcatgtgttactttatattaatattcctaagctgtgtctttctctttgatgtgaaaaccaataatttccataccaaacttacaaaatgcattcaaccatagctgaaaaataggaatgagataatctcatgaagtactttttctgtgtggtgtaggtaataacaccctcttaaaatctgaaaaatttaaataaacaactctttttaaaaggaaggagtagcaaccaaaaataaataaataaacaaagttttgtgcattcctctatttactttatccttcaaactctgtgtattaaaacagagccacagccaacatttattttgtttatacttcaagtcttatgcttaagccggggatcattgattaatctcttaatgtttacctaaaccaagagagtagaagtctgacaatccattaagggttagaaattagtaattaatttgcagcagaattaaagcaaacagttctttttctatatttcatgatcatgtttatttgctgagaaaataatattcttcctaatgcttcagatagactatttaagccagtactataatgtgctgtatatctttgacttctttgacaaagaatatcttattgcttatttgtctttcttttgtcatctgtcctatgtataggcacagcctctccttccatgatatgcagcaatcttaaagccataaaataacacaggcacaattttgataacagtaggtaaaatttgtttctctgctgttactattcatatgtttattcatttattctaaaaaaattttcaaaaatattccttgtaccagaaattctgaatggaattttagatgcagagataaataatatcaaattggtatgcgagtttgcagagataaatatgtaaatagctataatgttttatattatagttgatcccatgatacatgcacatataaagaaaacccatcactgtgaagggtgtttcaggaaggctttttcagaatgagagccactggacagagaataaagtagagtggtgattggactggttaaataaggaagagaaagtgttggggaaaagggactactggagttttgaatgtgtgcatgaaggaggaaaggtgagtaatgaaagaggatgtgatttatcattccctatttgtttcaaatataaaattgtgcccttcccattaaattagtcattctacaattattgttgattatcagtactgttattgttaaatattaattctgtactcttcactattacagcaaaatattttatgcttggttaatatccttccaatgtgaattacacttcctcatgatgttttggattttcttaaaatccaggtattgaacagaaatctgaatgctgacaacatttagtaccagaagttatcattacctcttagataatgagttcccattcctcaactcaaaacatattctcagtctaaataccagactatttttaaggctgatactgcagtgatatagtgaagaactgccttaaatgtgactcctcaagttcatccccagtgtttttctgcctccacactctcctagggtggaaaactttgtcttctacttagcttcagttagaggtggatatttccttctctgggaagacctataaattgtacagatatgacagaagattattgtggtaaaaataaaataaagagagtatgtaaatctcaggcaagtatgtcataaatgatcctctagtcctttctaaatgagaaacccatcttcaacctgccgagaaggtagagattagttagatgttgtttatgtatacggagaaggaaaaaggaagtatctgacactttctggaacttttactttttactttcaactagtggaatacatgacttactagaaattaagatttttaacttaaattatatatatacatatatagttatatatgtatatataaactatatatataatttaagaatatgtgtgtgtatgtgtgtgtgtatatatatacataattttagaccattgcccactgttcttaaattctaagggtagatatgaaaacattccctattgtgacttttgaattcctttgcgatcagggaactaggtgcctacagaaatgtccaagaatatatatcattgtcttcctgaaattagggaaggaaaaaatgttcacattgtcttcaactttcaacaatgttttgggtaaagtaaatttatcctgacagaaatataagtaaatattttgactacatttagcatatgtatgatgcaccaaaaattgcattgtaaagtttggaggtggttaaatagttactcacatttggcaataatatgtctagatgaaatgaagcagataggttctgcttgctatcaaatggactttccagcactagagaagagcttagcaagaaattcttgagcatttttaaatctccttatagcttttacttatttccacagaaaatctagctacaaaaagaaaagaggcactttgtttaattaggattatgtttattattgctaagattttaattctatttactatcaagtatggaggcctattttctgtttgaaccaagaaatacaatctctattttaggagagaaagagtgctggcgttgaagctggaagacatgaggactgttaacttttcctcctcccccagtcagtaaaggtcaggagactcagatcaaagaggtccaagaagatgtccaaagtgaaaaggcacagttccttcagttttgggacctacatctctggctttcactgtcttttatcatttcttaagtgaaaatgaaagagtaagatgaatcagttagctgtaattttgtacgaattctttcatctcctaatcacaccattcctagctaatataaggagttctagaagcatagtcttggttccactgcaaagaaagtagatatgaaattttgggtatcccagaattgcaagaggattaagagtcactggattactgtctataggactgcctgaatcatattgcagtagttatggtggtggtaggaaggagttggaatggatattagtactgacataggaaactgtaaaactgaactttttctatataagaggcttatttttagaatttgccttggactttgtaatcagattgtatatacgtaactaactactaaacactctgttcatgtcttgtgactgtgacatttaaagataattattgaaagccttttagagacagtccctaaattacaaacagattgtattacagaagtttataacttagtgaaatggagtttgagggtatatttacatcttggaacagagtgatactgaatattgaagtttcctactcaaaacatacaagttgctttagtctattcatatatgttctatggtatatgttcatgacagcacaagagaataaaactttgaatctacttttgcaatgtttcaaattttatatgagtagtgaataatactcgatagagactaaggattataaaaatgatagttcttatatgtgtatttttaacatcaatattttcctgcacaagtcgaatgttgatatttcttcccaatgtttagacatcattaatagaattattcaaggacacagattctttaatattggcttgtcctttttttagaaacttcattttttcattagacatgcatatgtctgtttacacaagaaaagcaaggtgaggaaaaatatcattattatattttaaatagtatcaagagaattgaagaatattgaataccagatttgccacttctgggtcttgcccttctttcatcagttcctgtagaataaaaacacgttactctgaaatgtatttccttgatgactatttaaaatattctgactttctgctccttgtaaagatgtactttccaagaaaaacttgatttcagcaaactatcgcaagaacaaacaaaccaaacaccgcatgttctcactcataggtgggaattgaacaatgagaacacatggacacaggaaggggaacatcgcacaccggggcctgttgtggggtgggggtaggggggaggggtagcattaggagatatacctgatgctaaatgatgagttaatgggtgcagcacaccaacatggcacatgtatacatatgtaacaaacctgcacattgtgcacatgtaccctaaaacttaaaagtataataataaaaaagaatagcttctaagcactgacttctaacctggactgaggcagccttcttaccctaccctcaagcaacccagtgatctcctgggaagctgcctagactatttcacattatgttaagaagaggcagaggaagctaattatatgtgtaacttctagaaataggcacaagaatataaagcgtccttgttgttgaggttactgacttcaaccagggttttctgtggaacttacatgagcagttaatgcctgactaaataaacccataagccttctgctatgttcagcggttaatccaattgagtaaatagccattgacatctcagtgccaggcactagtgctagggattaagtgatgaaaagtgacagaccttcttcaaatatctcattataattcctaattataatgctggagatataggggataggtgcaattgtaaatgtatgtttaaggtacaaaaacagtacttagaacaattaactctggaagtaatgaggggaatctgaagcggagttgaaagaccaataggaactcatcatgaaaaatcaggagatggttaattccaggcaaatgtatcagtatactatacacaaacctgtaacggtgaggaaggcccaggcatggttaaagcactttgagtggtttgtatgcctgaagtgtaaccgtgcagggctaagggaaggcagagaaagtgtcgtacaggagctatctggggctctttcctgaggactatgaaatagttcagagttttaaatgagaaagatgcaggtaaatatgcatgctggaaggcctaccatctcagcagaatggtccatgggttagaaggagaggaactcaaagactgatttgagttaggcctagagtcatgcatacgattttctttttgtaaaagaggttcatttctttttttaattaaataaaaactgcatatatttattgattacaatataatattttgaaatgtgcatacattatgcaatggctaaattgagctaattaacatatgcgttacttcatttccttatctttttttgtggtgataacacttaaaatatactctcaatgatcttcaagaatataatacattgttattagctatagtcaccacattatacaaaaaatgtcttaaacttatctaactgaaatgatgcgccctttgaccaacatcttcctcaactccacccccaccatccggcccctggtaatcatcattctactctctgcatctgtgaattcaaacttttaagattccacatatcagtgagatcatgctgtaattgcattgctatgtctggcttatttcacttaacataatgcccttccgtttcatccatgttgtctccaatgacagaaattccatcttttcataaagcttaataatattctagtgtatatctataccacagcttctttatcctttgatacattgatagacagttaggttgattccatatcttgattattgtgaatactgctgcaaaaaacacagaagtgcagatatctcttggacataatgatttcacttcttatagatatatgcctagtagtgggattgctggaccatatggtagttctatttttacttttttaagaccctccatactattttccataatgaatgtactcatttaaattcccatgcatctgatgttttattatgatgatatgccatgataattaagggggaatattgagacaaaataaggagatgaacacaagagaaagtaaagaggctgacttgataatattggcaacaaattggaggttgataatcctcaatgtgcttttcataccagcaaaataggaacagacttgttttatttatttatttatttatttatttttacttagagacagagtcttgctctgttgcccaggctggagggcagtggcacgatctcacctcactgcaacctctgcctcctgggttcaagcaatttctggctactttttgtatttttagtagagatggggtctcaccatattggccaggctggtctcaaactcctgaccttaagtgatctgcctgccttggcttcccaaagtgctgggattacaggcatgagccaccatgctcagccagacttattttatagcaactttattgaaggaaaattgacatacaattaactgcccatatttaaagtgagtactttggtaagtttttgtaaaatgtatacacctgtgaaaacataaacaaattaagatagagaacacatccatcaccatcacaggttaccttctgctcttttataattcttccttgcaccctccccattcccccgtaggcaactgttgatctgctgcctgtcactagattagtttttattttctagagtttatataaatgggattatacagtatgtgttctttttttcctttggcttctttcattctgcataatttaaaaaatattcaaccatgtgtgtatatcaatacaacagttcattccttttcattgctgactaatcttccattatatgaatataccatattttgcttatccagtcctgggttggtggacatttggcttgttccagtttgaggctattacaaaaaagctactatgatatttgtagtcaagtgtttttatgtatataaatttttattttctattttcttttttattttctattttattttggataaatgcctagagtaagaatggatgtatcattggtagatgtatatttaatttaaaaacaaaccaaaccaaactgcaaactctttttaaaaagctatttatattttgttgttcaatgtatgaaagtttaagtgtctgcaaacatgtatcaacatatgttttaattagatattttttttaattttagtcattctaataggtatgcagtgatacttcattgtgactttgatttgcatttccctaatgtgcaacagatgttgggcatcttttcatgtgtttatttgccatctatatatcttttgatgctgtctcttcaaattttagtccccattttttatttgagttttttgtttcctcattattatatttggttaattatacttggtcagggagaaggtgagttacaaaacactggttttttttggtggtaggaactctctaaatcttaaattatgctatgaatggatggagaagagttcatgttgcatctaggtagacgttgtaccacttatcaacacaataaacatagatgggtaaacagtgttatggtccaaaatgttaattaaattgtgaacttattgaattttatgtacctgtgtggctttcaagtggcaattttcctaaagaggagctatgtggataattcaaccttaggaacgtgatgaaaccaagcgcaactatactagtcaaactttttcttatattggagagtcctagcacatacaactaccacctttcagatgctttctctcagataatccttatacatgtattttctcctgcatccctggaattctttactaagggtacagtgctggactacattaaagctttatgacccttcttttttccaaccttcaattttttttcatcccattgcataaaaagccctatcttcactagatgacaactatgtactagttgcttaattcctcttttgtctaagcaatgtaatgttttattccagctaaaatatgcaagtcttcagaaagctcttaggaagatttaattgtaacagaagactgatatgggagatggttttatatatatgacctttttcagaccttcgaaaatcgcattatgtatatagctgactgcctatgtgtagggtcccctcatttcataaggttattgatatttttctcttccttgtttcttttatttattgccatttattatcaatccttgtgacaaaataagaaaattttaaaatatgatataagaggtagaggaaaactgtatagttggaagacagggatctaatgccacaattcaccactgtgatatttcttcaatttttccagaacattaatttaggctaacaatcatatttaataaaacagtgttataaacaaagttatctggtttttaaaattatttatgatcttgaaatatatttggaatatttgaaatatcaatttttatgtaaactatagagtcaaaaactatatactagacaactactagaaaatgagtaactatggatgttatggtttaaattgtatctggcaaaaagacatgctaatgtccaaaccccaagtgcctgcctcagaacgtgactttatttggaaacagatcattgcacaataaattactgaagatgaggtcattctggagtgggacagactcttactccaatatgactggttatcttataaaaagagagaagatgatgtgaaatgaggcatacagggagaatgccacgtgatggcagaggcagagattggaatgacacagctgtcaggccaaggaatgccttgaattcacagtcgcttaccagaaggttgctaaagtcaaggaaagattctacccagagtctcagagaaagcatggcgctgccaacactctggttttagaattcacattttcagaactatgagaaaaaaaaaatatgttgttttaagccacctaatttatggtactttttatggcagcccttaggaactaacacaatgagcaaataaattttaacaaaatctcaataccatatggagatatagtttatgtataaaacatttcaatatccacaataatagcagtaccttgggtcagaaaataatcagtgaagtccttattcatacgcagattctttgggttgcagtttgagtttctttgaactattgatggttataggtctgttttcagtgactaatatgctcacgtacagtagtttgttccttattttcaggtcatccttcaccctgcctcatgatttgtccttacttactgggatgtgcattttctcaggaagctagcatgaagggccacagagaccaggatgggaacaagcaacacttgcacgtgtggcaagtggaaatgctggaaatgacaatgatgacggagaggaaatgatacatgcctcatttttaggaacataacttaggctgtttaaaaaaagaatgagagagggaagctgattactcaataatccttgtaaaaaataaaagacctagatgagagagatggcagaggagctggagagatggtgcagccggggaggaacatcccagatgtttgatcagcaggaatcattgacaattagatgagccaataaagaataaaaaataaaattacgccaaagaataatttccattcaacagatactttactctttattcctgtctgctttgtgaaaatgatatcaaagactgacagaattatagggaactataactctttttgtccctttttctcttttttggctcttttatgtgttgtttttgtgcagttgccagctctgttgccatacaagttggagcaaatagcacaacctgagaggtcggtgactgtgttgcctctgctgtttccaaaacacataactttttctctgtatattatagactaatttaattccaacctcaattaacagatcattaaaaaacagagtattattattgttatcttttttaagcccagaaaatctgtcagccaagatagtcagcagagcttttgtcagggagacagaaaagagattagagagcataaaaggaagtgatcttattctcaaccttaaggctacagtttaaaaattctgcttataggacctaacacatttgaaacaaatataacccttcacatatattatttatatgtataaattagatgggtagagaaacaactccattctgtgatatcaacttttgattctggaaagaagctatgaaatgagtttcctattttctaaggtctggaacaatttaattttttctaaaactataggtcttgatattatgttaaaaggaatagagaagggaaaagcaaagtgcgcttatatcattttatttcataagaacaactaatattcattcccattctgtctcttttttcctttctgaattcttgacctactgggagatagtagagcagtgttcattcttcagtaggagtctctccaggagactttgattaaaagtgaaacacccattctgaacatgccactcctctgtgtggaaaatgtcagtggctcattagagactggagaaccagcccattcatggaaggccaggatctgagccttcctcactgctttccatccaccattttcatctattactcacctacatgattcaaaagtcaaatggtgctttcttcaatactgtataattttctgcctccacacctctattcaagttttaagaaagcatctaggtagctacctagaaataactagcatttttaatctattttccataatagtttggaacaatgtatatgtgctctgagaagggtattggtgaatagaggtagactttgtaccaactgctaccctttgtgattttcaaagaacgaacattatttattgactcgaccttcctaccacctaaattgggttttgtttgcttgctgttttgtttgctaagttcaacgttgggttcatcacccacacacacatgctttatttcctttgcctttctcattttcaactttccattactgctcactcattgtctcagatcagttgccaaaccaattttaaatgtagactcaggaatggtttcagaagtttaatcagcctctgcctcaccaacactatcatcatatgaaatttagttattgtcttcccttctggttatgtgacatcaaatgtcatgcccctgtaatatgcatttagctcttccttgaatcctgatctgcaaatctgaatttaacatgtatatttaagaaaacacttaggtgattttatgactgggtacgaaatttttgaacttgacacttgttgggcaagagagtctgcagagaatagaatctgtagtttatcaattagtcttcttcattattctcaagcattttagccaatgtttctcagatttgattaaatctctattgattttttgccttttaacaaggctgaaaaacttaattgggcaactagttatcttattggtattcccttatgcttcagttattattatcttctgaatgtaatttccttgcataaatcttttaattattattattatgctgaaagtgaacacatattacatacttgtgtatatatgtctataagtgattgtatatgtatatgcacatacgtgtatatacatatatccttgtgtgtgtaaacctgtgtttatatgcaataatggtgatacctaatatttattgaacatatactatgacctaggaactcatacttttcacatattaattcatctaatttttcaataaccctatgagataagtatttctactatccccattttacaaattgggaaaaagacacaataagaatttaataatttattaatactcacacaatcaggaagcagcagatccaagattcaaatcccaatgggatttctctaaggcttatgtgctcttaatccctacaatatccaaatatataatacaaagtacagtaaatttgccatataactttggagtcatgatgaaggcatatggtggtgcatagggtaaatatctgtgagaaactaggtataggtattttcttccttttttatccaggatctttatcacctactcatgtttctcatgcccactgaatcccagtctgtttaacactggtttaagtcccctattggcatcgtgcttaatggtgaattagccagctagcatcctttgcctgcgattacactgtgttcggcttttccacttgcacaagagttcagtgatttggtggagattattgttgagatttttgtgtttattcccataattagatattatactaaaactacaccatagaatatctgcttgtgtgacttctatgcaattccttttaaaggaatctttactgagctaaatttgcttgttgataaccttaataagaaggttgactttaaatgaggaaagcaaaaaataggaaaatagaaaacattagaaaaactagaagactgtcccacattattcaaaggtatttctgtaaggcagtggttattaaaagttagtcctcccagcactttgtgaggctgaggcaggcggatcacgaggtcaggagatcgagaccatcctggctcacacagtgaaaccctgactctactaaaaatacaaaaaattagttgggtgtggtggcgggcacctgtagtcccagctacctcgggaggctgagacaggagaatggcaagaacccgggaggcagagcttgcaatgagctgagattgcgctgctgcactccagcctgggcaacagagtgagattcccactcaaaaaaaaaaaggttagtccttggagtaaccttgagaactgggcaaaaatgcagagtttagggcctcaccttgtacctactgaatcagatactggggtggggctcatgtgttttaacagcctccaggtgatcctgctgcttgctcaattttgagaaccaccactgtatggcttgtccctatcactcaagaactcatgcacgctcacacacatacacatatacccacacagacattcccagagtttcaaggtcagctgtatatttcttactttatagacattggaatatatatttacactgaattaaaactactctttgtatatttatcagatacaatggagctataggtaatttcgttagacatcaaatcctttaaaccagcgtttatcaagttttaacattcataggaatcatgctatgcagatttttattcagcagatttgaagtggggcctgatattctccatctctaacagccttcctgttgatttcaatgttactggactcagcccacaatttgagttgcaacaatttagactcaagcatgtcctcaacaaacattttcatacatatcccaaaatatggccacagttttcctttacatttcatctctactataactacaattggttacaaccttctagcacaagagatttctcatctgagcacacttatctctatccctgtgtttttaacatgaaattcttttaatctaacataaaacacattcacttacgaagctgtcactgtcgaaatctatctgttatttcaggcttaactaacaaattccacttcctttcttaaattttcagtttatttcatgtcggacatactcttatataccctatacctctttttaacaagttatctaatgctctgtatgaagttatccagttacataattagtcccaatgtattttgagttcccagaagacagatttatgtggttcttacagatcatggcactcccctcacttatctagccactgtctgactcacatatgatgctgaatgctattggcttaattagtgtttcacctgccctggaaaggcaggtgaaaataatgttttgattaatgaagtaggtgggtctgattaatcatgtgatatgactatgctcagaggggccagaagaattgtttaatgaagagcacgaccagaggtatcaccaggaagcagagagagacagagacatttaaaagccattagtgaccatgagggatgtaggagatgaaataaaagatttaaaaaaaaaaaaaaaaagatgtttcagctatggaaaaagttaattccctgaagttcttctgcctgtaaataatccttagaccctgctatcgacattataaaatgagtttttgaaaagtattctggacagaggaaataactcctcccccatacagattatttttgaattgctgaagaatacacagtaatacccagagcatactggtatgtatatgaatttgtggtccttttagagcaaaggaatcagattgcccttatgtaaatcactatgatacagccaatccaaagtttcaactctctttataatcacccggcagtcagctgagacttccttgtgactctctgacgcagtcaagatagataaagtagccaggacggttgttcctagaatttggattttcttcctatagagaatgactacagtctgaactttgggtacaatttttcaaactagaaaaataagttgaaaaactgaaaagatgaagacagtaaatctgattcaaagttatttttgatttatttgttttatatattttaaattattttctgcttactttgtccatgtacaattaatgttttagttcacttttctagatagttgatatggtttggctgtgtccccacccaaatctcatcttgaattgtagctcccataattcccacatgttgtgggagagacccggtgggagataattgaatcatgggggcaggtctttcccatgctgttttcatgatggtgaataagtctcatgagatctgatggttttaaaaaggggagtttccctgcacaagcgctcttcttttgtctgccatcatgtgagatgtgcctcttacctaccaccacaactgtgagacctccccagccacatgggactgtgagtccattaaacctcttctgtaaagtgcccagtttcgggtatgtctttatcagcggtataaaaactgactaatacaatgtagtgaagtttcttgtttatttggttttgttttgtttttatatactttccagatttagcctcctttttgtaattcttttctttgttgccattgtggcttggagttttcatgtttcgagtagttaattttaaatcattgatactggatctctcttattctatttgtaaaaatgagattagattcaatagttttcatagtgtcttcaatatttggaatcccatgactcagtgattctataaataataatgagatcagacttttcaaactttttaaagtttattgaaagagatgggacatctttaaaattgttttcacagcgtcttttataagtgcacagcacaaatgtgaatttgaaagttttagtgttttaatatgaattttaatgggatggcaggagttgtgctagaattggccaacaactctagagaaagaacggctgtaatgaattgtgtctaaaaacaaacctcgcttctcccagtcctggaatggtgcggaagatggtagttcctcctatgactcatggtgcagtagaaagatggagtaggaggggggctgtaggctcccagcacactgcaggcaatgtgatggtccacctggagagggcattgctggaatgtactggtggccactgtcaaagaatcaggtggcccctcactgagggtgtccttcagagggagttggagtaaagctgagcattactccaagtaatctaagtaaacagtgagggaggcaacagagagaaaaagacacagggagaggaagggagtgagggtgggaggaaggaaggaaggaaagaagggaagaaggaagagagggaggtagtcaggcagggagggaaagagaggcaagagataattgaagtgatttaatctatgttacaaattaaagactgaaaaatcccataatataaaattttaattatttcaatccttaatttgataactgatttaaccaccgaacccatttttgcatggaaaatctattaattactgggatacaatttagggaatgctggtgtagacaagtaaagagcatgtttggtcgaaaggagacatgaaattaccacgagaatatgtggatttacaatgattctcagaatactttttgggttatttcaatcctatgattggatcaaatacatagccaaataacatccacatttggggaactttgtgtattacacacactcactcctgctcttcttagtcctctccataatttttacttctgcaaaaacctccctgtgtctgtgtttaacgtaaaattacgtatactgttcatttactaagcacaggtatatactttcaataactaaagaaagaaaaagtacttttaagaaaaaaaataaataaaaaatcatggctaacctagcactttgcaatggcaacttttctatgaggattaaattccttgcttttttttaggtaattttacagagtatatatgtgtgtatccagcaacaaaaatattaattcaaacaaaccttaaattctcctaagaaagttctttgattgtcctcaggtgccccatgctgtagtgagatttgaccaggaagaacagagtttgaatccaagacctcacttagactgtagtgaacaaagtacataactttcttttactcgttctgcatgcacggaatgagttacttagtacttagtcccttacagtgttttgtcaatgtgtgactactgataagatgatggcaactgcttgttatatcttgcatttcccataggttttcttaactctcttttatcaagacttttcagctgtcctaaagtttaatactattaaaaatattttattccatggggaattaaaaaaaggaaaatagtagactatgatttctttatcaaattctgatgggaaggattatacggggaaaaaataaaactcttaaagagaacagtgcttgttaatgatctaaaccactgtttatcaatactctacagttatataagcaaaaactctattttgactttcaaatacctggctttgtctagaataaaatttagcttgactgttcatggagcttgaaatttccttaagtaagtgccgtacaagataatgaggatagtcccccctaccccagccttaaaaccatactattttatctggttttatctgtatttactgaacccattattataaacttaattcaattgtttgcatatttatttgcccactatatatattgatgagtagatatgcaagacaagatgaagagaaacagttgcatgaaaaaccattgttcatctaatccaaatggttgaacacctcaactattggattactctttgaatgtcacctcatctctttcttcatccccaaacacagcatcctttctgcatatccagagactgcttgcttgcttaccatcagaaaaaagaaaggaaaaagtcttgcttcaaggacagccatatggcttagaactaaagaagaaagatgggaaatgtggagttgggtggagagtcctgtaaaaggaacaagcactaagtttgcttatagagtaagcctattttatgatgtcaacagaacttctccaagtctcttacaaggaacttacacttctccttcaatcagaactgtccatagggcatcgtttaatcccactgtacactttctcaccaggttatgctcttgttctcccaaggtatcttgccgtggattaccctcatcttctttttctacttatacaaatatgtcccggtggaagcattcttgaactgttccatctgaaagatacaattttctcttaattcatatattgcttaactgacaatcccaatgagaaaggttgagaaaaaaaatctgagaaatactgagaaaaaaagagatattgagaaaaaaatcctggaccagatattcaaacatctcataatttgatagatatgtaacctccttaacatacagtaagtagtgtccatgctacatcacaaaaatgttgtcaggatagaatgatgccatgtctgtgaaatgttttgtataaggcaattaggtatacttaggtaaggtgtttgcattgtttataccgaattaagctatgatgattaacattctggtgaatactactttctttcatctgtttttcatattgcctcaacccaattaaaagtatatttagcttgtacctcataaagaaaagttcatttgcttttcctgatgatgaaagtaataaatatctattatagaaaattgttaaaagtacacacaaatataaaaataaaaattaagtgtaatgttgtaaccaagagataacaactatatcaaaaaagagccacacttatatattcttatatatgtgtatataggtgtgtatctttataaactgctttgttcacttatcagcgtatcttttgcatattcgtattccccagttctatttttgcttcctcaagtgcagccacagtattttgacttcagttatgtctcactaagcatgtcatactgtgccttgggtagaataaatattcaatacattggctttattcacagaatgacttaaagccttttgattgtttaaatgtaaaattatgtgaaacagaatttctgtctttaaagatcacaattgtgttcttattgatgaattgaggccactccatgtaactgtgacttatttttccttttcctttcccttctgtttagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggtaaatgtgttactatagaaaatataataaaaacatgttactgccacggaatttcgttgctcagaaaatattcattaatgtttgggacctaggaatgtttagaataggttctgactattgtagctccaagaacctcacccccaaagccaaacaactattttacaagctgcggtggacccgcttacaaaatcagcttaagaaacgtaaccttaaattttagaattacagattttaatgacttcatattccacgactgaccctctgagttttttgtttattaaaacttttcaacatatctcattgactatatgtaaataatcattctaatattcctaatagataagtcttctaaaagtacatgcagattactctgaagaattagtgattctatacataaagtaactgaaaccttttgaaaaaatcaatccattcaaatttatctttgaaatctatattaatttaaaataacaggaaattaaacaacaggatatccgccactctctttttgttcttgtcatagaaagttgtattgggtctgaagcaaatcactgtgaagtagaaaaccttaaagtagctagtgaaaatcttgttttcccgccgggtgcagtggctcatgcctgtaatcccagcactttgggaggccgaggcgggcggatcacgaggtcaggagatcgtagccatcctagctaacacggtgaaaccccgtctctactaaaaattcaaaaagaaattagccgggcgtggtggcgggcgcctgtagtcccagctactcgggaggctgaggcaggagaatgacgtgaacccgggaggcggagcttgcagtgatcccagatcacgccactgtagtccagcctgggcgacagagtgagactctgtctcaaaaaaaaagaaaggaaaaaaatgtagctagtgaaaaccttgttttcctttctccttgttattatagccatggttaaaatttgcattttaattatccttttctctatcatactatggtttgctgagaaatcacattttctcaatttagctcattattttaaacctctctgctataatatctatctcatcatttggctattagaaaatatgtgacaaatttcatgattcaaaatctcagaatatcagtttgggttaactctcaaaactgctgaagaaactaaaatgacatcaaggcagaaaaaaaaaagacagcctatttgagataaatatgtttttcagttttaaaaattataaaaaccatactttaagtattgtcaataagaaaagttaatagggacaagatttgatgttttacttatataactaaacaaaatcctcaggtgaactttaaaatagagtaggttctcattaatctaaagtgggtaaaatgtgatcttgtttaaattagaaaaaagggtcaggccgggcaggacacagtgactcatgcctgtaatcccagcactttgggaagccaaagcgggcggatcgcttgagatcaggagttggagtatcacccatctctactaaaaatgtgaaaattagctgggcatggtggccacagcctgtaatcccagctacctgggatgctgaggcaggagaatagtttgagcctgggaggcagaggttgcggtgaaccaagattacaccactgcactccagcctgggtgacaaagtgagactctgtctcaaaaaatgaaagaaaagaagaaaaattaaaaaggctcacataatctataagtgtccgaagtgtcctttggaataaaataattttcacattgcagttggtattaaaggtaaaataaccccccctgtttcatttaaattaaatatatctcattaagaatgtttttaaaggaattttcttcttagaaaatgtctttggaacaattcttacagaagagtttaggatgttacattttccataatggctaacttatattgaatgtctaaaaattctagtttcccaaacgcagaacatttcattttgaaaaatactatagatacaataaaatgtaagcagatagagtagtcctaatctttccttgataccatcaatgaaaatgtgtcaaatactttccaggcagaatgcacagtgaaggatgatagtgatacaaaagtaaggcaacaaagagcccttctgctaatgaagcttaaattttactgggataaatgggtaataaacaaatagatttgtgatataatgtcataaaatggtaaataatatttaaaaaataggaggtccaaccttctaattacttgtccagtgaaaacagtcattggctgcctgctacacaccaagcttctaacagaatatttcatggaagttggctggaagaaactagacccaaccacagctaaatgattacatgaggtatagatttatttgtgagtattataattccagcttagaaaaatatctgctataggcaacattgtctcaagatttcctgactgtagggagttaatttttctgagaattttaggatgaaaagagatttcctagaattaaaaaatgcgtgcaaatgatcatcttgctgaaataatggggcatgaggaaaaatgtttatatatcaaagagatctgtcaaaccattatattgttcaccaagtctggtgaattgtgagtgcctcatatccgagactgagttctcagtgccttgctagatccatgattataaggggtgtgtgctatgttgttgggctgttctgcaaaaggcactggacttaaatccatgcccaggttctaccactaggagactattaaattatgggtggtcacaagctctcaggattttcagtgtcttcatctacaaaatgaaagatttagagtgaatgacatctaaagtccccctgtatcctatcatcctgtctgctaagctaccattattaaggcagagaaaactgatcctttcgggggaggtatagtgttgaaggggagagccaggctaaagacatcagagtaggaatgcgttaatctttaaccagaagcgtaatatatataaaaatgcacagtctgatttgatgactatattaatgaatcctctattctcttgtcctgtcctgctgtctgataaagtaagtggccatgagtcccttagcagaacatttcatagttcattgtttgcaaggttctagatttataacatcaagattgaatgacttacggaaatgatgtggcttataagtgtgtcccctcatcatgttaattgtctcagtggtagactggaactctgtttatggttttttctcaagtcttcttgaactgacttagattttcaaaccagatcacctctgtgagctgcttgttgtataaagtaatacttttttatttgtactaaattcacttttcttccgttttcaaaagatcttcctcgcattcataatttcttgatgtatgagaaatgatcactttatacctctcatttgtttatcctagcaaaacacttttgacttatttgttttatatatttatatcataaatgtccatgtttatctaggtaggaaagttctctaactttaaagcctaacctttcaaaccaatttctttttcttcttaagaattatggttttgcttgggaatttccattattttatatatcttgcagtgtttcagcaataagaactgtattcagcctcatagaaccagttgtcttgtgtttcagtacaatggcagaataaggtttctgttatttcagtatctttcttgttgaagttcaacattgttgactatttaaatctattgtgttttacatctttagaaagcagttcataatcgctcttctatccctctgccacggtgtcagcaataagttggaactcaccgcccaacaaagctttcagaattatttttacttcagacttgcttgtatttgaaggttatcgacttttcctttctgccatcaaacagcctcaagagatcttcttgcacatatttgctgtcaggatgaactttattatataagaaagaaagccaaaaagctttacagggaccaaacttatgatgcttgtcattgtgatacagttctaactaatgcagaaaactaatcatggataattctgttagaactctcaatagatgagtaaattccagacagatggacaccaatatccttctcaggctgtcaaattacccacttaaactagagtaaaaagtaaaacagttgtttgatcaagcattcctatgggcctgataacagagctatacttttcgggtgtctggagaaaaagtttcattggaaagactgaatgatggattagaaagagctcgaggctagaagatcagagacttgggtacttttacgttctccatgactctgaggctcttaacttatttagggtttgatttttaatatactgggaatatgcaatgaatagaatatgataaatttatttttattaaaaaattacatgaaaactagagcatgttatatgtgtaatgtgcattatgagaattcatcaaaattatggcaagagttttatctcaaagagaggcatttgtttctgaagataatacgtagtaagatatgggaaaaacaaacttttgaatgctggttgtcaggccttcctgaaacccagtttgaattttccctcagaattcattctaactccgattgtaacaaacaaattttgctataaattatccctttgcacaaaaaagtatggacatctgtaaaatttccagatgtagacttatgtaattagcttagtaaaataaattataaaatggataacacttttcatgaaagaagtagaactttgggctgggtgtggtggctcacacctataatcccagcactttgggaggctgaggtgggtggatcacgaggtcaggggttcgagaccatactggccaacatagtgaaaccctgtctctactaaaaatacaaaaatcagccaggcatggtggcaggcacatgtagtcccagctactcgggaggctgagacaggagaatcgcttgaacctgggaggcagaggttgcagtgagccgagattgtgccactgcactccagtgtaggtgacagagcaagactccatctcaaaaaaaaaagaaaagaaaagaaagaaagaactttaatgaaggctatcatatgaatacagcaggaaatactttgctcctatgagaaaacaaaatggctgctgaagcgacgtgacattgtgagcatgccccagattatgccacaattaaacagtatgcaaatctatgcacactgagcatgaggagaaaggtgaactgaggaaaagatgtaacataggaggaggtctaagctctgttaaaaatagcttctattgaattcctaggcataaagtaagaattgctcataatagccagattatgcaacttgcctataacactttatttagcaaatttttaaacaagattggtttctcatttccataatttattttacatttttatgttttaaaaggtggatattaacaaatctgaacatttcaacaaggcctaccaaattgaagatgtagaatgaaaagttggtgataacattttcatctagataaatattcatagagtcaaataatactatatggatgtatatatatgtatatatatgtgggggggatacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgaatttcccatcccctcaagcagctccaaacaatattctcacaattataagaaatattcgtattactttccccagctcctcccttgtcgtggtgctcaaataatcttagcaaactagcttcagacacacacagaccctcaaacacaagctgcagactacccatttattaatttaaaatggatattttaatttttgaggaaatcagatagtacagtgcgacatatgaccctcattttactatttatcagtgggaaaaaatattttaacatcatcttcatggaattataaagactaatgcagtaatatctcaaacaatgagatattaatgaagatttcagttattgtgtgtgcccctattaatgctgaacacatgatttctttattggagggaaatgaactctttttaggccatgacagtgcaatataaatttgatacacaaaaattgaaatttacaggccttcagagaatgtttgaaaacatggtttagatggttcaagggaagaggggaaaagacaggaaaagaggagtagataccaagaaagaaagagtcaaagttaaaaaaaaaaatgagattcttgaattagtcttcattagcacagagtaacaatagtagtagtagtaatcgtagtaataatagtagaaactgaaaaaattaggcactgtgctgagtaatttaaatgcattcttttgttcgaacttcacagtaactctgttccacttaatcataataaatgatgttaatgtctcatttcacagagaggaaacaggcttagagaatttacattccttgcagggatcaagggatcaaggagctaacaagtgatactagattcaaattccagtcaatgtaagtctagatctagattctttatcctttctgagacactcacccaaaagtgtgagaggtagaatttgaaaaggcaaaaacagctcagaacgtgtgtccgtacttaagacttcttcgcttctatttgccggcttagatttttacacaggtgaaatttgaatggaccatgtttctgcttcattaaaggtgtaatgctctttaagatgcacatttgatatgatttactattgaatattatgtttaccaacataccaaactcaccactaccaccaccctcacatcaccaccagtatcatcactgccttttttctaatctaaaacatattatgtgtgactttctagcactaaaagaagcaatccattccaagaaagaaagaataagtcctttgatatgacctagagatgtttccttttttgctttccatgtattagttgctatgttctaaagttaaatttattttcttcaaggacattattattttttaaatttctgtgtgtgtgtgtgtgtgtgtgtgtaaggggtactcaggaaaatcgaaagaaataaatatatttctttgggcatatttatttttaaaatgttcagaagtttgtattaagtggaaggtggtaattttcatagtgaaaatattaatattcacttattcgaaactatatattaggcaacttctgctgcttattgaaaaggtaatgaacaaggaattggagaaatatttattccttgtcttcctatctacataagcattctacttcttagttttcatggaaaattttaaattaaattagaatcctataaaaagaatgctcctacactgataaaatgtctcacttgatttttaagtaactatttttaggtgataagctatcagatgatctggaattctaaagttctacacttcactcttactctgaaactaacatggcatcctttcttggtaaacttaaaaatgtgtacttccttaattatatattcctagttttttttctcaaaatgttaaaataatggtgtcaaaacccatagtggtttaagcatttttagatgccttccaactaagaatatttaacattcactgtctctttatgtcagtgttttttgaagtatggtctgctgactaaaattatggttactgtagattcttatgacaaattcagattatggttggctgatttagaaattccaaaagtattttaaacattaaagactgagaaacaattctggaagtcaaatttcataatcatataatggttttattaaggatcttcaacatatttgaatctagacatgaaatggttttacttctttctatcactctccttggccaccttatatcaaatatcctttccttgttcccgaatgatatcactatcggttatcataaattttctgaaatttcaagttatttaaaagtaggctatgttcagtttaaaactcaaattttataagcttaaagatcttctcttcccaataaaggcctgacccatggcttgaaggatctggaattgtccatctcttacacatcctttaactccaacactggaattcaaggtgggatataggctcttcatgcttcctcactcctgttgctttagggacgatggggaatgggagaagctaaatgtcctgacttacctggcaccctggtcagagctctttcttggttggttgtcctgcctctctggctattactgagccacctgtgtgatgctgaccctcctgaggggtgcacggctgttctttgagagccctgttgtgcctccacactgcatagttctctgagtcagagattcaactcttccaggagtcttccagtccctccactcctgtaaccagcagtcaatccctaacgaggtcctggaaccctaacaaatccctcttgagtcctggcaagaaggctcaaacccagccttttcttctaatatgcacttacctcacaacagcatcacagaaccttaccacattaaaagacagaaggccagactgccatgggctaccctatggccaaacctcactgttttccattttctgtgatgagctgaacccagggggagatgagcaagccacctgcccaaacagatgccccagcaggggtgaggtagtagttcctccttgtagaaactcccagactttatgagggattttcttggagtctcccttagacttgacttagggaggcagtagtattggtgaggaaacacccttacctgtccttctggtattcccttttagcacaaaaactgcactgtcctggctgggctgccgacgcctgtaatccaagctccctccttggaaggccaaggtggggagattgcttgatgccaggagttcaagaccagcctggccaacatagagagatttcttttctaccaaaaaaaaaaaaaaaaaaaaagatagctgggcatggtaacatgtgcctctagtccttgctcctctacccaggaggctgaggtgggagcattgcatgagctcaggagtttgaggatgcagtgagatataatgcaccactacactgcagcctgggaaacagggtgagactctgtctctaaaaaataacaacaacgacaaaaacaaaacagaaaccttgcactccctgacctcatggctctctcgctatctgtctccccaggtctacctctgttacagattacggaaggagagggctaggtggttgggaacagatagggtcctgatgcctcctagtaggccctggaaggaaaagtttggctacaattttctgtaaactcttttcagaacatggatgcttggggtccttgtcctcatctttgtttgagttttaagtatactgctgagaacaggagctgccccttaactgaatgcctcttagaggtccagaacaagtgggtttctactgaataaaagacttcctttaaatttatctttgaacagaagcagatttttgatgagagactacttttatattccctgatttgaaaatcaaaaaacaaaacaatacaaaactccagcagggaggaaatttttgtgttcttttatcttcattgatttgataccacaacataaagctcagtgttctgtgaagagacttccaaggtcaggcccccgacagctttgcggcttaaataagagacccctggaggttgccataggtgaaaaggtgacttgctttttgtttggggttgtttactattggtgtaagtacggacagtaagaaagggaatgacaggagatctatttgcagagttacacatttgtcactatgtaattggtgctgttaaatgtggcatctgagcattgcctaccccatcacatcctcacagccagcttcgcaggacataatagaacattcaaatagccctgagtgaaaactgttatgggaaaggtagaaaaaaatagtaaaaacttccagacatctacaaatatttttaaaaggaagttctctgactcatttgcactgtgatctttcctttgttggtccccacagtcttgacatcaatgcttgtaattaggcctccatcacgactctgagaaatcatgtcttctgtttataaacagcaaagagcaatttcgaaatgttcccattgcgggaacaggataaacattttgtgacagaagctgtcttaatctttgttctcttcaggctttttagttaccatggataatttactagctgaattcgttttttatttagttaatagcaccctctggtttttctaaaggcttgtttcttcaaaaattcagtaaatgttgccagaataaatgaaactggccatttcgctaccatgcttataacaaacataaatccacagtcatctgacaggtatgtggtgactagaactataaaaagtgatattcaatctggaacaataacaaaaaaaaaagataccaacacattaccacattagccaacagacattgattggcaatcttatctatagctcaagtttaaacaaaatgatggcatgagtttccagttttatcaggatctctgtttttcccacacatttgtgcctttcaaaggtcagaagtgaagtaagattttgggtggtcaagaaaatcagatttaatgtctcctccttgatctccagaggaattgtaatatatcagcattgtgagttttgcttagaggtcatctagtctaaacttacagttgaagtttcatctcctttaacccatcggacgagaacagagtctgctcagctatgaaggaagtcgaaataaaatgttgacttgtactgagctcataacttcttctttatacctccttcccaaagcctttcttcctttatgtaaatcctcacaaaatatttgaatttcgctatttcgatgactgttaataatcacatttgactttccagtttagtagcagcaggtataaagataataaagtttatctgtcagacataatgaaatataaatgctctggttagcaagtactttaaaatatattttatttcatgatacatacaaatctgaaagcaaccgaattataaattcattaagttggaatgaactttaaagattacgtagatcagtctccactcgctgctagaatttctctggcttaaagacagcctctggattggaatctctatgtcacagggtaatccattccagttttagagcaactctaattgccagaatattcttccttacatttggcaagaagctgcctttctatgcttttcttatcaaagatccaatttctgctttgtggggcagaccagagcaagtctgtgccctcttgtacagggcagtttttcatctctcatggcagcgattgtgatgactgcttttggtaaaattgtcacaatcctaataggaagaagcaatcgttggcaatttatgcagttaggataaaatcatactttgtaaaagccatgtaatccaaacctctgttttttgaagtgaacggaaacctagagaggctaagctaagattctaaagctgattgctcgttgagttgagcctggccgcttgatcacctaacgtagactagctcttatcactatgccttctggtgaaaaattaacttgaaatgcatttgctaaatcaatgattgcatgcacatatctaatatctgggaattggcagtgtcaagcaagacaaaacaaataagcaacattgtaccaagctcataacttcttctttatacctccttcccaaagtcctcattctgtcctctgaagcacataactctgtgccttgtaaactctcaggaataagaaaatgttgtccaagtgcactgcatttaggagattctgatccagtcgtgctttcttcattaactggtggcatcacattcttgtttacgctgcctctttgggccttagttttctcatgcaggctgtggttgtctattgaattctgcgtctgtagccaggttagtaggagaaagcaccataggtatggaaaaaaatgtgtgccaagcattttttcgcactggatattttaaattctaagtttcccaccagctctaaaatgcagtgcaggcatcatatcttacttagttctgatatactcctttctccaatatggaggtagtaaatattattatcattttcccaattatgtcccaattctatctgacctctcatgagagatttatttatgaaagatgactaaaacgggaaactaggatgtaaatgccgaatttagaataaagcagttgtctacagccaactttaaaaatacactataattaatttatctgaaatcagctctcatgtgagttataaatttgaatataacaaaatataaaaacaaaactttatcaataattttaaatagtcattgtttattttcactaattaatgatagaccatcatgtctactatgcttttatttcattcaacattttattatgaaaaatttcaaacatacagaaaatgtaaaaaatttatagttactcatatattacctgtaatcaatgtattaccataatatttttaattattttttctatcactgtattcattcctcaatatcaattttgtaattttggctacattcaaattaagttataacactaactttttggagttgagtgcagagatataaaatgttaaaacgcatacagtcatgtaataaccaccacaggaggcagcaaactacggccctgatatcagattgtttgccagtttttttaatagtttcattggaacacattcatgcccatttattgcaaagcctaaattatttgttctctggccctttacagaaaagtagttataaatttttataaatgcccttgatcaaattaataaatttcccttttattcacactttactgaaagtttttatcatgaatgcatgttaaattttgtcaaatgtttatactgcatctattgaaatgatcacattttttcaaaaagctgttgatgggataaattatgctgattgatttttaaatattgaaacaacctttcattacctggaaaaacattacttggccatgatttattattatttttatatattgctaacttttattcactactatttattgaggatttttgtgcatatttataagggctattggtgtgtagttttaaagagttttgtctgattgtttatcagtgtaatacttgcctcttaaatgtttcttactgttgttatctttgcaagagtttgattagcactagtattattttttcttgaaatgtttgggtgaatgcaccatgaaatcaactggacctgaatttttttgttgttggaaggatattaactaccagttcatttcctttaataactataggactattcaggttgctttatgtcctcttgagtgagttttaaagtttatgtctcagggaaaaaagctcatttaagttgtgaaatgtatgagcatccaggtattcattctagttgcttattattcttataatatctataagatctatattgatgttccttctttaatttctgatattgattatttatatcatctttttttgttaatcattctggctagcgttttatcaattttattgaccacttaagaaaactagattttgttttcattgatttatctttcattttatgtttcagattttattgatttttgttacctttgttattttcttctttctgcttgttttggtttaaacttgctcttctttttatactgtcttaattgaaggtgaaatcactgagatgaacccctcattcttttttgataaagcgacgttatttcctctaagcactactctagatgcctcacaaagagtttttggttgtatcttcattttcaatcatttcaaaatatttttaactcttctcatgtattcctatttgagccgaaagataatagaactgtattgtttagttgaaaaatatttggggattttctaggtacatttaattattgattggttgtttatttgtgttgtagtcatagaacttacttagtatgatttcaacctaaataaatgtgctgaggtttgtttcatggtccacactatggtctatcttggtgaatgttccatgtgcacaagcaagaaatgtgtattctgctgttctcatgttgttgatagtgttgttcaggtcttctatatcattactaaatttctgtctactggttctgttggttacagagagaggaatgctgaaacctccacttataattctacttttctttgtttcttgtttcagttttaatagttatggcatcttgtattatagggttcttttgttaactgcaagcacacatagaatttttatatcttctcagcaaattcgcctttttatctttatgttatatccctctatatacctagtaacattgcttcttctgaaatacatctacttttatattaatgtagccatgggagctttcttttcattattgttttatgttatatttttatttttcctttacttctatggatgaattgtgatagagttgtgcctgtacttttttcgtatatgatcatctctttattttcattagtgtgtttagatcatacatttcattgagtataattatgatatgggtaaactggaaacctacccccattgctatctgttcttcattgcgtttttccttttatgcctgttattggattaaatatttgtataaccctaattatttacatgtatagctctctactcatatattttaaaatatttaaaaggatgccatagtatttacaatataaaatattaatttattacattctaacttcaaaaatattattctgctttatgtgtagtataagaaccttatgacgggaggcttgtaattctcatcttctgtgctaatgtcattataccttttacttttacctatgttgacaattacaatatattgctacagtttttacttaggcagtcaattatatgttagaaaacttttaaataaaaataaatatatgtattttatatgtataacatatatatatacacacacacatttctggacataaatcttcatttttaaaaataaatctaactttctgtccaatattatacaccttctgccttaaaaatatccttttagtatgtcttttagtgtagatctgacaggaataaatcgtctcagattttgattgaagaaaaagtctttagtaagtatttcttagagctatttgtgttgtatatagaatcctgggttaactcttattctttttctttcagcactttaaagatgttactccaggccgggcgcggtggctcctgcctgtaatcccagcactttgggaggccgaggcgggcggatcacgaggttaggagatcgagaccatcctggccaacatgatgacaccccgtctctactaaaatacaaaaaattagccggatcgggtagtgcgtgcctgtagtcccagctactagggaggctgaggcagggaaatcgctttaacccaggaggcggagattgtagtgggcggagatcgcgctactgcactccagcctggcaacaaagtgagactccaactaaaaaaaaaaaaagatgttactccattgccttgtatatattttttacacccagaagtttgctgtcagtcttacttttcttcctttgtatgcaaaatgtctctcttttttccttttttttttttcttggctgctttcggtattttttctttatcttttgtttttgacggtttgaatatgatgcatcacggtttggtgtgtgtgggtacgtatgtgtacgtgtgttttggaaagttattcattccacctatgcagaagactagccacagacgtacacagcctttatgcctgaaagtgtacatgcctcttctcttctaaattagtgtagaggtttgaggcaataagtcaggagctgagttgggtttgggttttgttgttgccaccgtcagtttcagtgcatcatatgccacagcttagggtggaaaagaagattattctcagtgttccttctccacctacagcttttgatcttccctgtacatctatgcctcagaggcccttcctccagtggttgtcaattgctgattgttccctggtgtttgttggcctcgtgatggagggcaggaaaactctctgatgtcctcatccagggtcagacttaggcaggcctatatctgactgctagggatggaactttctccatgatcgatgccctccttttcatggcaaacatggcagcttatgtacaggaaagtttttcctgtccctgctctaatggtattgctgtaaacctgaggctcaggagtgctttctgtctcttccacaaggctaaagtgttttgctccttaggtgagaggagcctggagaggacactgtgcctctcccacagaagcagcctcttttctccccaggcttgaactataatatttctcttgagctgtggatagggtccatgaagaagagcatgcaagagggtagaaattttccttgtaactgtggctcccagggattctagtctctcctgctacctcacagtcagccgagtctcttggatggtgccagtgtctcttccttgcatactctgccgcaggtgagctaagtctcacaacatggttgctttagaggaacgtgcatatattttaaagtttagattccttgatttctcgtctctctgatgcatgcttggaaaattatgatttttatagttaatttcactttttcttgagtcagtgtagggataatacttgtccaactttctacatcctaggaagatcttcaactctaaatttcatgtttcagagtattatcctaaaaaattctcactgtttgcttgtgttaatgtagttatgacatcatatttacccttttaatatttactgaatctagatattttgacatctctctcatcattaggctctaaatacgaaattataaaattttaataagataatggaaataaaataataacctacactaatattttgtaagtacttcatagaatttgaaaataaagcatttcctattaaaaattaaaaatacattttttctggatataaagtattttaatgaattatcatgaatgctataaccatcatttctcaagattgaagtccggtctctgaaggcactaactgcttaaagaaacacaacaagatactccactaattgtctgaaaccagttatgattgctagatacactgattttcatgatctttgagtaattttgacttgggagaaaaatatatgtcaagacatttgcttttaagaaaatgttattttccaagggaaatatatagttataaaggagctacagtataatttaaaaactacttatccttatgaatttatcgaatggataaaagaaagtgaggctgtcctaacaacatcttccagaattagcttagtatctgaaagtcttaaagtatggctgggactcagtgttattacctgtaaaaaatagatgttgcatttagtgtaacaatgtggtctcttgtagcttcgagatctataattgttaaattgtatattgcttttttagtgattctattgaaatcatacttacaatgaatctttctataattgcaggcttcatatggggagaaattaaacagatgtgggatggcggacttcaggactacatccatgattggtggaatctaatggactttgtaatgaactccttatatttagcaacaatctccttgaaaattgttgcatttgtaaaggtaactattatttatgttgttggtaaagcatatgttctgattattaatgatatactttcaactgatattaattttattaataaagttacctagagctttttccggatgtcgtattcatcagctcatggttttattgatagatatatagggataaaaatacataaataaatgcatagcctttaatcacaaaacaagtttttataagtagaagttatcacccaattcccttgcatctactaagtagaatgatgtctcaaaattattcacagtaactgctctagtttctaatcctttctatttctaatgaaattgtgcttcaaacactgtttaaattttggcaacccaaatctattttcttcagttataactaatagataaaatttcatagacagatcaaaatattactctttcaaagcattgaaattattatttcagtataaactaatacaatttgatataattagagcagaatataatttctttctcctcatcccattcaacatgacagtgcctgaaatctcacacactcattactcccccagattttgtacaccatcaatcttatcccaacctcataatttgcataaaacatttttgttctgtcatgacaattgggattattttgtactttgttgggtttctttcaacccagaggattatcttctctccttcactgattttccttttccccctttccttttctctttaaaaaaataaaagtttcaaaataactagttaattggtaaaaaaaaaaaaataaagaatatctaattgggtgtgacataaataatgcattcaatttaataatctgaactagaaaattctaacatgtagataaacttttattcatttagcctagttcttaaaataatgccttctgcttctgtgggcaaccttcaggtatgacagaagcaaaattgtctgaagttggatgcagccatagaaaaggatgagttcatgtcctttgtagggacatggatgaagctggaaaccatcattctgagcaaactattgcaaggacagaaaaccaaacaccgcatgttctcactcataggtgggaattgaacaatgagaacacgtggacacagggtggggaacatcacacactggggcctgtcgcggggtggggggaggggggagggatagcactaggagatatacctcatgtaaatgatgagttaacgggtgcagcacaccaacacagcacatgtatacctatgtaacaaacctgcacgttgtgcacatgtaccctagaacttaaagtataataataaaaaaaattgtctgaagttggaaaggccatagttttctgttaaaatgctaccagtgctcaccgaaatactaggggaaagcaatttctatcaattttatggaaagcaagtatatttcaaaatgaaaacataatttggtaattttattaatgcattgaggttaatgaccttgaaaagtttaagacagcagaaggtactcttttaaccaaaggagattatgcatttctgtaagaggtaggcagtctgtgattaagcgcctagctctccagtccccttcttctgtcatgattcttagatgtatacataaaattgtttagacctacttctaaaagtaatatatgtagttttttgtggttttgtgctgtcatgaaattctgggattatatcacaataccagttcttctcaaatttctaagtggataggaatcataaggagggcttgccaaaactcaggttcattttctccatcaccagatttaagttacatgtactaagacaaagtccaaatttgcatttctaacaaactcccagttgatactgatacagttgacctaaggaagacactgtgaagaacattgcattgtatagacctgttctacagctcagagaactgtgagattgggtcccaaagaaactgctgttatacatctatttagacaatatttaaactaagctatatcatgtttgtatttattacatttgtgtgatgtttatgtatagtacatgtattttttcatatataagaactctggtacgtagtgagtatgcttacatagattaatggatatttgtggatgttttgcctcaagacttttagatgtgggattttaatttagttaaaaagttgtaaattctacactggcaaaatctattttaccattaaaatctaaacattgttcttcatgtttagaattaaactcactcaccccagtgatgaaaaggagggggcagagggagaaacggtatgtggagcagtacacagtaattactgcagatgaagatgacctaaggaatgtgaagtcttcaaaaaatacatagtttgttaatatatggtcataggagttcagctacaattggaaatataaactacaacatgtcctttctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactagttgggtgaccttgagcctgtttcttcacctcttttgtctatccataaaataagaaaaataataatttctaccttatgctgttggcatgagaagtaaatgagttgatgtatttaaagtgcctattacagaataagcacactaaattagttttttctttttttttttacttttgtctttgctttctttctcatgtactatgagtctactagacttgccttttgtaagatctttaatgtgtctcctcatttgctttattttagttttaaaagagtttgagctctaggtccacacttgccttcaccatgttcaatctgtatggtatgggacaagttattgaatgtaggtctcaattttattatctgtaagttgatgataataatcaaaagagtactcactctgggggcctgtgatgtcactctgattttctgatttgtccttccttaccttacatttgttctatcattcaatttttttcaggctaatttgtaataacttataaattattattttaagagcaggtaggtaatttgcatgaaaaaatagaggctgatgtagataaagcaaacagctattatgtgaatcaagaagctaatcaaatcaataagcatttattggagcacactaagaaacagcttttgatctggttgctgaaaatgcaaatctgcccaagaggtagctcttgccttcaagtgggtcacggtcaggtagatgaaagagaaatgcatgtaaacaaggatcttacaatgtaataaggtctataagaggggctactgtaacatgagagaaggaactgaacttttctgtaatgacatggaattatacagaggacagtacaagtggatatctatcatgatcatgaacatgcatgagcattcaagacagaaaaggcacaatatgcaaaagtcagagtgtttaacaagcagagttcactatctattttggatgatcctaaaaatgtgggcagggagaaggtgagaaggactttccacatcttgctatcgggcttttattttaccctataaattataaggatccatttaggtcatttatgcagggaatggttcaaatgatgatgattgcctgaaatagagcagtgaacataggagaagatgatagaagattggacttgaacaaatttaggtagtaacatctggaagatatgtgatttagtaattatgaaatatgaggtagattaaatcatgctaataattctccgtagtaaataatagattcacctcttttgcttcagacgggattaccggtgttatgactaggacctctgctaggattgtataggttctacctcctatctgaggattcctgaacaggaacaaagtccattcataggtccttttggttaagtcatggaactggaccaaaaaaaactgtatcatcctacaaaaaaagaaaatcttgttataattgttcttttcagaaaaagaaccttttagaaacatctgtcataggggccagccttgtttaatttctccattgtattagtcacctcggcttgtcacaatagaataccatagattgggtggcttaaacaacagaaatttatttcttgcagttacagaggctggaagcctgagatcaaggttccagcatggttggtttctggtgaggtctctctcactgacttatagaaggttggtcacattcacctggtgggggtggggcataaggggttgggagagaatgcaaactttggtgtgtctccttataaggacactaatctcatcatgaaagcccaccctcatgacctcatataaacctaattacctcccaaaaataccatctccaaataccatcacactggggggctcaatctggggagatgcaattcagttcatgacattcatacttttgaaatccatctacttgcaagaaagatctttatttaaaatgcacacaaaacagcccttctaaccaaggccatggaattgctgtgactatgacttatatcacttcctacctatgtgatttggagcaagttactgaacctgtgcctcaaatttctctgctgtaaaacaataataacaatcaaacataatagaatgtttctgaagattaaatcaataaacatttaattccatagaatagaacctaatataaaaacgcagtatttgctctcaatttttatatacaatgcaacagtattataatgtgcaaagacagagcataaaaatatgtatgacttcaagattatccattttacatgcaaagttttgtggtgttttcttgagtatcttgatttattagcatttaaagctcatgggttataaacttttaaaaaattgctcctaaccctctagaggaaagtttgtcaatcattttctcttttcactgtgtatgaagtattagttaatctggagtttgttgatgcctggggaccacagttataaaacgttacttcagtttcattagggctggtttatttctaaatattatccagccccttttctgtatgtaacacttctcatatttatcttcaacagtttggcagaaatgattagattttaattcctttttcgctgtgtaatttaaataatattttcaaaaatcaaaatttttattaataagaagatttgttttaaccatcattgtggcttttctttatagcaccattcttctaaatagttctaactgcatgtctcatagatcccatttcttattaactagaaaagggccaagtgtttttcctattttataaatgatgtaactttagtctgctccccaaagtgtgggattgtctaaggtattctttagttttatggcagaaagctataaagatttgaatcttagttgtttaatcagaattatgtacttgaagagaaaataatatgccagtataaacactggtctttttggtctttcactacttaattatctgataaatttctagaaagggaaaagatttcaccatgtaaagcacacattaaaaccaatatatgtttcttatttaatctcactgaccaatatttttatttcatattaatttaatttttactcatttctatttattacttgacattcacaagtatgcatcagagactacagaggatataaagatagcctaacatattttcctacattcaataaacttctgatccaatattatgattcagttcatctttctctcttaacactgctgctaaactcttcatgacttggctccaactcatctcatcctctcatactcatctcactgttcccaaatcctctgtgttacatctgtgtcaagatacatttataaaaatgatccatattctctaaccactttgttttttaatatgtctataattcttctccccagagtgctttttgagttcctatcatatataaagcactctactagatgtccagcacctaaaaatgccttagacaaagctccctgcataagaatctgacaagtaatccaaaagtacctctctattatataggtctgcaaaataagcaattctctttcaaaggaatctgaatagaaataaaggcttggggaaaaaccaaactagggtacatacagactgaaaacaaataattgagagaaggaggaatacaggaattaatgatcctagaaaacctatgtgtgtttaaagtagttctttatttcttcctaaaggattactttacaacacggagctgtcagctctgatcagcaggatcctaatgtccatgcatctgcagtcggggtaaaggattagcatggcttgattaatgtatgacttcaccatgttgtaaacccgtatggcatcttccttgatcagtaccatgaaccccgaagacagtgcctgacacagagcaggcacactcatgtatacttgatgaatgaataacaaaataattggaatttaaattcattctagagaaatggtacaatgttcatggaaaagcattttggtaagaatgtgtgactaatttgaggaattaccagtagtgaaagtttgagccaaaacattaggtgtctaattagagccaaatggcagttaaatctttaaaaggagtcagaacatagaggctttatgtagcaagttgaaaaatcagaaggtcatctcaaggacaatgttgtgattgaagaacattaaataatatgtgacatgggctggttgggttctttaaaagattctggaggagggctgggtgccgtggctaatgcctgtaatcccagcactttgtgaggcccaggcgggcagaccacctgagatcaggagttcaagaccagcctggccaattgtggtgaaagcccgtctctactaaaaatgtaaaaattagctgggcatggtggtgggtgcctgtaatcccagctactcaggaggctgaggtaggagaagtgcttgaacccaagagatggaggttgcagtgagccgagattgcggcactgtactccagcctgggcgacagagcaagactacgtctcaaaaaacaagattcctgaggagatacatagatgatggaggacataagacttaaggcagggagagcagtgaggaaggtgctgcagttatatctgagaaataagaggtactattttaaaacagtgagggtagtgatgaagagaaggaagcaacctacataagatttgggtttagatgctgggattttagacaaaaagattctaggaggaacctcaaattctgacttggtgacctgttgccattcataagatcagaaggggtaaatggagaaagagtttcaggatgcaaaggtggtgagttacactttcgatctgtgagtttgagatgcctgtgagatatcccagtggaaaagtcaaccagacagtacaatgcagaatagggctgttaggtgagaagtctcagctggagatgtatagttgagaatagtcattgagagttgaaatcctggaaaacacccagggagaattggtagaatgagaagagaggaagcttgaaaaatgaactcaacttttaaggggcaggtgagattgaggaacttcccaaggagactgagaagaggccactcaaagacaaacatgcgaagatgaaaagggaaggtaggttttgtaaattgctcctaaatagcagaggcaaagaaattttttaaaattcaaattaatattttaattcctaagaataggtgtggaaaattcatcgactgattgaagaattaaaattattcgctacaaattcaaagaatattacaatttgtaattataaaaatcactttgttaaatgatgactatagttaaaaacttaagaaaatatctatgtgaaggatgggataaaaattcagcaaaatttaagaagaataaaatcaagagataattacttcatatttatatctcttaatccgtgacaggaaatgaggttttttggatcagagaacagacaaattatttacttacatagcaaacttagcactggttccccatgccccagtccccagtgggggacctaatagccagatgtaccctgtgtatacaggggtttgtaccacaggagaggagcttggaaaatatgtgtctcagaactcataccgtgcagctgagccagctgcctgtctttcccctggagaagaaaagagaaagacttcaactttctaaagtaaataaattgtctctggggaggcaaaggtccctaggtttattattctgagagtgtaagcacaatagcttctgggaagaagatcctaagtttctcaggaggtctccatctttaacttccaatggttgtttcccattcaaacatcctttaacccagatgccagcaatgttttgcctaaagccttgaccttgcataaagtgaatatattcatgcagcattttttcctggccatgactagaagtgctagactctgaaatcaacttaaataatcacactggggcagaatctgtaaaaatggaaaaccttcctcttatgtatttttttttttttttttttttttgtctcagctgagataatttaccaagaagggctcttttcagagtaggtccataatagaacttgacctagtcataatgtgatgatggatccacatccagctgacctggatgttaaacctaaagcaatgcatagcatctttcctagatttgaaggatttttaaagctttgacaatacatcatctctcaccattcctagcctcagaagccccagacagaattaatcacttcctcttccctattcccaccccactttgtgttaatctcttagagcatttttattgtaattagttgtgcctgtctgcctcaccgggctatgaatacttgacaggagaaaatatttcttgagcacccacgatattcagggcattgtgctaaatgttctaagaagttcaagaaaatgattgcattattaagaatacttcttgtttcattttttgtgtattttaaaatatagtcctgagctatattaggttaaatgaagaggaatttaattagctaccaacatagggggatatttctcaagtataaatatttatgagctaattgtatcgctgatagaattagctatcaattatagggggacagctatcaatagttacggacttaaatatgtgtgtcttttaagagagaagtgaggaaaggaaggacaatgtgatcttggtctttgaaggaaaaggtggcatcatacatagcgagactaagagcagagaattaggtaatgtttagtatccaagtttcactctgacacttgtcataatgaaagagaaaaacatcttaacttttttttttatatcttcagtaattagctattttatgcggaagctatgtgtgggaatgttcaagaacatttatcaagatttaaagatagaaaataattttcttctagttcaaacttgattgttttacactgccagtcaagcaagagtctgagtgttgaataagatcaggagcctataatacattgtctccccagagagattaaaaaatactatctattagtttcaaggagaattaattgattcacatttgtaaagctcttggatgtaaaatgtgctataaaaagaataaaaaacattatgtgggactcagacagagtagcactaactttcttttcattggaaaaacatcttggttgtctagatatatttttcagtgatgtgtatgaagcaaataattcaatttattattcagttctaatacagatttaattacagattttcatactgcaatatctaaaagagcatatttgacccttttttttttcttttgagatggagtttcactcttattgcccaggatggagtgcaatggcgtgatctcagctcaccacaacctcagtctcccaagttcaagtgattctcctgcctcagcctccctaatagctgggattacaggtgcccgccaccacacctggctattttttgtatttttagtagagacggggtttctccatgttggtcaggctggtcgcgaactcccaacctcaggtaattcgccagcttcggcctcccaaagtgctgggattacaggcatcagccaccgcgccaggccttgacccttttttaaaagggatacaaatttacctcgatagtacacagttaaattttattttgctttttatatgttttaatagcaggataattcaaatctgacattttaattaacctgcttactttttaaataattgctggtcaaagtttacagtagcaatttttttctcaaatcatgtattttacctacttaaggagcattcagataaatgttatatttcctgcatattaaatgtaaaaagttagcaattcagcaactgccgggacgatttgtaagttaggttgtatttacatttaggacatagcagagaggaagcactgatggtttttgcccatattggtcatttctgtttccatagcaacagaccactacttctactcatttatatgtaatttgtatcctacatgtgttcctctagaattggcaagtgtgttcaaaaatcgaaaacaaagtcatcaattattttgttcaaaatttaatagttttccttctgggtctgaccttgatctatttatatgcgtgtgtttgttttactttccctttgtttctctgttttctccagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgtaagtctaatagacatttctactggtaatgttgtacagcatttagagtgcaccacatcacaaacttgaaaaacctatgacaaatggttgtaaagaaaatggggaactaaaattgtgcttaatgcagaaaacagaattaacatggctttgaatagaaatgaaaacttccgacaggaaaaagaatacctgacacatttattttaaattttagtaaaatcatcttttcttctaaatgacttcatgaaaaagaaagcaatagatactatttttttgatgtagaatttaaaaaggtagcctatatactacaaaagcttacaagtacattaaaagatagaacatgtgtaaaaccactcatgttggaaaattcaagtagatttcaatatttcctcatgtgttttccaggtactaaagtccgtttatgtatctctttcattctctagtttcctacacaaaaacttaaccatctaaaaatagtgcaaatggaaatctaagactaatctagccattactgtcatgcacacaaaactctctgtgcccttatggctggatgagcaatagacagtgtctattgtcagctctctcagttattctcataatgggctttgctaacagcacacagcttcatgggcactgtgtctgatggtcacacagctctcataggctattcctctatatatctgtcccatttccttcccactgtgacaaacagacggttaaccagtagctgaattaataagtgaagtgattttcctccatacagtaaccacgtttgaagacacagtcattttgtaggtgactttaaaagtcataccttattcatgagccatcatagaatcttgtatactataagagaggatggtaatttctcaagtaacaaaaaagtcaataatatcacatgaacaaaatcacttacagctaaaatgctcttgttggtctaattctacatctgttttatcttagctccaatatttaaaacttcattttagttattcatcatctttttatttgcacataatttttaaatgtcagccattgatacctcatttttttcagaaatagatttgatacatccatggatcttaaagaaaacataattttttttttttaaggcagagttttgctcagtcgcccaggctggagtgcagtggtgtgatcttggctcactgcaacctctgcctccagggttcaagtgattctcctgcttcagcctcccgagtagctggggctacaggcacccaccaccacgcccggctaatttttgtatttttagtagagatagggtttcaacatgttggccaggctgagtcttgaactcctaacctcaagggatctacccaccacagcctcccaaagtgttgggattacaggcatgagccacttcgccggccttccagctccttcttgatcctgtattcctaagcagcagtttcttggcctgaccggttcactcagtcttgacatcttcccactgctctcttctgaccctgggcaggaggaattcaatgaaatcccttgcaaaaacatcctcataactagcatggcctaggatggcatctcaattttgatatctgaacttctcttcctcccccgcccaccccctaccctctggctcccgtcttatttgtggttcttgacttgcaacttggccagggaaacggattagagatttacaatggtcagaccccaccaacctcttccttcataaatgagagttctgctctaacaatctttgtctgtctgccagctggtctcctggatttctgatggagaacccttgtgaatgctctttcacaactttcttcttactttatgctgcataacctggtgcaaactgcttgccaagaccaccccatctgttcctgttgccatatccttctgacttcctcctttgccttccagaaagaacttccacgtagcatttaaaactgtgttaactcccaggtcctctttatttcagggaaaagctctggttcccagacccaacccttctcacctatctgattcctctgcaatcaataggttatacataacactgtcatgatttatgatcccctaaaattcctaggaatttctttgtccctatattggtttctttgtaagtaataacatattacaaactaattataacataaatcaaaggagattaaggccagacaagcatgatgtaaaatgcttaatataaattttattccaaaatcaaatatactggattattgggattatgtattactttcgtttgtctctaccagtgatttcctctattgtcatgaaaagcaacatataattacatatcttaaatactataggcctatatcattcaacccaaataaatcagttattgcacttgaattattttttctaaataatataaatgtgcaagccacaaattattttttgcttcaagatattgaaaaactaaagtatatatcaatagcccttaacattaggaagcaggaggtcctaggcttaagtcacctgtctcttgatgactctgtttaagcaaaacggacaccagtcattgtcacagggtatatagtgatacccttggggcccctgctctacatcttacttctgtgctttctttggtttttaattttctttttgtaattctgtacgtttcataaattcaggctcttttttactgcccactatttccgagaccttattctatgtgaaggttaaaaatacactaattcatataaagtacctaacacagttcatgtcatagaatgtcatcaaaaatggtagctactcttattatcttcatgattggcaatggtagaggattatctctcacatatctctcataaggtttcgtctctattattccttccactcagtttcaaactttgttgaaattttgaacccaatatttcccattagctaccactcctgtttcattcctttcatccaagtaaccctaaaagaagcctatacaagatatcttattttctcacctctcactcagacttcatccaattataatttggcttctgcttccatcattccactaaaattgctcgaaaaattatcacctggagccttcttatcaccattaactatggacatttatctgctcacattttacttaatgtgtctgcttcatttgaccctgtttaacacttccatttctggaaatcttgccccttttaacttctatattattacctttttcacttcaaaacttacttctctagcctttctcactttactctaaccctaaccttaagtatactctgataattttttattttcattactgcttttaaatagtggtatgtcttagcatgctaacctgagacccttttaacagtacccctatgaaaactcatctgtgcttttggaattggctctatatgtctaagtcatgactaccatatttatattactagcaccaatttctatcctcgggttgcacaatatattcagctgtctagtggacacctctctctacatgcctcctgaagacttaaattcaatcaaagagaatttatcagagtctctctaaaacatattcttcctcctgcttaattccttttcttagtcaacatcaccacaatccacccagaaacttacatcaaaaacatttatcttattctagatcctaccttcttctcatcccttccatgtgtagtcggtcaataaatatctgttcctgctcctattatcttggcactgtcttccccttgctctccactgatgcccaaatctaagtacccctgcccctggtctctgccttgtttcttatgtcttccattttgcttcctgaattatatttctaaactaatatctgaggctaccctgtttaaagtgccaaaatggtttcccatttcttacaggatactgccacattctttagcttgacattttagatcattcattgatctgcttgtcccctgcctcctgtcttagtccatttttgttgcaatgaagaaatatctgagactaggtaatttataaagaaaagaggtttatttggtttatggttctgcacactctataagaagcacagcatcaacatctgcttctggtgagggcctcaggaagcttccattcatggcaaaagagtgaagggaagcaggcatcacagggggaaagaggaaggaagcgagggagggaggtgcaggggtcctttcaacaatcagctcttgtgagaactgatagtgtgagaactcactaattactcctaggatgacactaagccttttgtgagcaacccacaatccaccctcatcactcaaacacatccctctaagccccactttcaacatcagggattacatttcaacatgctatttgaaagagacgaacatcctctgtatcacttccttttcttgtctcatctttcaatcccccattaacactttactcttcaatatttcctgatggattataaatacaaatccccaaatacgttattttcttctcttattcgagaatggccttattctgcccttccatgtggcaatttttttttccaaatcctacctcagatataccttttgcaggaggccttttctggtcttctccctgactgaatgcccagtgtcaggctgtgatccatgtcttctatgcatcttcatgccgtttcccaccagtgaatacatacttcctcctgctcctttccaggttattttctcattaccctgagaagaactacatgttaccaaaaaacacaaaatatttagttgttgaaactattctatgtgcaattttaagctattagcctctggtaaggtactttcttatgaagagaggggcacaggctttgtgacaggtattgtctcattaagcaaagcccttttatatttgttggagctgtattcctaatggttgtaactggccagttggagtcatacattattttaatatttcatttttgcttataaactaaagataaaatattcagatgaattttttattaatttatgtttgctcattgttttagtcccatgggatagaggaaaatttcaacaatggaatacattacttttttacacattcaattcttctggctgtaaatatataatcagggaaacaagctaattgtataaagcatatgttgagcaatatattcaaagcaagagataaaatgctatcattaggaaggcaggacctaagtccacccatacagactgttaggatttagtcttcaacccaagttttatactaaatgtcacttaattaaattgtagcattatcttggagagttttcagttcatatcttaccacagaacaagaaaaatattagtcacgtaaaggcattctgagatgtgatactttaagtaatgatccttcaatgtatgggcaatgttggtctcaatagatttgggaattactaatgacaaaaacatttctgaaagcagtggctttgaaatgttaacttagactgattttttaaaaatccacctgttatctgaacaattcattgagaaacactaaggccagggtcttaattcctctgagaaataaatatattttagttaagtggaactagtctttaaatctcaccactgacttattccactaaaagaaggaaaataaaagaaagaaataatctataagtaatcatgaaatgtcactttatttagaattttcccctttaaatttttttaaacatcaataaatattttgcaaaagtatttattaatgtttcctaaaattagtagttactatgtagacaggagcaaatgtgtactattcaaaataataagtggtttattctgcatcattgtttttatttgaaaaagaacctgtaatggggtttatgtggtaacattttacactatatattgtataacttataatatttaacttacaactttccttaaattgctattcatgtcaggaaaaccagctgatttttatgtgtatactcacagtgagaacataaactatttggaaagaaagaatacaattctttcacattaaatccaaaggacactatgattaattttagaagttgtctttaaagttactaaaaataaagaattcatggccatgggccaaatttactttttcctgagaaattttcaaagagtagctttagtggcctttgtctagggccaatgagtcagattgaattctctctattattgttggaatctggcacctgggttttcctctaagaatatgtgatcacctcctcgtagaatgcacagcattccatttaagaatcacagtctggctaaagttgatcagatcagtgccctttctccttcacaataatctgttgttccgtcattttacaggtctagaaaataaatagttaaattttctgtcttaaaattagttgctcaattaaaaatatgaaattttttacctttttaaaaaagcaatttccatcctgaatgccaattaggcatatttagctggaatctcctggttatatgcactagaattcacagcttatttcaagtaacaggcatttagttataaaaaaacatgcaaagaattatagcccttcagtcttctgagtaagggtttatctttgcaagggcagaacctagagcaagccccagctttgggaagagctggagttgacgtagtgctgggccatgggattgttactctgtgtgtcagcattaaaatgagtcagctacttcatccttattccgagtttacttattgcctggcttattcatcctcaattctctgcttcttagtttgtgctgtctcaaacctttggcatcccgtcattccagtgactctgactccacatcataacccctgtcatcccaacccctttgggcaattatcttgatatttttaaggcaaacttctctagaggggaattctgatcttttttgccttaatgcatgccacaggccactggccttatatgaattttctctccttgggtcacttgaccatgattgacttagtccatggaggtattgggtgagaagctccagagtcttacacaaggactacctttccataaaagggcatacaggggacaatgccactggggctgggagttgccagaagccataattgacttggttctgcaacaccattccaatctaatgctaatctcccaatagacagaaatcctacctccttagtcatcatgccgtgtatgagaaggttttcgttttatttttgtaatttaaatatagtctcattttaacgatttaccaagaagtatgaaatctctatcatcgttttattacactatattaatgtattattatggtccctttgaaacaaacaattctccatttgagttcagatactcctcagcttatttcattttttggagtaagttaaagggacattattttcaataaaatagccagagttcattcattggctagaataaataaaatgttccttgaaataccaaaaaaaccaaaaacccatcaaattttattacgtaagcattctgagactctttaccatcttacaagatgcattatgtccaattttagttgtaaacatagaaatctgtagtaattataatgttctcaattctcctacaaccaaagcaaaatcagtaaaagagcaaactttttaaagcctaaaatttgggatctatcatttattagtgatgacttagtgccctaggacagagattgacaaatgttctatgaaaaggagcagatagtaaatattttaggttttctgagccatatgttctctgctataactactttcttctgccattgtagcacaaaagaagctatagaaaatgcataaatgaatgagaatggatgtgtttcaataaaattttatttatggatatagagatgtgaattttacataattttcatgtcataaaatatcactcttttgatttttttcccaaccattttagaaagtgaaaaccattcttaactcagtacccatgccacatttgcctctctctgccctaggaaactaaatttagctttcaaagctcttgggaaatttaagtacaccatttctactagtttgaggaaaacagttttatttcactctttttatcgtttaattttataattgtcctaaaaggttattttactgttgatattaatgtttaagttaattatatatatatatatatataatcatgccaagctttattgttttatcccatgtataatgattccattaatatagctattagtatcattttatctttattacaggttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgtaagttgaccagctttattttaattcaatgtttcctctagaatgtgttgttcttagctatactccatcttcttatcatcgtaaataaaatctataattagctattgattagacagataagaattataaatggttaatttgaaatttctgagcagtagcacactatatgtagctataaattaatctgattttgtcatgttacacatgattacaaagataaaccaaatccattttgccaggcagccattggctatgggaagtagtagctgaggtctgactaataaacaagcagctcatctctgcgccgtgtacaataggttttgcctcctgtcggtccatttaacctaccactctcatataagcgaagtcatccctacaggggaagatacaaaagataacccagagaggagtctgggaaggggagaagccacaggattttcaatttcttaaagctcagggaaagcaatgtattaagagaagtaatattaacttctgtaggataatacacgatacaatacatgtttttttgaaactctggaatctaaacaacgtagcacaagttatttatttattcattcaatacataattactgggtacatactgtgttttccagtactgttctgggcaccagaaatacagcaatgcacaagaaagacaaagttgaacttatctgcttgaacttatatactagtgatatacgtctaggaccactagcaatagcagcaaaacagaactcttagtggaatgaaatatagttaagtctttcatatttataccttagacaagtagcattttataatcgtaattatagttttcccattttcttcataaataattacattccattacacctttgaatctatggttaaatctctgaagtgttattactgtttttttgtcaagcaaaactctgaattttacttcaaccatccttagggaggcaatttttctcataagacactcatcactgatgaaaaactgcatagaacatgagaatagatggtttttatttattgattcacagactaaagtattccaaatgcataaaaaattcctctggaaataggtaggtcctaggatttggaggttaatacccgaatttgtggatactttgaatttcatttaagcatcttacgatctgaaatttttataaatagactctaaatttttgtgtcagaagttctatattctcctaatcaacatatttccaaaatgtgcgttctgttttccagaacgtcagcaacaacaacaaattagaaggcctttaattatcaagctagatacaaggaagctgccagcaatttggatcttttaaaacattaaatgtcccaatttcatcaaggagaaaacactatttaagaatattatgacattttcttattgcttctttgtgaggtgtgcttttctaggtaacttcattacagagataagaatcatcttcaactctctatttagacttagcccaaaccctaagactatggagaaccaaagagtcactgagaacctgagacaggtgtgattcccaggactccatgcatgaagtctccttgggggcacgaacatgccaagcatttgcttacacctgtcccagaatagcagaattttctctttttctttcttccttccttccttcctttctttttctttctttcttctttcttctttctttctttcttcctctttctttctttttcttgttaactgtaactcagagccatcggtaaaccatgaaaaagaggaaaatttaactgttgaaaggcagaagcacttatgtaggccccaactaaagactgctttccattcactcatttgttaattgattgaatatttattgtgcacctactatatgccataaacatgcttaattttcgggatacaaagaattaaaaagtccctgttttcaacaaaaaaatgatatagtagagataaaaagcaataaataatttcaatattgagaaaagaaatttgaggatgtcatgaaagtatggaagaggggaccttgactggggttggagataggaggcagctcaggactgatgggaggcagaacaggcttctaaggagagaggattcttaagccaagtttcaaatgttgactaggagttagaaggtgagtagtggaaggtggatctagtcatcaccagcttagagctttttatctccagattttctaagcaccatagactatgttatagaccctcttaaaatcctaaatcatgaacaaagaaaccacttgcttagtgattgcaataagataacataatttctgactcaccgagagtcagagaatcagaaggagctatccacaggccaatgctttatctaagtgattgcctttttatttccttgagccaaatctgctgagtcccattctccatgcctgcaggaaacaatatgtacaattctcttcaacaatgctgagtcccattctccatgcctgcaggaaacaatatgtacaattctcttcaccaatgcagcataatcagccagaacctataaacttgtctagaaagaaagagaaaggaaaggagggagaaataagaaaggaaaggaagaggagggaaaaagggagggaaactgcagcttctgtgttccgatttatgtggatcaatccatattaccaaacatttgcttagcagcaataaggccatgcattctctaggtatggcgattcttgttcaaagcacagtctgtccaatatctggattaaacccatgttgcgcagaataaaaaagtatgcataacttattcatccgcacacagcaatttaggaatatcaaaatgaagcctagttgaagattattctcctactctaaaatatgagttcgtgtttatgatattaactggttacaatgaactattctgaattcttaaaatgaatgtatgcccagtctctaccacctcctacttctcagattttctgcttaaatcagatttatggctaaattaagaagagactggctgtcccaaatctaattgccacaaatgtaccaaagtttcctcaggaggttaataaagtggagtgagtaatacatgatgaaggggatagcctcaggattgtgggcaaccactggccatactcctctttggtgaaatctgtacaaagttaggtcaagattcaatggtgtgtcagagaggcccaattctacatttgttaatggaacttctttctgagtttatctctattggccgaaggtgggcaataatattcacatgaaaacatatccaataagacttttcctggcaacattgaaggctaagccatgagcatctgtggaggtagcattaatctaagcaggaatacaaggctttggttaagacagaaagtctatttctggcctgaatcaaatgaaactgcactaacatgagtctacagtgcagaagatgcaggctaatcttcaagtcataactaattactgcagtctttttaacatggaattattttagatgtctgtttcactgaagaaggaaggatgagaagtgacacgagagctgtgactaccctaggttaagccaccctctgaaatgtttagatgactgtctctgggagtcagtggtggttttagaagcaatttaattaatgttccaagagccgcttgaagtcaggttacaggatctctgtgagatttatggtaccttgttaattaaggaacctatcatcagttgtcatgttctcctgttcaggaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaataggggtaagaacacagcatgttagtattactctttttttaaattgtgtatttgaatatatttgtattctttattgtacatgttcaggtctttagcctttttgttcttactgattgcatgtcatgaacatttataacacatctcccatgactaaggcagtgtctgattaactaggatttcttcacaagtgaatttcctgcatcgagggcagtcactactattttaatagaagtcccgctcttcacacagccctccttgagttctgctagtcaaggctggggaactagcatactctgtcttaataccttgacttctaggtcttttcagaatgtgacagcaggttatttgtggcatttcttcctcattgtctgtttccccctctggattgtatgctccatgagggaagggcacgtgctttggtgacctcaaattcttcatgcctaacaaagtccctgcacaaagcattttatgcttgataagaattctcaattaaatgattgactgaatattataacttaaatatgctgtgccaactgttaagtgtgattccagaatatgtgtaattactcaacatgttgcatctactccctatcatattagatgccaagaatttaggcatctaaatatatatatgtgtgtgtgtgtgtgtgtgtgtgtgtgtgtgtatagagagagagagagagagacagagagagacagaagagagagagagaaaggtgagggggcggggactgcccagagccatgctcctggtaaactggaagatggtatttccctttcatcattttggaaatcagggtttcaagcaattccagcagaagatacaccacgtgaagcttttggtgcagccataccattgacataagacaaatcattcttcacgccttcctcactttgtgttctaattttgaaagttctcatagtaatgttttggaaattaacactcatattcattagtcacttggatcttctcagtaaaattgctttggaagtatttttaaatgttatcatattaggattagcaagtaatattagagattaattaaaaataaaaaaatattaatttgttttcaattttattttacatggtttgtgactgcgatgccctaagagatccttaccactctaacttcattgcccaccaggcattgtcatcagcaccaaatggagctttctcctactggcagtggcattgattttcctctcatctcagtaacaactctaattccaaagagaaattgactggcaagtgaatgttacaaagaggtgattaggagatgcagttctattctttcccataaactattacccatagatttgggggactacagtttgagaatgtatctgaccttagaaaccaaagtcagattacaacaaagccttatcctgccatcctcatactaatttatgaactttatcactgaccttagaagggagtgaaattattttactccagatatttgacttttgtgttaaaagttttagaataaatgtaatagcttagttctttgttgttgtttttttttttttttttttttttttttttgagacggagtctcgctcagttgcccaggctgaagtgcagtggcatgatcgcgactctgcaagctccgccttccgggttcacgccattctcctgcctcagcctcccgagtagctgggactacaggcgcctgccaccactctcggctaattttttgtatttttagtagagacggggtttcatcatgttagccaggttggtctcgatctcctgacctcgtaatctgcccacctcagcctcccaaagtgctgggattacaggcgtgagccaccgcgcccggccaatagcttagatttaataagcaattactgcatgtgtcccccttgccgtaactgaactagaatttgaggagtgggaagaggtacgaaggcatgggttccatctttgagggcaccaattttaatgagagagatacagaaataaaaacagatatgttatgtagtatatttaacattataatacagtcacatgaaagaggttatgggaaaaatgcaagaaataattaatgcttcccttgaggtaaacaggacaagatttcaaggaagccagacttcagcttactcctttccagatcaaatatacttatcctttataccatctcattcttaaatttataagcatttttaattgatctctgataagatagtgatgattaatgctgtcataatatactacctttcataagagtattttgatttagaaagagcttctgggccaaaaaaaaaaatacctactcaccaaagaaatatgtatttcatattttaattttaggcaatggcagagagaatcttggtttttaagataacaggaaacttgtaacaaaacacagggtcctgctctgatgttttaagagatccatctgtactgccaacaaaaagaatggagaaccagaccaaaaacttggcttccaaccctccctcctatcctctcactgttgactcatgggtaggattatgttgccatcattttttagaagcaaagaggagctctcagtcaattggcttttctattaaagtagtgattcattctcagagttaaacagttttatttgctatatattactggtctcaaaaggaacccacacatttcttttatgtgtttatatttgaattttttgctccaagctgatgcacagcaaggtaatttgaaactaatcagaatctcaaaccattccttttttttttttaaccattaatattttactaacattcaacaatggctatttggatgctttgggaatttatgccaaactaaaaaatattctgagttttgtctgtcttttccaccaatctagagccctgggcaagcaccagcccaatcaatatcaatgctgtctaaatttactctttctccatactgcatttccaaaatgaaaaggacatattgttttcagatgcctactcttagttgagctttatacattttttgtttatatgaaaataaatgataggtataatttataaggaagttcttgcttataaaagtataagaaacgctgggtgcggcggctcacacctgtaatcccagcactttgggaggcctaggtgggtggatcacaaggtcaagagatagagaccatcctggccaacacggtgaaaccctgtctctaccaaaaatacaaaaattagctgcgcgtggtggcacgtgcctgtagtcccagctactcaggaggctgaggaagaagaatcgcttgaacccgggaggcagaggttgcagtgagccgagatcgcaccactgcactccagcctggtgacagagcgagactccgtctcaataaataaataaataaataaatgtataagataaatgagatataaattaagatggttgtattattaaaagaggggttaactgagaaagtaatatcaaaagtaattaatttttctgtgaatttatttcaacttggttaatcctcctgatagtttattatgtggacatacaaagacaatgagatacacaaacaactattaattaaaaggtgacatttaaggaacagtgacactcactttgtgaaactagcacatggcttagaatataccattataccccaaagggatcttagatatcatttagctcaaccatttcttttaaaagataacctgtttactttgcccattgtctcatgctctcttagagacagagcagggggaaattgctgggtcttccattgtttcccagttcaaactgctttccatcaccctctcttatttccctgagaagtctggtgaacatgcagcaacaccttccctgttgtgtcttttgattgttctcagcagcctttgcagatcctatcattgttttcagctgcctcttagactcctgtgtcccgaatcccttgtttaccaggctggtttaccttctgcccttatcctcaacttgcttatctttatgctgcatttttgaagcagaaaattcaagctacactggaagtgacttcattctttgaagtatttttctgtaaccttcccatttgtagttcacttactgacactcgtcacccagcctttgagtaaatgtcaccctgctgctcattccattcacgttcccaggaaatgcctgggaaaccagtactcttcagggttgctacattggccactctctaggagcccattattgatgatcttatcgtgctatttatggcttcccagtaatactgatacaactagctctgaaaactcattaattcgtatttctttgtaactctggacttcatttaatggttgattgggagttccaggtaaattaatctttcacttgactgctttatgggagaaagcataaatgaagcagaaatgctgtattattgagcacaacatttgtgatagaaagcaaacccattattgagagatgcttcctctctgggctattataaaaatcccacgaaaaaggcagcctatccaaataagaaacatactcttaacttgtgtttttgacattgcttcctgtcaaatgttttgtttaacctcattttatcagcaaatacccttcttatcattacagcatttgttctcaaatattttagcatacaagaattgtcaggagtctccattttaacaagcatttccagtttacaactttaactagacatttctattcaagacagcattggtatctaccacaatttttttgaagttttttaatctttaattcgtgtgagtacatagtagatctgagctttttaagctaaaacgaagccaggcttcatgctgttgctcaaaaggtcccgatccatttaattcaagtacgaagatgctattataatacaatacttccccaaagcatttcattaatgtgagacatatttaatgtcacagactaggtttctaaatgaaatgtttacatttatatgttaccataccgaaccaaaaaaaaatactagttcttttgataaaatcataaaaaatgtttttaacttccttagttttatgttttccgctttttggttttctctcaagcacatggtgagaagaacaggaggcaggatggtctctggaagatcactctgagcatcacacagctctgagatacaggtggaatattcaagcctgactagctgccccagaaatatgcccagttaagtcactacaaatgaaattagaaactgtgaatagattagcaacagctatcatcactaaagaaaaaatgctcatagtacatgcctctcagacttcatttatagtggcgatttgtcaaaatgtatcgctccctaatctttaggacgcttagtaggcctaatgacaaatcttacagatatgacagttttcatccgtgagtgtctccggattcctaaattactgctgcaagatttgttggcagggccttttgatgaaactttatttccccagcggggatatatagaaattaattgcttgatattcttggtatttcaagagtgagttcctgaatatttggtttgacaatacaacattcaggcatttcacgtgaattattttgatatgcttagaaaatgtgttcatgaaaagcagtaagcagatgtatgctataagggtgcagaaagactgtttatagagaacaatatgtagatccatctgcaaagaagccaaactgcaatttttttgtaaagggatcacatcccggaatgccctcttgcctttttagttttcgtgaaaggagaagaacacagcaagctgcatggcttaaggaattcaaggagcaaagcaaagactaaaaggcataattcatgggcttaaaattcactgctagaccaaaaccagagtggaaatgagagaaaacggcattgaaaattgacagcagggactagctacatgaaatgagcgtgacattccacatagtggacctggagagaaccggagataagagtgacaaaatgtcacagctcactctccagagacctctcttttctagctgcaaaatcttccctgctctaaagaaacctgaaacttctattgaaattccggagtttccttgcagcagcagcagtttctcactagatggtctttctctttaacatgagttctctgatccaaacgctgccattgtcctgccctaacaaattaggaggaacctgcaaactgtgaattatgctaatgtggcaacaggtatgccctcatcttctccttgaaagctactttgccaaggaatattccacacacagtctagtgacttctgatgtagtttgcgaagaaaagtgccaacctaaggagaacttcttccaaaatatttttcctagacactcagttaaggaagaaaagcccttgatttgtcacaaaatccattttttctgtcttaaacacaactcacaaccaatctagtttaacaaaaaaaaaagctgcaaaatgcaagttccagaaatttctttctttttttttttttttttttttgagatggagtctcgctctgttgcccaggctggagtgcagtggcgcgatctgcactcaccacaggctccacctcccgggttcacgccattctcccaccttagcctcctgagtagctgggactacaggcgcttgccaccacgcctggcaaatttttttgtgtatttttagtagagacggagtttcaccgtgttagccaggatggtcttgagctcctgacctcgtgatccaccctcttcggcctcccagagtgctggaattacaggcgtgaaccaccgcgcccggccacaagttccagaaatttctatgtgatattgtacacttgagctcattcactgagaaatcctttattcctaacacaggtctaccatgctataattctacctaagttattatttttagtaaaattagagaacacagttaatgcagattactctgtcaaagtttaacatgcaaatggcttgaaagaaaattaaatacccattttcttaggtattaaagctaaatacccacttaggtatttttaaatgaaatggctttcattatattactttgaatcacaaattgttcatttctcctgttctcggtcatttccagtgataattataagaaaaagatatcttctcttaaggtaacaaatccctttgaagttcagctgatctttactcaacaaaaaaggatatgaatgtcctaaatataactgatggtagttctattgtgtaatattcaatggtgtcactaattgccaaaaattattgtgatgtttattgcaaagagtacatatattatgagttgaattgtatgccccttcaaaaaagataggttgaagtcctaatcccctatacatagattgtgaccttatttggaaataggatcattgcagacatacttagttaaggcgagattatactagaatagggtccttgtaagaacatggccatgtgaagaccgagacccaagaaaaacaccatatgagattgcagatgggcacctgcaagccaaagaactccaagaattaacagccaccaccagaagctaggaagtctcattcccacttggtgctactgctaaatgactatcaatgaaattacactttcatcacatgtcactcaactagtcaaaatccccaggtgcctagtaaccactggattcatgtgccatctgaaattctacattaagagtccacgctaatttcccactacaatctaatctgtatattcccagtagcaaagactttgcaactatcctgccagaagtctccataatgtgcctctcactttctaaccctagcatatttgctcatcctactccaatcatctagaacacctgtgcacctccccttgtcctaatcctgtgattccttcatgacccatctaatactgcattctctataagagggctgttacggcttctttccttcacacagtattacctccttctcccctgtactcaaatatcacacttacagcacttcccgtgttttcttttgtatttgccttcatgtgtagtctttcatgatcttggcaatccaccttttggactatcagccatttaagggcaaaagtgtgctttattcatctctggtttcttgcactccactgccatacacatgtagtcatttaataaatataccttaaattagccctacaagttaagagagttctaattccaaaatggagccttgagacaagctggctttactccctgccatggaaaaccaaacccaaatatacagtgccaggattatcaccagaaatatcccaggactcagataggaggcaaagcccatctaggggtcacagagaaatgaaaaactcctagcacatggtaaaagaatcgtatttctggccaggcactgtggctcacacctgtaatctcagcactttgggagatcgaggcaggcagatctcaaggtcaggagttcgagatcagcctgaccaacatggtgaaacccccgtctctattaaaaatacaaaagttagccaggcgtggtgccatgcacctgtaatcctagctactcaggaggctgaggcaggggaatggcttgaatctgggagacagaggttgcagtgtgccgagatcattgcactccagactggtgacagagtgagattctatctcaaaaaaaaaaaaaaagaaaaaagaaagaatcgtatttccatatccaggatgcccttctcttcaatctgcctggcaccaagagtgtaaataatttctcccaactcaaggttcctacactgaaaaaactgagatctgaggtagacaaccagctttcccaatatcttgcattccctagaagtaggcttctccttgcctcaacccatgaaaatcatcctgagtccctgaagagaaatatccctgagctcagccagagacaaaggcaaagatggaactcccatccccaggcctggagactctgctctgtaactcgaccaaatgagatgccaaatcagagtggcttctcagtagcgacatgttgtaggaggtacattccacagctccactaggctggaacccctagccagccttctcttttgctatgacctctgaattttcctcagagtttctatatcaacgctcacatatggctgtctcattagggtcatagcaaaaattcaatgtcatgccgaaaagttcataaaacttttgggctcctccaaagatgactgcctacagagtctgggtcacatctatccaaatttaccagaagtattctcttactctatcacttacatgcaagtttcctacctctaaacctctctactgccaaagctgaaggcatctaacgatttagctgaaggaaatgctccacaagcatgaattaccatcaaaatcatgcaaagggacacagttaaatgtaagtatattattttactttctcagaggtaatcataatatgtgtcctactatgcacaagctttgagaatcagatttttaaaaggctattaagtcacattatcaatcaaaaaggaaaaaaatgcaaagaggacaagaactaacattagttagcaacagatgccataaatctcttagctcatttaatcttcagaattacccatggagtttatcttcaccctgcaaaataaaaaatcagggaagaggtagggtgtcagagttaaactccctgactaggcacagtcagcttcaaacccaggtgtaacccctgggaccatattcttaatatcacaccacactttctcctagaaagtaggaactggaagggcataatggtgatcactaaacagcctattctgtcatgctaatcagggaaacagagattaaacagatgagagctctatcagccgcataatttagcattaattatttggtgagcgcactgcattcattttgagttttaggttcagaagacagttaacctcatccattctttttttctagctagaatgttgaagttcattgcctgataaaattttgtgaaactaaaaaatagttttgtggtattaccacataattgtggaatataattggttggcaaaaacaatgaatcgcattaacttagtcttaaacctggactatataaactgaataacgcctgaaaggtaccatagtgaacatttttagtgttcctctctctttttgacaatccattttgattttttaagttttttcccaagaaaattaacctagaattaccatttaaaatgtagtctttgacctttttatatttgtattaaaattttttgacgttggatgagtaagattctactgaaggaaagacagtttgtactcattttaatactaaaatgtatcatgataattttcacttattactcataattttctgattctgtcatcctcaattgtagtttgatgttaaagaaatttaaagttaaatcctgacttctaattgctctctgttgaaaatttcctcattggattttagaaggataggattctaaaacacagtagtgaaatgttatagaatcccaaaacaataaaaattaagtagactaaattctttctatattaaattaagagtttctagctacttaaataatgaaaatcagatctctgttataatatttatggtgagaatgttaaagaaattgatgtacgactcactttagtattttagtttaagtaaatttaaggagatctagaagactgtgtgtttccttttagaagtgcagtttgtcttaggtttcagctgagctatgtctcaatatgagtcagacacctccatctggtggcccagccgtaaaattcccatgccatactttttcaagctgctctctacatttgtgttgtttcaaatttctgagtttttaaattaataacttaatcctattttaaatgtttttctcaaaatgtatttctcatgcaaaagtgaatgatagtcaaaataattagtgacctttaggaacctaagcattgtctcatctgtttctacaagtcactactaatcatgaaagacagatgcatccttatggccagtgaaaatagcattttcttctatttctctgaagagaagaaaagagtttcttttaaattgtttaatatttaaattatcatttcacagtgatgtaggcacagctcttttcaatattctgttttatcagcctatgattatttattaaggaacaagagcaaaagcctcattttaaaaccaaggtatatcatcccttttgctttctcacaatttaccaaattaattcttttattatagagatatttttattttatattattttgcccaatattcttcctgaagaatcagtgctgatgtttattcaacatacataaaattgggattatgtagggtttttttctaatatctttagaatacttgagaatctgcaaatatataactttaatgtcatttattatttcactcaactcataatgggattttttcaatcattaaacaatccatctctctattctacaatcccaaatcactgccctgtgcttaccccacctctgctctcaaaccattctgatgccttcaaaatatgagctgggactcacatttaattttttaaatgagttaataaatgctgtgtttcaacagaatcctttatttatttattccgttaaatccagccatctatttaaacaggaatctcctcttactgtatatatgattgatattatatatatatatatatgattggagagttcagtgactaatgaggcttctgattacctggtacataacataactaacttcttaatcttgccatgttaatatttatgaaaacttttaaatttttatttgatatgtcctatctctttctcttagcatcattccgtcaatgttgagtgcatattaactgtaattaactaattttccttcatcctgtgtcctgtatgagaacaacagttctgtcattgttaacttattctgtgtttcaaatgtcatatagattatacactcttgttcactcattcttttgattcatgtgcagcactctttagccattgtccattgactagtaaaactcccactttgaagaaataagaataaaaacattatcgattaaaaaaataaattattttttagaatagtaatataacagtataaccagaaaggaatgtccttttccttttcagaggcgagctgctgataacttgagaagacatcaccaataccaagtaagttgtccttgtactatgtcttgaaattttcactaaaataaaatgcagtccccccttcagaactgactcaggaggaaatttatttactcattgagtatcaatactcttgttctaaaatgcctcaggaagttatgaggaacctggtgaagcgatacgttgctgcaatgattagagatgctaaaactgaagaaggcctgaccgaagagaactttaaggtaaccattttcatcttcatcacaagaggcagattgtgcagaatatggatccagatagagcacatttaaaatcagagctggaaatgcagctgtgtgttccagcaagcctgtgtggcttctgatttttcagctgaaaccctacagaactgtaaaaagaaaagaaaagcaagtggtgaaatttcttctcaaaataaattgttttcaaacatacagagaaaagcctagtgcttaatggcattctgacttacctgatcccagagtgagcttctgtttctgaaatttcagcctgatttttaaatccgaaacatttactaactaacacactgacaacaaaaactttgtgtgttctgaaaaactttgatagcagtgaatttaaggtttgcatttaattgtaactaatacacttataaactttctccttgatagtttttaaattgtgtaagaggaaataagtaaaatgtgtgaaatattatatgcttgaatcacatgtttaaaataatttagtttaaaattattgagtgattgtttagagattttggaagaatgattaaggtcaataagatcttacaggccaaaacaaacaaacaaatttaaaaaaatctataggagatacttaacatagaaaatagcaggtttgaacatgagaatgaagtagtgaattaggtaagaagatagagaaattacaaaacttaaagtgcaggtggaaaactagctagaagcccagattttcttcacagccataaagttcaaattgtaatattaaatgattcatgttgctttaggagataggttggggcaggaagccaccaagataggttggggcaggaagccatcagggtaagagtgagaattcagttgtcccaaaagacaagggaaaaggatgagtctaagaaatgctgttagatccgaagaaattcccaggatgtagaggctgacccagatgtagggggaaggtcctctttaagacagtaaacaactgcaagtaactaccaactcttaaattagtctccacttaattttcagacatccctttggacagaaaaatgggccaatattaaaaatcttataaaatacaccccagagacagtgaggtaacttggcagcagatgaataatttggagagaaactgtagtcccagggaaacccaatatactcagctgcacgttggtggcaaagataactcacgtttctttttgcatcagccttaggaagtgtccttcccaattccaataaggaaattagtcgacatcaaaatgacatcaagtatccgtgagagaactgggaattctaaatagaaccacagtagagtagaatccttgtttttaaaaaggagtgaaaacatttctgacccatatatgagacgagaaaatgatgtttccaaatgtttaagtcataaccgaatttttcattttaaattctacgtaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgcaataacccacagaaacattttagctatctttttcaattaaaacaaatgcaatttatttcatgtggtagttgactcctaaaatagatatttttatattcaaaaaccaatgtggctgaaatattatagcttttcataattttttagggtctttagagagggttactcaccaaggacttttcacctagtcctacagtttggctttaaaacacaaatattaccaaattatttcttaacgacatgtaaataattattgtacacaaagcaaacaagtcttcttctcatggagtcatatctaaactccctcaaattcagaaaaactttgtagtgttttaggttgttccagggtttcctttcagtaagtaaaagaagtgtttgtcttaatacattttgatgactgatgatttttaacgacattttgtcaggaaaaaaactcgcccctccagtttttttaattacctatttcagattcaactgcttatcagtataaatatgagtctttatgaataactgaatttcaaaaatatggcaagatttctgttataaaaaaataataaaccataatattgtaagtatcttaaacaagcaagatgattacatactaataatatccaaatgaaaatgaatttattctaacaatctaaatctaagtaaagttgaattccagtattttcaatcaacgcaatattgtaatcaattcaaaagaagtacaaaaaaactagcagtctcctcttttcaccagtaatctttatatatttctttaaaattaaatcactcaaaaatcattattaattttatcagcagatatagatatatagttttgcctataggaaaaacattcttatttcttgtttttctttctattgtttgcaaggtaatttagcttataacaattcactgaactattacaaggaaagtgttcgcaacttacataaaattgatactagaaacttaaagcttaaattttacattgcttgtgtctatttaagccactacgggaagtttcttcaccacataaaattagcatttatttcaaatcaatagaaaaatgctaagttcattttatttcaaaaattactctgcgaacctcagaaattgcatgtgatttatcattggccccaaactgaataatgttatggcactcagtttctcattaccaaacatcaaaaataaggaataacagcaataacaatgccagcctctgttctattcctatacacctgttaacatttatgtactgctctttacagccctctgaagtagctcctgtttttatccccatttcacatatgatgaaactgagaccagcactaactggctaaggtaatacagctcatgatggagctgtgatgtgtccatcagagccattcccttcaccactgcattgtaactgcctttcagaacataaaaagagcaagttataaaacatgcatatacaggggttacaattgccacttctgaagtcctataccttgagagagaatgagtttggtatgcttcataagagtcccttcttctaaagcaagagaagtgtgcaaaatataaaatgtgctgtatttgattctttagactaaattacattaaagttagtagattttaaaaacatatttattatgtgatctcagaactcaatttgaaatactagattttaattttcagaaaagccaggagcactaagcccctgttcactcctaaacctggtttttgggaatttaggaatgggccagatagatttggagaaacacaagcctaaatgaatgcatttactgtttcaagaacacctttatctcaagtatattaggactcagagcaaatcctggggctactgaaatactcatttttttctaaatcatacctacagtagtagagaaattgtaggcctattgttaatatttgggatattttctattaatttctttttgcctctcttgtgcgttgttgttttattttgttttttcccaaagtaaggacactatacataaccatt

SEQ ID NO: 15754 - DNA, 363033 bp, Human
  misc_feature (1)...(363033): n = A,T,C or G
atcctgggggaaaggatgtattagttccattcacttctttgatcaatatcttagtaatataaaggaagtagcattcgtttttgaaaattacttgaattaggagttttctagttagatttcatttcaataaggaattattgttgaatataaattagatttgccaaatgcttaagctgccctggaatgaactttagtaccagcctgctgtcctggactaaatgatatgaccatactgtagggccaatgtatactatttaatgtcttcatctacttaattatcagttgccccctggtttccttaaagagctaatgatgcccaactatttctagtgagagcactttgctactgagagagtcaaacaccaaggtgattctctgaacacattatctgtgtgtgctaggtacaacagctaggaagaggtaagatgatggtgagttacttaaagctcttaagaaatgaccctagtagaatatccataggggttaagagatgaaatttatttcttggcttagcattttggaagaaatcacttggcatttgtcattggcaagataaaaagaagctctgatttctgttctccagaagatgtacttggcttcttcctttctcttaatttacccctatggctctcattttgcctcagaatgtgaaagaataggcttactactttgcatttagttaatttggtgagttcactgtactctcatctctgggctattaaatagttcaaaaataaatatcgcatcacttgtggaatatgtagcatggatctcatttgagctgtgttttaaaacaaatggtaattatttaacatttacatcatacttggaaagtatttcagaatagaactttttaataataagtagtcaagcacataactgggatcaatgggcaagagaaaaataaaattttaatgttccattgaaaggtgtaggctcaggaagagagaaaaatacttatgtgtattttgtatactcatgtgtatttgggacaaacacaggttgtggacgacaggattgaaagtcagattaactggatcaaaattcaggctgcgtactgagccagtctaagatttcaccgaaatctgggagctgctcccactccctggacttttgtgcaaagactggaggaagctgtgaacagcctgggctaggagaacattccccctctgggaggagaggctcgcatgagctcatggggctttccaccgcagacccagccttggcagccacaaagtgtccagcagtgaaacctggcccttcagttctcaagggccctttggaacatatttgactctaagcagaggtcactattccaagagtgactcatgtcttggggttaagtggagatgatgggtgggatccatgaacagatccagctcttcccaatgtggggggcaccagagtgcatagcttgggagggttggtcatccgaagagtcactgcgtgggtgcatcccgggcaaaaaggatgagaaggtgatccactggcttccataccctgggaaaggtgtcagaccgtgaggtcacatcaaaaggtatgagtgtgggtacctccttccctcccccgacggtgggggcctcatctctcggccatatcacctctgtgccttgcacacttcctggctcagactcagccctgtccacgttctcttccaccatctgatctgcccccatctcccaaagactacttgtggggactagggaggtttaggggtgtagtcaagccagatgcaccgaggttgctgcggtgggaagagggcgctgggagggaggaggacctggggcgcagccgtggtgggtgcgccctgccaagaagggcgggggcgacggggcgcgcacgcggaggaggaggaggaggagggagacgggagggcgtgtgagcgagtgagacaagaaaagggagcgcgcccgccgccgccgccgccgccgccctcctctggagagagaggctggagtgaggctgtgcgaagcgccgcatttcaatgaggacgggccgaggcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtgcgtggtttgccttccctggggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccggggctgctggcacctgcctcttttgtttggtgccatggggctttaaacctggagtcaggcgagcgggccctcccaggcttttcgcgttgttagtggagatggagagccagggcggaggagctgggagaggtgcttgtcattgtcagaactggctgcggagcgggaaccaaggaaggagtggccgggcccggcctcttattgtgtgtgtgcttttccgtgtgcccgggccagtgatgtgtgcttgtggatggggtcgattcgtgcgtggtggtggctgcagcgtgggtgttgcaagtacgtttgcagggtctcaagttccttcagggacagcgaggctgcctcatgttcaaattagtacctgcagtgctaaaagcttgcggagaggaaatggcattttttcctcctagtgggagcgcacgcacagccccgcaatgccccacaaaagaggctgcttttgaaaaccaggtttgcgcggaattgctcctggatttggcaaggagatgcttggtcggtgagagagaagatgaaaggtttcattcaaaccggctccctctctgctgcacctgtgagtgtgtccaggcacggtgcacacacgttcagcgaccacactgcaggctgttccgtgaatacattttatgactgttcctaaatatattgcctttcagtgggaaaggaaagtaggacagcgttttaagtatgaaatgtcacatggatgcaggtcagaagggattttttaagagaggtcatatagaggaaaattataaaagatatgcacacaccctgtgatgtctacgtccgtggtggtgcacgggcctggaaggtatgtgtgcgttttatttcatgccagtccacctgaatcctaatcccacggttaaaatatgccttgggacttccaggtccagcatctatttagatgtggtagcatttatgccatttttttcttggtatatatgtgtgtaaatttctgaaacaagaaccatgtgctcatctagagaaggatgaacatagattcctcaaaatggtgagaaatcccaccgagaacaatcagggatgttggtttcttgaaatggcaggatttataggaaaagctctgatgagagccagtggcccttcttacctccagtgtctgtggtcgctgtggctgaggtgctgtggttaccatcctggtgccactgcacatgtgcactcaggcccttggccacctatggtctctgaacattgagctgtgtgttctcgcagccttcctgtgcagaaagtgtaaacctgtggaaggccagtggatcttcagaagctcatgcatggttcaaatgtatgactaagccaaggtgagggaaagaacacctattttgttgccacgaataattaccagcacactagggtgtggagtgtgctccatttagaggtagctgtagccttgaaaatgatttcactctgagtatggtttcttttgtcgacaccattgcccacttttggacagattcagggaagggaagtaaaaggtgtagccctgccctggatgaacctgtgatccagtttgaggaaatatgcaaataaaatgaaacaaagtaaaccttttttctattttaaattgttcttttcttcttttttcatctggtgtgggaattcttggtcctaaaagcccgttcccccagggaattctaactattgccaaattatttggcctttgccaattgtcagtcactgagaattcgatgtgcactctttctggtaacagaactgtgccatccttccctatggccctgcttgttttcttttagtttatatcaatttggaaggaaatccccaaactcctagtgttgggagaatgatcactgcctttaagaataaaacacaaacttcaaaagtgagtttggcctttataatttacaaaatgttgaagaacttagtgagttggtgtgagtactgggagtgtcttccactccacccccaagacacactcccttttagaagacaagagagctcactttaaaaccatataaattaaaaagtaagagcagttaccaatatcctggacaaaaattggttctgtttaacaactaatgcctacaggactggatatcaagggatcattgttttaaagttatctaacatcaaaatcaatgaaaccagttcagagctgcctatatataactgtttttgaaaaatgcaaattctgactactatgagttattaagaggcaagaaatagttttcatatttggagggaaaaaagtacactgaactcattaacactccaggtttaaatcacacttcatttctccctccccagaccttcagtggggtcagcaatagacccataagcaggtagatagaatcaccaacatcagaggcctgctgaccactgcttcctctgtgtgcagacgaggtctggatcagttatgtggcctgtccaaggtcactgagctagttaggagtgagggcttacaaaatcctgcttctcatgctgaagaggaaccagtttcaaaggagcaagggatggaaaacaccagctttggagttacagtaaatctgggttcaaatctcaacccctcagttataattttgggaccctggataaattccatattcacctgaatattaataatattacctaccttgttggattaatatgaggtttagaagagaatttttagcatattatacaactggttgatgagtaatagtgtcaggtacctcctagaccttcagtaaatattgctttctttcacttcatttctggagtaccaaatctctagtcatgctttcaggtgtgaaattttagccactctgaatggatcagaggtcagtttactgagggccaaagaaaggttggggagacagtggtgcattggtgagtgttcactgaccttcagaaaggtgatgtccatctaatatggtgggacttggggagtgcttgtaaggttcttgctccaaattttccattttcctgatattctatttcaacatgcctgaaattttgtcattaaagtgtctttcctttgaatgctttggtctttccactttctagattgtcttgttaaaccacagattcccctgcaaggctccacaaacctttatcaaccaacccctcagcaaggatgaactggtcctccagtcagcttgctgtggggaccagggggtacagatgtacctttcaaaaggtcatgagatggagatcaggaagaaagcaggggcctctcttgccagaaaggaaagattctattcctgctagctctttatgtgtcagggccaggaacacaaaaacagattttattaataaaaaaattagtacttatcacatgtcagacactatgataagaacttcatgtgcatgaatttatttaatagttaatactgactgtgaggtaggtactgttctcattcccattttgtggttgaggaaatcaaggcttaaagatgctgagcaagtagatttttcaagcttacacagctagcatggggtcaagtgtaaatcgacatctttaagcctcaatttcttcaatcacaaagatagtcttaatgaaaggaagaaccaagaaatgtacttccaaacattttttcctttcttgttgttcctcttccttctcctccttctcttcctttttcttctttttttaaactcaacttttctgaagtactaaatataagtaaatgaagtatagtgaatttgcttttaaaaatattgaatgtgtgaatatgttggaaaatcttctttaagttggtccaacctacagattgatttaatttgctctccatctggccatggggcacacaaacattatgtaaaacttttacaatctgactgttatgctgcctgccctctctttctgtcccagcccaccatagctacttctctttcactgtatgatgatatgagagcttattttcttcctgctaccaggattagccctctgccctgcaaggagcagtgggctttggagtcagggaaacctggaacagagttgctggtacaagcatttctcaactgtattacttggagcaatttaggggaaatttttctgtgcctcagtttcttcttttgtaaggaaggacaatactttggaaagttgttgtgtctattgggaataatatctgtttgaagcctgatgaaccatgggcaacctaggagctgcttctaacaaatttgtggctgattaataagctgtttccactgggatcggcctcttctgctgacagcgtgcagaggagcctgtgtttattttgtgggaattcacatccctttctctttctgtcccacttgataactcatattaaatgtgtcatcagttaaagcaatatttccacccagctgttctgaagcagaccctttgaaatcatgatctcaaaataacatcatccccaaactttgggaggccaaaggggttggggggcgggggaggatcacttgaggccagggattcaagaccagccaggacaataaaacaagaccctcatcactactactaaaaacaagcaaatgaacaaaaaatgaaggaaattaaccaggcgtggtgcaggcacctgtaacctgtagtagtcccggatactctgggagattgatgcaggaggatcatttgagcccaggagtgtgaggcttcagtgagtacttcagtgagtgccatctcactgcagcccggtgacagagcaggaccctgtccctaacataaaaaaaacaaaaacaaaaaaatatatatatatatataacctacatcaatatgtgtgtctgcttttgtttctggggctcgtaggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggtgagcgctgtgagataacccccacgtgaccctacaggttccaggctcagatttccagtgttgtagccgattcgcatttgccctctgacagttgacattcagccttatggctgtgatccttatagtttcagacatacgaatgtgctattgtgtagagtaaaaaggaaaaaaaattaatggtattgtcaggtagcttataataatgtgctaagggaaaaagtccctaattctacagcattctctattttctttctcatacccatgctgcattaattttaaaagtccattttatctcttcaatctcatagtttatattcgtttctaaatgcaaattaaacttttgctatcacgatatccgaaagtacttgaattgaaaatgacaaatggatcatgaaattttagagttgaaaggaaccttagatagctatcaaacccattaattttatctttggagtctaaggaccagaaaattcaaatgacatgtcggtggttacgtggtaagatagtgatgaccctggaccaaaacaggttttctgacagctcgttccactgcgatgcttccttttgagtttaaaggattattgtctttctctgatttttgaggatatgcagggactaatctgttcagtttaattttttaagtccaatttaggttaatagtcattatctgttttagacatttaatgtggaaataggactgtttgcgtccacggatgcagcctggtatcttatgcaagcagagaaggtcaccgactctgggctacacttgcctcaggactgaccctgtttgaacagggcataaagcctgtcattgccttagaaatcatcgccaattaaaatgagttggagaaaaaagactgggattaaatgtataccaaggtgcaaaaaaagctagcagatcctttttggagggttgatttttctgaaattgagatctcaaggccctgatgatgaagaagtagatggcacaaaagaatctgggaaagggaggttggatggagtgttggaagagcttgatttcaccttgagttcatttttactccagaactatttgctcaggccgtgtaactcaactgggtccaggagggatgccatataatccctccctctcttgtgcaggtagcaggaagcacccgttgcagccccgttggagttgggggctgctctcccctgaccgcacactgacagagccctcttgtcctgctttgtaaccagtgtatgtatgtgattcaaggctggggacttctccctttttgcttcccttcatcccttggcagaaatgccagcctgatcacagtgtgactggccttgagagcgtgcagaggagcctgtgtttattttgtgggaattcacatcccttttcggtgacttgacatgctgccaacatgcctgtggacttggcctttttccttctattcagagggtggaacttccagtaaattaaaggagaagaattaacatgaaattttactgtttcagctttaatttctgtgccctgtcctttgcatgacctttggaaatccaaggttaaatgaaacatttggtggtatagtctaggggatctggataaaagttatacgcaaagtcaggtgcatgaccagtcaacaagccgtccctctgagggccggtagtactgtagggaaaaatatggcaagatctcaaagcacatcctaagacagccatgggttgacacctcactctgttccagagtcacttgtgtagcatctatgggggttggggtacttcaatcagtttcccacccagaaatgatctttacttagaagtggccgaagatactccaatgactcccatccaccaaggagagggtctgggaggtggtagatgacagtactcccttcacatctagggaccagcaaaattatggcatgcttgtcaccatcttctttgtcttttactgcaaaataatgctttctctgagggactgatgtcttgactgaaggtaataatgatagctctcagttattgagcatgtgccaggcactggccaaatccctgcatatatgaatacatttaattctcacaatgatcctaggaggtgggaactgttatccttatattaaggtgagaaaaggaaggtacagtgtggttaaatgatctgctcaaactcacaaagaaagaaatggtagagttaggatttgaacccaggaaggctagtgccaaagcttgagctcataactacctctaagatgctgtgtgctatgaattcaactactatattgagtttttcccctcaatcaatgtgaagtaactgccgactgaatattctgatgtttaaaaatgacttttttgggaaaaaaaaattatctgattgaatgaatggtaactttggtacagtgtgtgagttcaccatgttggctgcatttattttttgaattttcatttaaacagattttttttctaattcataacactgacaattagcatgcagctgcacttagtgtttaaatagctggaaattcatttagattcgcctctttgtcaattacattttttgcttagtctgttaaaatgcaaaccgttggttcatattcatcattaggctcatatctctgactttacatactaattttatgtaaacgtcagtgcatgttattagcttttcatttccccttccaatatgatgatgtttgagttttaaattaaatccttttagtgggtgcagtggcaagtgtattggacttatagttattttcttgctctttctcacttgctctcagactaaaaattctgaattacaatatttgtgaatttctttatctatgacagtcttgtggtcactgtcactgttttgtttttatctatggattattatgcctaagtgtggtttaagcatgttggtagagctagctgtatgtatttagctgagccaaaatcatatagtcagtgtgaatgtgtgtgtctatgattgtatgtgtgtcacctatgcacatatgtatgtatatacacacatattcacacacatacacttaagagcattccaaaggtgacactcttgtttgctttcaaaatggccttaatatgtttttttaaaaaaatcatgatgcttaataaggaaagttgaattgcaggcctatttccgcaagtgattcatcttgagacttggcctcatttcccccaattttgcaccatctatattctactgtaggtaggtaaatgttgtgatgataaataaaggtgtcacatttaaagcctttgaactcttaggagaaagatgtaatgtaaacctggagcattgatggattgactgatttgtccttcttttaacatcttatgaaaatgtacatgtgagagggccagaacattttctttaaacattaagataaaaactctgtagatatgtaatcttctggatacaagtaagtgaatttgttcatcagatctgcgctattagagatgagtccctcttcttctttggttctcatgtatgccttggcttttcactaaccctgtatggacgttgcctgactctggagctgcagtttgcataagggctttttccaagtttctatcataatccccctctcaggattaaacccatgcttcaccccacagttagggaatctctttcctaccacagcctctgggttacccatcttttcctattccctaatagagcatcctctactttatttccctatttcactggctttctctatgcctctccttgctataatgaattttttaaaattaatttttgaatagatataaaatttgctcttcctaaaattcctcagaggggaccactttactagtttctttttcttttcttttttctttctttaaaaacaaaagcaaaaacaaaaaacagggttttgccatgtttcccaggctggtctcaaactcctgggctcaagccatccacccacctcagcctcccaaaatgctgggatttcaggcgtgaggcactgtgcccagcctactagtttcttgagggtcctctcagagataccagtgcatgtgaaggacacatatacagcaatgcccccttatcctggaaggaaatacgttctatgacacccagtggttgcctgaaactgcaaatagtactgaaccctgtgtatactgtgctttttttcctgtgaatacatacctatgataaaggtatgtatatgatgcaaggtatatgataaagtttaatttataaattaggcatggcaagaaattaacaacaataacaaatacaatggaacaattataacaatatactataataaaagttatgtgaatgtggcgtctctctcaaaacatccttttgtactgtacttgcccttcttgtgatagagatggaagaagcaagatggcgtgagagttcatcacactactcagaactgcatgcagtttaaaactcctgaattgtctctttctggattttttcatgtaatatttttggacctcagttgactgcaggtaactgaaaccatggataaagtggggcagtactgtaatttgcccagaaggtaactttttatgccaacagttctgcaccttgctttgtgtacttaacaatatatcctgaagacctttccatactggtacatccaaaactactgtgttcttttactgacttcatagtactcctttatacaaagttaccatcattaatttaaccagtcttttatcaatatgcttttaggttgtgttcaattatttgttattacagacagttgtgtgatgactatccttggatagatgttttccagtcatgtaggagaatatctttaggataaattcctagaagtaatattgttgggtagagaggtacaagcattaaagttttaagcactatttgcaaaattccccttcataaaagtggattcagtttacactccaaccacttatgtatgaaagtggccgtttctctatcctcaacaagatgttttgaaatcagatgtttcccattaactaacccattaagaaaagaaaactgtatgtcttctcatacagtttttcatataattttcacataattttcatcttttcatgtgtttaaagggcatttgtatttcattttctgtgcattgcctctccatcatttatgatcattttcctatcaggttagggtttttattaacttgtagaattttttttcttttaaatatattaactctttgtaataatgattgagagggcagtcatgtgtcatttaatagtgtggatatgttctgagaaatgtgttgttaggcaattttgccattgtgggaacatcatagagtgtacttacacaaacatagatggtgtagcctcctccacacctaggctatatggtatagcctattgttcctaggctacaaacctgtacagcttgttactgtactaaatactgtagacaattataacacaatggtatttgtgtatctaaacatctctagacatagaaaaggtacaataaaaatatggtgttataatcttataaccaaatattgtggcacatgactctattttttccagatttctctttagtgacttcatttattgtgttttttgccgtgtagatgtacaaaacaattatataatcaaatgtgttattctttatttatagcttgattttcatgcctcttgggtcctttgtacactgagatcataaagccatttttcctcattttcttgtggtatgtttatgttttcacttaaaaaatattttaatggaagtcatattgttataatatgtgagacagggattcagtttaaccttttcttcccccaggctatttgcttcatttctttaacattatattttcagattaatttggacttatacaagtatcacagagataggaagttcctgtttacccttcacccatcttcctgtaatggaacagcacacacaatcatggtgcaatgaacaaaactaagaagttaactttggtacaatacagtagttgaactacaggcctcatttggctttccttcgtttccccactgatatccttttttcattccagaatcacacattgcatttagttgttgtgtctgcttctccttgaagctatgacggttcttcagtcttttcttatctttaatgaccttgacagtttgaagaataccagtcagttatcttgtagaatgtcccacagtttgggtttgtctgatgattagattgatgttatgcacagaagtcatgttttgtcctcagtacatcatttcagggggtacatgatgttgatatgtcttgttggttacctgtgatcatttggtgaaggcagtgtctgtcaggtatattcactctaaagttataattttcccctttgtaactaatatttcgggaagaaactttgatgctgtgtaaatatcttgtttctccttaagcttttgcccatgaattttggcatttattggtggatcttgcctatagcagttattactatagtgttctaatggtgattttcttttccctctttactttccaaatttctaaacattactgtcctccattttcctgtctttggatcatccactgtgatctcatcaactgacattattttaaccactcttttaaggcctattactcctaaatcagatctttcttctgcactccaactacctggatatatagaactgtttctcttccttagttctttaaagctcaacatgtataattgtggactcattcttttccattttccagaattcattctttctctcatgttccagctcttattaaatagtgttaccacctgctagggtcctaatgtttgggaccccctcaaaattcacatgtaaaggtattaaggggtagggcttttggtaggtgattagtttatgaggctggagcttttatgaatgggattcattgcttcatgaaagaggcctccaaaaattgccttgccccttcaaccctgtgaagatacaatgaaaaggcaccatctgtgaggaagtggggccctcaccaaacactaaatctgctggtgtcttgatcttggacttcccagcctccagaacagtgagaaataaatgtgtgttgtttataagcctccagttgatggtcttttgttatagcagccaaaggactaagacatcacataacttaacatcacccttaacgtctctctctcttaatctctcaaatccaggctatcatcaaattcggttgattctgctaagacatttctccaacttgttttctcttctccattcctatttctgcttgctggaaatctccaactgattggcttctaggaacttcaaatttaatatgtgcaaagtcaacttaatttccttctttactgcctaatccaaacctgttccccttctaattgtatctattgtggtgtatgggaagtaggcccaaagagaattttcagtgtcatcacttcagtgtttttgttgcctcatattccctcggaacccacatccagtcaattgccaattctggctggttgtatctgctaagtactcctcgtaacatccactcctctgtccctagtgtggatacgtaacattcagttcacctcctctcctggtcggctgtgatgactttctaggtgatatctggacttctctctccccatgttcacttcagcccctcattcacactgcagccagtgcaacctgtttatcacccagggctgatcatgtgtaaaactctgaccttgttgcctgatgtggttttatctaactcgtctgtctatggaatcatttttatttcatttttttttgagaaaatgttttaatatatcagagaatatccctttctgtactgtgcaacagagcatattattattttatttttatctggaatgttctcccctctcttttttgtcaatggtaatcttacccttgcttccaaggccagtgtgaattccatttccctttcatagatagcccagtgggaagtgggaagtgacttctttctcctctgaattaggatggcctagaccacttacttagcaattattacttactgccttgtggtggaatcttttcatagacacatcttgctttctaacctatttgaagatagtctcctgacttaggtttctttcccttcccagagtggctaagttaggtcttgcacctatgactcaggatttaggaggttgtttttaatttttaggtttcattgttaatgttgtgtgtgcttgtcacagttttgttatttgttgttttgttattatgcaaaattttttagcaatgagattatgggtataaacattttcgtggctccaagtagttttccatgttactttttaaaatgattattaccattttaatgtctgtaatggtgttttctatttatactttattgtgtgtttatcctttgtcatatattttagcaccttgtattattttgttgctgcaacctcaataccactttattttgattattcttttgttgcaattataataggtacaagagtacatcttaaatctgctttaacttgcatttcttggcttactatttaagcaccctccatgtgttttccatatattctttgttttgtttttatcctttgccatctatttttgtaccctgtatttttgtaaattataataagccatgcttattataataagaaataagtaaaagagtctctacttttcaatttcaaaaagtttagatctctcattttttttttccttaatgttgtttttctgttgctttggatttgagaaggtgacatgtccacaggtctgacatacacattcaagttcattttctataagcttacttttatgttctattgtgttacggaagacttctgcaaaagaatgacccataagcacctttgggaaatattttttcttgcctttaatagctcaatgaaaatcatcctaagccagtgacttccaggtagattatgaaatgttgctgtgcgtatctgagttgcctcataaaatgtaatatccagaaggtactttacgatattctattctgtaaacaatatttcatgtaatttaattcagttcagttgcagaggtttcaatacatatttgagtttttcctagattttgccataactcacaataatgaaatttaattgccagagtttttaatcagaaagtttatcctctggaaaaatgaaatatattacggatatccttcacttaaggatgcttttgactatgccacatattgatcttaaaggaagcctagaggaggtaacaaccagctctagtaatgtgaaggatggagatgaggtcattttcagactgaagttaagtagtatcagaactggaatttactcttagccaatgaaaaaactcccacaataagaggcaaatttgtagaatcccccaatatagagtctcgtggaggaacacttttatagctgacacactgcaggcccagtcacccagggaacaggtaccacattgtcagttttcagtagtgcccagggaaccattttaagtggaaatattctaatttcataatggaagcgaatggcaaagtagaattaacttcacagatttttaaaataataaatcttattagaggaaatgtattgttatgctttgaagaataatggccagtatgatcatttaaaaatacaggccagtcgcggtggctcacgcctataatcccagcactttgggaggctgaggtgggcggatcacttgagggcaggagtttgaggccaggagggccaacatgatgaaatcctgtctctactaaaaatataaaaattcactgggtgtggtggtgcatgcctgtaatcccagctactcaggaggctgaggcaggagaattgcttggactcaggaggcagaggttgcagtgagctgagatcacaccactgcactccagcctgggtgacagagtgagactctgtctcaaaaacataaaaaatgaaacataaaaataaaaatacataggtgattttttacacaggaactcttcagtatcttaaaaataatctagtatgcttacttagatattatttcatcctccaactttctgaaaatactaaaatctttcaggaaagaaattaccatattctgacattttagtattagttggatccaaacataatttcatgcttatttccttacttttaaaaaaactgtcattttctttatctctctctctacttaaaaacaaagattagtttttggccttcattaaatgccacaacaaaattcagccagatgctgcttcagcatcttgctatttgttggagtgtcttagacacccagagtattacatttcaagtgaagaatcagacttatcatagaatccttagggcttgaacaaactgaaaaaacaaacaaacaaacaagaaaaactggttgtatgataaccaaccagaaaatcatgatgtttgcaatttctagtaccaccgctaagagctttgcaatcatgccatccttgttcaagttcacctataggaagtaatgcaaagcttccaaagcaaattttgggctgttttgctcaaaaataccttgtgtttttttatttgtttgtttgtttgtttaagataaattcacttttatttcattgttgcagtagaagttataccaaaagacttcggggtgtggggtggcttagtgtatgtaagaggaagtatactacagtaattgtaagcttactttatcttgttattttgtttgttttttcgtttgttttttaaataaagagagatgggatctcgctttgttgcccaggctggagtgcagtagcacaatcatggctcactgcagcctcatccacccaggctcaagtgattctcccacctcagccccccaagtagctgggactacatatgtgagccaccatgattggccctgtcttgttatttttaaatggcacttaacacacatacctcatgtcaatacttgaatgcactctaaaaatgattattttaacaagattataacttatctcttaactctcagtcacactaaggaagagattgaacactggatatctagagctacttgaccaaatcaaaactatgtattcttcccattcagaacaatcacgtttgttaatttataataatcgatgataattagcccatgaattgaaaagctattttttacaaaatcagaaaatacaaccaactttaatttaactgcattaaggcgggaaccacatctcttgtggcagagagaagttcagtgttatgattactgtaaaaatagttaatacatagatttaaaaagatttaatggaaatttcttttcatgataaaatggaaatgtattagcataaggaaatcaatggaaatttattagcataaggaaatccatctgggcctttcctgaattcctgaatagtgtcacagactctaaatgactgtggtgtgtgatcttggatttggtggcagctccttctccttcctttagctgttgctttcctgttagcacagtatcatctgttactggagtctcacatccttctctaagattctcattccagtctttaaatctgattatccagcagaggagcctcacatttacagctcagattaaacacatatttcttctgatcattgttgcttgaaccaaaccagcaacgccttctcagtgtaactggagaactttcttatgcttttaaacattttcagggtgctttatctaagaagatatttttaaaaagtgtttattttctcttttaacaaactcactccatgttgctatgttctttaaaactgctccctcttctaatttaatatatttttaaagtttttgttgaaatgtaaactgctctctgtatctttgttttgcttttagttattagcttagtatagaaacttataaataatcagacaattgcatatcttcagttagcacagaattctgacagaggctagctttgccagctcagttacatgctgtgtgtctcactggggagtgttagggcattctcacattgacatggacccaacgtggtgtccactggtaactgttcaatataagacctgcttaccgatttctagtaattttgtttttgaatttttctttcaggcttactgcacgattagggtatgtagcctcaggtcattttcactcacatagcaggtttgtatttgagatcactttgatctctatcttctaatttgatcttcagaaaaacctaatgaggttttgttttatagataaataaactaccacccagaaatctgagggacttgtccaaagtcacatgcttggagaggccaggtcttgagcccgaatttccagttctctcttcccactatcatgtgcaggtcatcactccatgaaaactcccaaaacactgctgtttctatagtacccaaatatgcctttctcaggatttaagaaaatatcaaaaatacatataagtttttgatatttacttaaatcctgaggaaggcatagctgagacaagtcatgatctgccaggtgaatagaaatggggttggttaaacttgcactattcatacaacttctagtgaggcataatgtgtatgtatacacattagagaatattttaagaacatctgcaaaacaagtgttcagtaacatgtataactgctctttttaacttttgaaggcctgcttcagttatttttatgtgactacttattctttggccttggatgcttgcactgtgaatttaaaaataatacaaggacttagataaaagtcaatgggctgtgttagattaggcctcggtcattttacctacaattatgaaggtctttcagcatttttacctattcctagttacaaaaacttattaacacagaaaaaaagccattacaaaatctttaatttcaaaaggctttgacctaactttatgaaatatgtatttagaattcgtcattttacaatttgttgtctcttggttcatgtttttcttttttgtgtgtgtgatctacatctacttaatagtctgattattttcattaaaagatttcctgctaaggagtcacttttaataaacatttacttatatttattttagagcccatttttgaagctgtagtttgtatgttgaacacttctaaaacctcttacttatgaacaagtatgaattgaccttatagtatgtgtggatcactgtgattggcactatatagatgagagaaaggaagggtgattatttgcttgcttttggaactttactgggctttacaaaatctttagcatcaactctcatcaaattcgtaaattatatgactattttaagatgctgtattctgattcattcttagtgtttaaattatctcaggtagcaaatggaggtacttccaattttgaaattttctgcagatttaagtatctctaattcccaaagaatattttctattttaaattcactttcacacttctctaaggtcttttcaagtagatcagcatttctatcaccgaccttaagatgaggaaatggaggaataatgttttgttttgtttttccaggatgtggatctgttgctgacagtgccagattagcaatcagaaatctttctttttccctaattattaatcacacttccattgtttgaaaagtcagggctagctcttgcccctaagcagaaaaggcaaaagagaggataagtaggaaaaaagaaatgggcatattttagtataaatttaaatatatttctctcttccttaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtaagagacatattgtgatgtgactttgactttaaggcaagaaccagggagtcggagggtgtacgtggctaaagcatacattttgctcaagttgttaaagggcctgggtcacttgatcaacaaatatgtacttgctggccctagaacagtcagaagtttgagttgagcaggattattcataggaataaagtaagaaaaaaatgcatatctttgaagattaaataattactcagtgatttctacttgttcatttattatttgcttaacataatgattcttttctgtcatctgttttcagttttctcatagatcttatagcctgaagaatgaatgactgaggtgtgaaagtaaactctgaccagtagggaaaattctaacttatttctttgacctaaatattttatgattttaagtctttgtagtgttcgctagtgagatttacttacattttatagattttaaaatatgtatctaagaaatgacatatttccatctggatagctttaaaggcatatttctagaatagtacgcatcttgtatttttcagtgttaaaatgaaagggaggtttttcagctacagaatgaacatcagttgacttggatgggtggtcattttaatgtgagttggtcagatgaacccaaaggaagcatcaccttttattgtcttgggtggactatttttgtacaggtttgacagaaccttgatggtgagttgaattaaaaaacattgattagggccgggcacggtggctcacgcctgtaatcccagcactttgggaggccgaggcaggcggatcacgaggtcaggagatcgagaccatcctggctaacagggtgaaaccccgtctctactcaaaataaaaaaaaaaaattacctgggtgtggtggtgggcgcctgtagtcccagctactcagggggctgaggcaggagaatggcgtgaacccgggaggcggagcttgcagtgagccgagatcgcaccactgcactccagcctgggtgacagaacaagattccgtctcaaaaaaaaaaaaaaaaaaaaattgattatatgtacagcatgatttgctagtcattcagagtttaccagattatacttttgagcacactatctttgctggaagtttagtttttaatgtggtgctatcaaaatgcttttttaaaaaattttttttgagggataatttgaatgatttgtatgtatagtaaatattaaaattaaaatgatccatgaattaaaagattgatcttattaaatagaagactcctccaagttcttaaaggctagcgcattcaaactttctgaattagaaatagatgctaatcctagaaagagtattagtcatgaaagaatacttcccttagggatccattcagatgctctaaattataaaattcattaggaaagaaggaatatgtgccagttgttcatttgtatttaccatcttttgcttggcttataacccttgccctaagtaatatgcggataaggattctaatggatgagattctctaatgaatgagacttagtcttctatatttaagagtctgtagcctaaatgtcgtaaatctatcaatgaccagaaagttcatgctggcttgtgaattatagtagcaataagatggcaaacttcacctttacacattttgtaagcccttcactggctccatttctaatgagttattcaaacatcttgtagttctgaattttcatatattgaattttctcaagatgggagttcatctattttcataaatatttacctattcaaataaatatttttataaagtgtctcattagagcaaagaatacatatggataaatgttccctctccctgctgcacttcagaattttgggagttccaaaatgctactctgaatctaaaaatcggctttaatgactttagctaaaatttgccatcagctgattatttaattttgtttatttcaggaataaatccctacaataggtatgatgttctcagttgttttcttccttactgaatttgtctagaattaatatttgataatggctagtttactgtggtttacatgtaaataatccaaagtcatgggacggaatccgaggtttaatgtcaaaaaaccaggattcaagtcttggctcagccgtagattccttatgtttttagcaaaacacttaactgagcttcattatcctcatcagtgaaacacagataaaatgattacctgtgttttatagagtgctgtgggtcaactatgatgatacatgcaatagcaattttgaactataatgatgatagctttattgagcattgttcaaagtgctttgcatgtattagcatgcttaatcctcataacaacttgcttattatccccatttaacagattagaacactaaggcacagaactcgttaaaaacatgcacaagaccacacagctacgatttaaactggtcttgctccagagcttgtgctggtaaccactgtaccactttagattatgttaaggcaccaaactgatgtaaatgtattgagaaagaattgtcaagggagtaatttgtccaaagaatatcatctgaaacatttctgctctgtcctttttttccctgcagtcattctgctgactgttgtactcaactgttgttttgtcaagcgttcagtttgctgctgtggcatttcccctagtgttggcatgttctcttcatagcaggatcagtgaaaagctgcagaggaattggatgataaagtggaaagaacataaagacttattcgttgggttcccagtgagaacaaagatgcttcctcatggaccccaggagtctttagaatctttttggctcaaaagagaaatctgtcccataagcagtttgttagagtagaatttttgacaaccctggcagagactgaggcttgataagcctctgagaataaatcagtttcctccacgctgtcctgtggaataacgcttggccatagtggggtggcacctgcactgctaccatcttggcctgcctgtggtggcatcggggtccatatgctgccaacaagatgccaccctaagattacttgtcccacctttttaaaaaatagtttaactgaaccctcacatcaactccataaacaatatgggaattccagtgcccagtaaagaatttcatgtttttgggttgaggaaatagaattgtttaaaaaatgaattgcttgagtgctttgagtaaatgcgtagagaggaagatggttttgtagattgccttggggcagcctacagatgtatccatggcatgaaaactgttgacgctgggattttggacaatggaaccatgaaagccggagcctgctgtttaatatcttacccagaggagacggacaccggagggcacagaccacatgctgttctcacttgtttctaccaccactccttgctcagttgcctctcgggtttgtgttagccctaagcaaagagttcattgaacagtactttttttgatgtttttagactgagataaggaaataaacgttttggaaatgctgcacaatctagaaaagattttgcaggaagctgcaattggccaagatgaccgttgtggttcataagcagcctatgtgtgagcaaaccctttctaatgatttcaactccattctttattcaggggcactgaagcttcagcaaatggttgccccgaccttcctcctcttccttgcaactttcagggtgactgctcaccaggtcatcagtccttttgctggcatggctggcagttcaaggaagcacttaccatgccttaatttcagtgatgcatttttttttttttaaatctgggccttggttaaagacctccaaagaagaaaaagggacattttctagctaacagttaaaatcatgtcccctgaacccatgtccaaggggaggatctgcaggatcttagagtctgagagtctcttcctcttgcccaagtccaagctctggatgttggaactttgctgtgggttattcacttaacctgccaagcagttactcccagaggccatttggagtataactattttttaagtgcttaaaataagactaaaagttaccagatttgctacaaagatacccttgcatatctcctgactccttttatggaaaagcaaatctggctttcttgagctgctaaatctgtggttcttgaatccgtccttagaaacatagaacagctagtgcctaagtaggtgatttatactataaagaacatagatagggcacttcccaatgatccccttcccactgaaatacagcaatgacaaactggattgctctttaagtagaaaataaatgcacatccctatcttatctacttttcaacatcaaagatctgtacaacattgcagcatgctttagtgaagagaaaaaaacccagagatgttatatttttatcttatagacatttcacataggccatgtactttataaaatctaccactgctagtgagtcgagatcgcgccactgcactccagcctgggcgacagagtgagaccccgtctcaaaaaaaaaaaaaaaaaaaaaaaaaatctaccactgctagcatgctagagtgagcaaacaatttattgttttcccaatatggaaaacattaggaattactcagctgaagtatgggtagccataaactgatttcgatggtaagccatgagaaagcatcataactgccattttgaggacatcccagtagctgttgataaattaatccatcattacatcttctctgtatcttttgatcatgaatcctcattgcctgttataaagctcaaaagatgcttgtaaatgagtcaataattgccgccatttattttaggtgtttaatataggagtttacttgattacaggaaatggtaatgatgattaataggaatctattaatcagatatcacaaaatggtctttattttcttctttttggcctttaatatctaattctaatctgaagtaaaaataatttggtcgactcttgggtttagagtgcttaagatatgtcttcctcttacaagttaaaaaagtggtacaaattattattgcatctgaccttggctataggagttgataagcatagaaaatgtggaaactagaggtttccagacaaaatgtaagaaatttagaatctgataggatttatttggaatgggaaaggaggttttctgtagctattagcagcagtggtatttttccttttttattagtagaacttttctgtgacagttctaattaacttctgcaagcatattaaaacccttcattcttggtataaagaatgtgtactattgatttgctacactacctatgtagcaaaagggaatgtaatactttttagttttgtttgcgattggagtaaaaaaacagttgatacaagtaatttagcttacactttaaaatgtcaaattaaaattctctacaaaagctcagagcacatgttaaaccatcctcatgatttattagagctatgaattgatggaaatagatgatttcaaagaaaaagaagtttaagaatcgtaatgacacttcacttacagaattaaagtgttcagaatagaatgtactattttaggtcacatatccttggtcaatatttaggactcatgagctatacctgtccttatgtagatgttagtgcctccaaattgggaagatttaagtccttttttttttcactttgagctcctctgaggatgtgatcaattatgggtacctgcagtgatgtatattttaaggcttagattcattttagcaaaagttagttttctgtaaattgcattctagctcgctgtaaaatgaattctaagttctcttagtgttccactgctgtactgaagataggttttctaaagcccttccatagtgtgctgagagcatttgggggacgtttacaagtctactggctttgtgattgccttctggtggtgagttctcttgcttctatgacagctggagccctgacccggcctgtgagccttttctgtctggcaggagcatgttgggatgatggaaagaacttggactttaaagtcagctggtcagtcagttatccctgcaacaaacaaacaaaaaaattcagctgagcctggactgagatttcagtctggaaaatctagcttgtggtttttcatccaagcctggaaaattaagttagcctacccaacttactgattagttaagtttaaaatttctgtatattgaatttacttataatgaggaaatttgcttatgtatgctataaattaagcatagatatacatgataacatgacagagaggaaaaacattagttccatagaattatagatgagttcaaatctgtcctctactctgggcatagtgaaatttatcctcctattggaaatagttcacaccctgataatcctcagtttcatcatctgtatattgtgaataataataatgataataatgcctgctctataagttgtcatgaggactaaatgaaacaattcacatggcaaatttagcactgtgattggtacccaattgttggtagttgttataatggaaaagctgacacttaacaaattttttttggaaaaaaatcatattttaatgtgccaaagggactcactattttaaattatccttttataatgactaatcatattttcctttgtaaatgtggcttttcacatggaaatgcttcatgatataataaaaagagcatggaattcgaaatgagacacttaactaatacaaagtcaaatcctgacttgaatactcattagtagtgtgacctctggcaaatcagttaaactctctgaatctcaatttcctcttctttaagatggcataataatgcatacctcataatattggggtgataattaattgacaaaatatgtatataaaggccttggcttgacacatggtaggtcctctaaaaatatcagtccttctcccttctgttctcatattccaggctttcttaaaactgtaagacccttgtagttgtataataccatgaatgtagaattggtcattttgcatagtttccattgcaactgatctgctgtacctgaactactaacaactgtatttttatcatcccatttattgtcagtcagttgtgaatgcgatgcagatattttattcactttcttcttcaatggtacaggtcattccttaaaggcatctttctattggcaatccatcccaccgagaaagtaatattattattagtatcatttgttgaataccttctctgtgcctggcattggactcgttgctatatatatttatattgatgattacattgataattgaaggtaatctcactgaaccccagctctgcaaagcaagaacctactcatttctcaagattcagctcaaaggtggccttgtctatgaaatatttcctatcttccccatataaaattgacaactcactctcttggagcctgttcactgtacattgtatgtagccatgcaaatcttcattatgctggtctattgtaatgcctgtctcctcctttcgattttataggatgaggctaagaaaggtgttctattggcctttgagtctccagagcttgacctggtaaatgactgaatgactaagtagctggatgattgaccagtttgctgtggtctatccactcggcattagcatatggctccagtattcagcaaggtccttacgggtcatggccatataggagctgccttggtcaccctgggctgtggtcatgtgtagctgtaaatgatgatggtgccctctgcagcgtggccacacactacattaccatgcacaccgcaccatgatggttgtttctagctagggcttcttcatgaaagactctagtatagaaaataaaaagaacgcatctgccaattttagatcattttcgctattgaaagcactttcattttgtgggggaacaatagatattctgttagaaacatctcgccgtctgagtcaggagaattgctgtaaaccttcctgacattgccttagccatccagtgaataaagagaagaactgatcaatatgtcccatggatataaaaattggtggtgggccaataggagatgcacatgaaaagcatctggcctaattattgcagagacacaaacctgcagtattcaagggtgtctgtggtggcagactataatatgttgcaccagattttcctgattagtttttaaatccttgaaactaaattaaatgaaagaagtctgtttcagaaattaaatggaactttaaaaatccaattttaaataggaactatattgtaaacaacatgccttagaaacaaaaggacagatgggagatttattttttaattggtcttgtcctttgtaagattaatatataatcaatgtaaagaattttgaaggaaatgggaaaatattaagataagttaaaattacccacagtcgcattgagaagatggcccttgctcatatttcggtcttttttcctttgtctttttttttttttttttttaagacaggtgtcttgttctgtctcccaggttggaatgcagtggtgcagtctcagctcagtacaacctctccacctcccaggctcaagtgatttctcctgtctcagcctcccaagtagctgggattacaggcgcgtgccaccacacccagctaatttttgtatttttagtacagacaaggtttcaccatgttggccaggctggtctcgaactcctgacctcaagtgatctgccagcttcagcctcccaaagcgctgggattacaggcgtgagccactgcgcctggccctgtctttttctttaaaaacaaacaaacaaacaacaataacaacaacaacaaaaccccacagatcccactctgtgtgcagtttggctccttgctggcaccttcacatgagtctgcacatttatgtgggaaacgtatcaagccattccctctctaactttgttatttcattgtccagggtcagatcccctgaagccaagtttcccagtgtgctttcctgtcttgtgacttgtctgtagagcctcttttgtctgtcttctgacttacggctgatagtaatcatgttccaaagtcgatcgagaagcaaacagcatgtaaagtagcaattcttgaggtgctattcagtgtaatcagttattggaggttaaaattatctcagactccatctgctttgtctagaatcctcttagaaaaaaagtcacatttttcaaaacgtgtctgattccataagtccagtcttgttttgtacatgccaggtaacaggctttttaggtcaatgggagcacagtcaccatgatctttatgagttcctccctgagggaaaaacacaaggtagttctctttctgtggataatcacttctgctttgccttagaactgtttgtacacctgtgtgagaccaaaatatctgggagaaagaagatagtgctttgttgatttctgtattcacgactaccctcattagatgcttacaatttgttaaatgacatttcttagttttaacttttggctcatcctttaacaagtagattacagggctaggagtgcccctacaagagatctttctattccctttttctctacttggaagaccataaaccaaagttgccttggcagatagtaacataaaattgattttttttattaaaaaaaaaatcttccaggaagaaaataactcaaggtaagcactagcttaaaaaaaaaaaaaaaaagattagactagacattttccttctgatgccttttcagagtgacagtctgggagctagaaactgcttacacaacagaaataagttgtaaagagtcgtgctgtgtgcacaggtgtatgcttcatcagtattcttaaaaacctcactatcggccaggtgcggtggctcatgcctgtaatcccagaattttgggaggctgaggcaggcagatcacttgagatcaggagttcgagaccagcctggccaacacggtgaaaccccatctctaataaaatacaaaaattagctaggtgtggtggtgggtgcctgtaataccagccactcgggaggctgaggcagaagaatcccttgaaacttgaaggcggaggttgcagtgaggctagatggtgccattgcactccagcccagcctgggcgacagagtgagactctgtctcaaaagaaaaaaaaaattaaataaataaaaacctcagtaccaagagtggtcccgggacagcagcagcaaggccaccagggagcaggcagagatgcggaccctcaggctccacacagacctactgagtcagaatgtgatttcaacaagattctcaggctgtgtatattcacatttaagtttcagaagtgctgctcaggagactgaagagtatgaatggaacatcagaattcaaagccctaaagacggcgaaccccggctgttgttgcgtggtagatgcattaaacattagttttagctgatttcgcagttttattagcatcctctcaatgccaatgttgacatcagatggcaagatatgattgccagcagcaattttctggaaagcagccagtgcattagtgtgaaatgtgttctcactgcaatctagcctcagtgggctgcctcacgtggagggtgaatggcttcctgtatggagaataaacgtaggttaaagagtcaggaaggctgaacaaacactgtggaaacacggatcccgaggaagagattaatgccacaaagtgcatgtgcatgctgttagaagttgtctgtatctcccctcaatacgctgcacaaactgaatatgatccctgtgctgcttccgggtgtcttctgtgggaatgaatggaagtcattaactggtcctgagaaccgattttagatcttcaactattatcagatggagtccctacgcatgagacaattcccaacatggacgatgcccggaaagatgtgggctgtttttaaggtgtgcaggaatggaggggtaacttttgaaaataatttccagctataataattttctagacatgcccaaggatttagtggccaacagtcttacgtactgcagacttgactatggaaaacaacaatggatgggataaactggtgtgaaggaaccacctagtgatcagaattagagtgattttcttataacacagcctgggaggttaagagactgagggggtgtcgcctatttaattcagctggcagctggcaggggctgcccatcacttagggcagacagggctttgcaaaaagccatacaatgcccagcgaccccattaacagggccttttttgaatgggaaggtcaattccatttctgaggttatagctctaaattagggaaaaaataataagccctagaaataagtggggtctgtatacaaagaaccagtaaaaggttcgtttctgtcgttggttgatacagtgcccctgggaagagtaaaattactgacatatttctcaggccatttctggaattggtctcctgtgaaaggaatagcgcaggcttattgtattttgtttcctggtaacatcatcatttttgtttgtttgtttgagacaagatctcactctgtcacccaggctagagtacagtggtgtgaccttggctcactgcagcctccacctcctgggcccaagcaattctctgaccacagcctcccaagtagctgggactgcaggtgtccaccaccatgcctggctaattttgtgtgtgtgtggttttttttttttttttttttttttgtagagacagggttttgccctgttgtccaggctggcctcgaacacctggactcaagcaatcctcctgcctcagcctcccaaagtgctgggattacaggtgtgagccaccatgcccggccaatcgttttcttatatagcaaaaattgcttttctctttatttacattgtgtgtcaaattggtagacttagccactgtgtattgagaaaaaaacacatcgattgattaaatccttgctgcatttggcaacagtttataggaaaagggagaatttctgaagatcatgctatgatgcctctgggatacgttcagttggagaaaatctaatctcatgtattattgtattgtacagagtgccaattattgacagtgaccataaaaaacaaagacctgttacaaagcctgttaggtgaacagactattcacggagttgtctttggttttgccaaattggatcaagagtttcacctgggttttattaagatgattgtgctttagctttttaacataaatgtcttttaatgtttaaaatgtgcaagtccttgtagacttgttagatccggaaacatcgattcagcatggattctgtgccaggcattgggaataccttagttttctttcagtgggcagtggaagacttgggagaactcctcacaacagaatcctaagggaagagtcctttcagactcactgcaagtttcattactagagaaacttgcattttcacatttgtatgttcatgggagtatgagatgattgatacagttaatcttatttgaggatgtccttgtactgtttgaaaatgtgactgccgaaacactgtaacattgccttcgtactttaaataactgaaagatgtgttttattttatagttgaattaataacacttctagcacattaagaatccaaataatgctgggcgcggtggctcatgcctgtaatcccagcactttgggaggccgaggcaggctgattgcctgaggtcaggagtttgagaccagcctggccaacgtggtgaaaccccgtctctactaaaaatacaaaaatgagccaggtgtggtggcacgcacctgtaataccagctactcaggaggctgaggcaggagaatcgcttgaacccaggaggcggaggttgcagtgagctttgatcgcgccattgcactccagcctgggcaacaagagcgaaactctctcaaaaaaaaaaaaaaatccaaataatattaaaagcctacttttgtgtaccagcatgctaataaacagatttccattaaaattagtccctgtactctaagcttgtggcatattttagaagcccttaaaataaatactaaatgtcctagccctcagttttatgagcctgcactttcccattaagatgtattgggaatcaggtgtgtaaagttcccattcattttctaccatcagttaacgtgagagggaagttactttcaaaactttacaagattatcaaaatgcacgagaacttgactttggagatgtttacacccacatacctacattttggggcacaagagaaatagaggaagaaccagaggaaatgtggatctattttgaggattggcaactgtgttttctaggtcttaaaattactttttttttgaagacaaaagtgaagctttatgctatgtatttaaataattgcaaatctctctctctcagtgcttctctcacctggaaggaccagtgtgaatgaccccactgtaaatggattctgttcatgtgacttttcgtttgtcctatttgccttataatttggtttgacatcagctgaagaaagtgtgtcagatcagttctgggatagtgcaccagctctgtgccagaaaatgagtgataacaccttgtgtaatgaatcaaaagttggaagacattttctgttacaacagctggaaacattttctccagtttacgtgaagattgctgagtaattggcattccaggaaggtaaaggaccggatctgtccctgggggtgaggctttgtagaaaagaataaaatcatcttgtatgttgaatccagcccagggataatatcaataaatgtagaatagcagctagtgtttcttgaatgtttaccgtatgccaggcactaactaaaatttcgattttttaccccattaacagtattatgggagtagatactattgttatctccatttcacagatgcagaatcagggggaaagtaactggcccaagtgattagtacctggtcaaggcagactgacattcttaaccacagtgtcatatctgacattatatagtgttttccaaatactttaagtatataaaattcatgtgcatctttttttttttggtaagaatgctcacaatttattgctgagctttattggtgtgcctgctggagtttaaaaatacttttcttctgaaattatcaaattcctgtgatttgtcagtctttaaacacattgagattaatatactaccctgttaaaagggttagactgggttgccaaaagacagtaaatgttgagaaagctactgaaatgtcttctttcaatttcttctaagtgtttcttgctattttgattcctatttggattgttaatgattatgaaaataatccatttagagcaattttaaaaacttaagaatcttactttagattattataaaaatttatattcccaatagtggaaaaagaacatttttaatgtaactaacacatcacagagatatacagtacaactattttatagagtgtgaatatcgcaaaatttaaaaacatgtcaactttaaaataaaaaatgattacagctttattaagctataattttcgtactacaaaaagcacccattttaagtatattatttaatgattttaataaatgcatagaatcatgcaaccatcaccacattccagtgttagacactttgaccaagaaagttccttcatctgcatttgcagtcaatctgggctcccacccctagcccagcagccactgatctgcttattagtcacatcagcttttaaatgttgacctcatttttctatctgcttttatagaaaagtctcctttctaccttctaagtcatttgtgtaattatggattcactaagttcatcgcctttaacctgtaactgtagcctccatcctctccagctcggtttgactagctctgggttttattgaggttttataagtaacttattacagaggttatgtagccagtttcagcactgtgagccacttattatctttgcactctttgcacatacggcatttctgagctcactccagacttaggtatccaggagaagaaagctttcatgttcatggcaggatggaataattactgtcttctaagccctagggatgcttccttggggtctattcttctctcctaccttcttggggccccatttggtgacatttgctttgttacagtccaaaataccatttataagctgattaggtttcacatgatattaacatatttcaagctgtgtatatctttttgcatttcatagttaaaatatggcttccatgtgctttgtctgttccttggatgagatccaattatttcataatctctgtcattccctcttcatggtgagtttcccacttgtcctttcatcactttgctattcaagatctttgaggacttttaaaagattacctatttctttcttctcaaggaaagagacttaattgtgcattttaatattctgccgtacagtaaagctgcacctgggggattatgttcactgaaccatcattgaaaatgcctttgtacttcagtgttaagatgctgctggcctttggattccagaaaagattgtgtattcagtgtatacttatcttctttttcttgttcaaggccatctctaaaccaaaaacaaggaccggtctcccctgtgaagcctcttacaagatgggaaagaaaagctggtctctggctgagattcaaaggccttgggcttatatctaggcatagttctgaggttagtgaggaactgagattgcttcccagatttttctccctttctgacctccttcttggtaatctgtctctccaaagaaccaaaggggttttggtggtggttagctacattaaagaaaattacatacaaaaaaccctttcaaaaccaatggaacttgtttatagtttttaaccctctcttttgggggctttattatataggtcttattattaaattgaaattaaataaaatagtgatttagtttgtttattatatggtttattgtaatttcctttagctaaagctgacaacagaaaataatatcaatgaaatggaaaaattcttttaattccaggaatttaagacaaaatcctctatctttaatttagtttttcttattttatctacaacaatggctcttaaattttggggcttgcattcccctttgagaatcttatgactgctatggccatatcctcaagaaagttatgcttctcagatgaggtagcatttaatttttctactatgtttctcagcagtgttcagtctttgactctcatattttgggggaaggggtggtggaatttatatgtccatgatatttacttatccggtgacataaatcaagtcttgttttagatcatctttaattttcttgcattaagtagtggttttttggaaacatttgggagtttgagcccagaaagatatgagagagccgggcacagtggctcacacctggactcccagcattttgggaagttgaggcgggcggattgcctgagctcaggagttcgagaccagcctgaccaccacagtgaaacccgtctctactaaaaatgcaaaatattagctggatgtggtaacacatgcctatagtcccagctactcaggaggctgagacatgagaatcacttgaacctgggaagcggaagttgcagtgagccaagatcacatcacggcactctagcctgggcgacagagtgagattctgtctcaaaaaatacaaaacaaaacaaaacaaaacaaaaaaaacaaaaaaaaaaaacaaagagagagagatagagagatatcagaggatacattctgccacctgtgttcattcatgactgattatcaaaagaaatttctggttcttgacaaaacattttctgttcatagagaaattgttcagttcaactgggcatgggtttgctttctgtcacttgctggaaattctttactggaacaaaaagtctagtgcttgtgcataagggaagacatagacatgtggtccttcctcacacctgcttcctcactcctgcttcctttttgctcctcatttttcttttccatcttaacttttccccatcacttgagccttcagtaagtgtgagataatttcacttttcttctcatgtgattatttcacttacaggaaatcatattcctggcccgaaattgtttcttctttcacagcagatgctctccagggctcttcatcattttgtcctgagcaatacattttcaaaatgtaaagtgcttcccggctgatagctctggagccactagggggtttaggaatgtggtgcagtaacaacatttgtcttaataccctttaaaaactgtaagtaaagtataattattgcttagaaactttttccttaaaaaggaattgattttacagccacagggtgtatagcaactacccatgactggcagttagtggggatcaagtaagagtccgcatttctgagttggtttaataacgcaacagaacaccaacagctgatagctcctggttttgaccattaaattgctttaaattggttttattctaactatctgttgttaattttgtattcataaccattggttaaatataggaggtgaacaaggagcagaatataaatgacgataatgccagcttttataaagcacgttaaggtgtttctagcatttaagaaaataataataaaaagaaaatacaatgataattgaatccaatgtagcttttatttactgagattaaaactgtctgactatgactaaacaagatgatttgtggaggggtgcaaaatttatatcaggtcaaaaaaggcagatttttaaaaaatgctgtaacatattttaatttgtctacattttaatatagacttgactctaatgccaaataaggtctagtcattaaaaaaatttttggctgggtgcctgtagtgccatctactaaggaggatgaggcaggaggatcactggagtccaggagtttgataccatactggacaatatggtgagaccccgtctcaaaataataataataattttttgtgcttaaatcatatatttgccatataaattaaaattacctgaaaatatgtaagacaggttgattgggaagaacaaactttgtctttatattccacaaatactatctaagctctattaatgtatttctaattttaaatattttattttaaataactatcactaaaaaatgtcaaaattattctaaaattccttagggtatttgagaggctaaatagttctgtgaaggaattcctgaaagaaaaaaaaaggactggaaacatagggacatggattgtagtcaggtgattgaatgataatgtgctagcaatgactttgggaatatcgaggtcctcaggggtctctagcatggtactttgctttgaccaggtgcttggtaaatgtttgttcattaaaagaatttatgtatataatatatggtactttaatcacacggtgctgttttcatttaaaaacatggaagtcatggtctactatatggaaacttaagtaggtgatttgtagccaccatgggagcccttggctgggagattcactgtagcaaatatcctttcacagatccaagacctagtagtactgaatgaagtgatggttttacccacatgatgacttatgtcaatcaaaatgaaaaatatacccactttcttattcctaccgacttcttaaataatttgccaatctgttgcaaatatggtacactgccaattttcaaagttagctatgtgagcagtccttcctccaattataggaccagttacataatgaaggtttgatgtagaagtaaggatttcaagaacagtctgatgcttggcatagaagtaaggatttcaagctgcagtctgttaatagttttgaagtattgttattgtttttgtctcttattcgggaaggcctaattatcagtgatgttaacaatactttcctctccaaagccatttttttctttttttttgacttgtcttattttcaagcttctaaaattcagattatacctattttgtgcagcctgggctcttgcctaacatgcaaaggatatttagacggtagaattcatagaatttagtaactgattggatatgggaaggaacaggaagacgtgaagaaaaggaaaaggaaagaaaacgcctctcgcggccgggcgcggtggctcacgcctgtaatcccagcactttgggaggccgaggcgggcggatcacgaggtcaggagatcgagaccatcccagctaaaacggtgaaaccctgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagtgagactctgtctcaaaaaaaaaaaaaaaaaaaagaaaacgcctctcggataagagacatgccttgggcagcagggtagacagtagttatattaaaagttaaataatataataagcataacaactaacagctattcagctatttgccgttgtgctaggaactgtgttaagcacttcatatgcatgataaaatttaatcctcacaccaactctagaaggtaagtactatttttttctcttttacagatgaggaaactgagatttagaagggttatataatatgtgtgatatcacacagctataaaaaaaaaacctcaagagccagaactcttagacattagttgtcttccggtcagaaaaataaagcagatttggagttgtatatggtcaacagtatcatagctgctaagtaatgaaataaaataaggactgtctgacaacagtatcacgtgctgctaagtaattaaataaaataattcatttaataaaatactataaggtattggcaagtagaaaagatgatgagaggacattctaggcaaaataaacaacatagaacattgccctgggctaggaaagcaagacaatttgtccagaatgatgacagctgtattggatttggggaggggttgtgctcagggcataggaactaggaacacagataaatgtgaaaaagtagttagaaaatgatgccagtagtgggggaaatggatagctatcgttgggagtgggagggaggacccagatgaacaagacacacagcagccttcttactgtcaacttcaagtgctttatcatatgacacatatcacgctaggaatggtggctattttctttatctaccttgactcatatatcacatatatttatacctctggggtgtcatgactgaaataaattttctggactaactttataaatgtatagagaagcagacagaagaaagaagcaacttctctgaagtttgggttattttccattttgatggccaaatgtagattaaaagttgaaagtcattcatcacataacaagcccttacgtgccaagtattgaggatatgaagatgggtgagttatggtccctgccctgagacactcagagtacagcccagaagatgagcattttttaaaatttattattttttaaatttttttattttactttaagttctgggatacatgtgcagaacgtgcaggtttgttgcatagtatacatgtgccatcatggtttgctgcacctatcaacctgtcatctaggttttaagccctgcatgactaaaacaccaaaagcaattgcaacaaaagccagaattgacaaatgggatctaatgaaactaaagagcttctgcacagcaaaagaaactagcatcagagtgaacccgcaaccaacagaatgggagaaaatttttacaatctacccatctgacaaaggtctaatatccagaatctacaaggaacttaaacaaatttacaggaaaagaacaaccccatcaaaaagcgggtgaaggacatgaacagacacttctcaaaagaagatgtttatgcagccagcattttaaccagtggtttataatgccatgggctctgtgcccaaggagattgtactgagccatgtgacaacagtgcaggagagggactggctgttgcatggggtggagtggggtagggtgggggctgggacacaagaccaagctcatgatcatgagatcctcattgtgctcccctgctgtttctctgagctttcactgacctcacgagagcattcgcccccgtatccagtgagtcattcagtggctcctccgatctgcccagaaatgttttgggaatccagttacccttctccacgcatgcgttcaagctctcacggtgggcctggacccttgcagaagttccctagctgatctctttgcttcctgtctctttcctctcctacctacgttctgtgctacctccagagagctctttctaagaacagagcttttgtcccagcgtggcgtgtaaaatccttggagatattggcctcttctccctttccagcctcacttcttgccattttcccctgtacaccctaagtcccagttctccaaacagcttgttgcttctaatactaagtgtctgtgccatcccattctgtctgcctggatgccctccagctgatcttttcaatgactcctctaagaagaagggctcctctggggtattttgaaaatatgcctgtgaatagaggatgtgcgtccttatcggactgtaggccttacatttgctgctctgagaattttcatccagaaagatctgaatgtccagacccaaagaaaactatttttctttttgtctttatactttgccagaacaataaatgtcaaataactttcctttccacatcgataagcctacaactgttatgtcaccccactctaaagtaaggcttgctttataatgtattggagggcatgtcgtagtttatgaaggcaaagtgcattaaattttttaaatagtgctaggttattaacctaatgcttattcccacaatgcatgtggcacacttggggaccataggaattgcaaacgcacatctggattactaagatttgttaatcctctccaattgatgtgaaataatgattagtcaccaggagagtaaaaagctttggttccctcatgctgccaaatggagatcaaagtgccatcaacacttcgcattagctattgttggagccactcttgtaccaaaggaaacaagattttgtcttgttttgtatttgaaatattggaggaaaaaaatcaaattagagctagatgttattggtgtgaggcaagattcagtgactcagaaacataaaaggaagttggagaaagtaaatgaccagaactgcctgttgtatatttcttggtgcaaagaaaaaagaagatgcttttgccagagaatggaggtggaaagaagagagtgatgggaaactttaaataaatgggaacactttgcaatggacaacccggagttcctgttcgagggtggtcctgcagagaagtgtcatgagagagtggaatagttgagtgctgcacaggaaagaaacatgggctgaacttggaaccaaggttatgtttccaaaaatagagttatattaactgcacaaagcacatagattgaggaaagcctgtgcttctgttcaggcctagcaggccagcaggtctctaggccatctggcctgtttctcctgggttgcccaacagtttgtaatgtgaggttttctcatcaagtagaggagagcttacatatttattcgcagatatgtgacattgtacagaggaagaatgattcgaaatggggcagaaatcaggcccattgaagacgctagacaaaaaattaaaaccgcttccgaagcattttaatgagtctggcaaaagccattttgaactaatttcagacttttcacctccaacttgaatatagaaattgcaccaatgatgataagtagattgagagaatttttttaaaaaaaagatagaataaaattttgtttcttttattggttattggtatttcatctgttttttaaaaaagtattcagaaaagtttagaatccagaggaccattgaaacagagattagtggtgggaaggagtgaaatgtctgaagaaatggttgtgctacaaaggtaggctaagaatagtgagtgttcttgggttattatgagctaagacataaatggaaatgtggttgtcatggggactatttgcagtagaataaagtattttggtttgtcaagagagatagatctttttctaccactaatgttaaggttccaccctccctggaatctcaaggtacatcgggaaccccggcacgtctcgcagacccactggctggcactgccactccactggtgttctggggcacgaggctgcctgctgtcctgtagggcacatttgccatcttacaacctgctttcccaggatgtagttctctaccctatgccacttctttctcaatacagaaaagagcctgtcctttcatttcccacagcatagctgaggccaaatcctaacatttaagctttccagaaggcttttacataaaggaagaatgagagaacagccttaagactggaccctacatgaggctgctcctgaagtacagaagccagcttcttctctggcactgaaagcgggcagctcacctgctcacaatgggagtgcccttctcatccctcactggactcagccctcagtgcctcctcttcagctgcagagggagttttcctcaaaggatatggtctgcagcaccagccacacctcatctgaaacacactttaattattatgtggacagctcactcctcctagtcatcaacctgctattccagaatccagcagtcacttaacctttgcataaccactaggatgtaaagtattttcccactatacaggagagatcggtttccacaggtggattttagtcttcaatgatgaagaaacaggaaaaccacatgtaacttggccattttcccacatcatggttttaaaaaacattgttgtttagacccagccagagcatcctatgctcatgggcactctagtgctacccaagacttccttaacatttttggtaaaaacaaagccacaggttttgtgcctcttgccctcttcgtctctgaccaccttccctgccttccccttgtttcccaggggtcttagtcttatccttggcttgggagaatagtgtatccacagcaggataggtgtttctagtattgggaatccaactgacctttgcccactcccaatcaaacctgtcccttgttagaagagagtggagaggagggagaagcctccaggagtcttcttggtgggaaaaaggtatggatatcctcagagcatttcctgcatgccagcaatccacatggcctgttttccaatcacatctttgcacgtccaaactgccactaggctgcaaatttctcacagtcacaggatgggtcatttcatgtttctgtgctccacaatgcttgactctaagagatactcagaaattgattaccaaacgaatacctaacactatctcctaactctttgttaattacaacataagcgaaaagatcacagactcctttgcaagggtttatttttccttttagcaatacctgtgcttgaagataaatgccctgttttgttgtgtactttgcagtccacctgtgtagacatgtaaacagtctctatcatgtagagtgtttaaacagctgtccgggcacttctcaaaagaagacattcatgcagccagcaaacatgaaaaaaagctcatcatcactggtcattagagaaatgcagatcaaaaccacaatgagataccatcccatgccagttagaatggcgatcgatcattaaaaagtcaggaaacaacagatgctggagaggatgtggagaaatagcttttacactgttaatgggagtgtaaattacttcaaccattgtggaagacagtgtggcgattcctcaagggtctagaaccagaaataccatttgactcagcaatcccattactgggtgtatacccaaaggattataaatcattctactataaagatgcatgcacacgtatgtttattgcagcactattcgcaatagcaaagacttggaaccaacccaaattcccatcaatgatagactagataaagaaaatgtggcacatatacaccatggaatactgtgcagccataaaaaagagtgagttcatgtcctttgcagggacctagatgaagctggaaaccatcattctcagcaaactaacacaagagcagaaaaccaaacaccgcatgttctcactcataagtgggagttgaacaatgagaatacatggacacagggaggggaacatcacacaccagggccttttaggggcaggggcgaggggagggagagcattaggacaaatacctaatgcatgtggggcttaaaacctagatgacgggttgatgggtgcagcaaaccaccatggcacatgtatacctatgtaacaaactggcacgttctgcgcatgtatcccagaacttaaaatattaaaaaaaaaaaaaaaagctgttgaggaaacattttatttccagctgtagtgccagccagtaatgttgtctgaggctgacttctcttgggactgattctctctcctgtgtgctttgtcctgacacctgagttcagctgaggtgttctggagcccaggggacccctggtggtacagagcagactccagagggctggtgtaggttgtgttttaagtcacagaaacagctcctgacattgacttggtttgtcgaaggagctaattaaataatgctaatagctggcaaacagtgatgtcagatgggtaaacagtgaccctggctgctgagttggatgggggaaggaagaaaatgagagagagggtctaaatgtagccaaggaaggatgagccttttatatctcatgcagattaataataatttttattaaaagtgtctaacgctgtggtgagtgccacaagatttggtttgtggagagacttttctttaaagatttcttcacagaagtaatctattttattattgggtaactaattgaaaataagcaatatgcaatgaaatatttgtctgggggttcctgactgtttattcaaagttgccagaatgccaagaaaggggaatccaaggataggtgaagggagagcttcaggagtcagggggtctcttggtctgcccatgtgtctctctttttgcccttttcaaatcctctccagccttccctcccagggagctcgctatgcttaatggcagactggtattctctcggtctaccccaactataattttgcttgataacattcagggtgttggtagctatttcctcagtcacaaagaatagtgtgtggtaatttagaagcttgatttctgatagaaaaaattagggaaaattactgcaaacatgagcagtcatgggaacctcatggttgaagctttaaagctagttattgatggtcatttttgtctttggggacagtggcacagagctggcttccaaactgtattcaggttagtaatttttatctctactaaagcaatttgcagaatatgtgcagtatagcttttttcataattctaaaaaaacccaacctttggattatatacatttagacaaaggtctggaaaaaaaacacaataaactgataggagatgttacctctgagaaagaaagtgggattggaatctacaaagggtccatttgctttatattatttgaattgtttacagcataaatgtattttaaatataaacattaaagttaaaagaatccagagacaactttcagagcatataggcatttgtttcaaacttctctggggagaaaaaattagtgtatttgatttacataatttggagataaaaataattattttaataatatactaactttgagtttccttgggcatatttatagtacctaaattttctaaagtggatacttaaaacatctgttattagtaatctatctttggccacatggtggtaatgagaaatttgttttccttgagagacaatgtatacatatttatggagtacttttgttttcaaagtctcatcttgatttatataaccacatgatattttttgaaaatggtataacaattttatttctgatgggaaagtacttatataagtctatcctaggaagttaaaaagctaaaatgggtgccatataaccagtagcgaaggccatttgcattggtttgttgttctttcatcagtttttacaaacttgcttggttttgtctgtttctcttaatgtgacatacggatcccttgttggtagtctttctaatagagatttagtgggagtatagataatggcagaatgattgtagctttcacaagtgtaattaacttcttgtaaagtacagttcttcaggacaaatcttgaaatagaatgactatttccagatctgggcttttgtccccctcctttataattcagttcttttcacttctgtgctgtcagtttagtgattcttcaacaagacttcccaaacttcaaatttgtttatatcttttctgtttagctatttctttttatcagattatacataagtgttttttaaatagctgcaaggtttgacccttgtgtgcccggtgattgtacgtcagtcatttgaaaaatcagacgctcagctgtcgtccctgtggtccagtttctaaaaccaagaatcatgaactgtctggggataagggaaatggaagacaaaccgagctactgtctgtctgctgattcttgcatctagtgtttttccttaccttttcattctgccagggcggggaaaaatcattcaaggatgtttactgacatttctgcatgtttttgaatgcctcaggaattatttgacttttcctttgtgataatctaatcctaagtgtctgtttgctccaatgtatttttaatagccaagggacaaatacatttagttttcttccttttgataaaaagttgtttgagaaaggaaagtatcaatttgaccgatttctattatttttctagcacattctaattatgttataaaaatagcaacagcaaagtaacttagagaaatccaggaggaaatgaacctgttgacttggaggatatatattcatatatcactaatcctgtgtttaatagaatgtttcttaaagaaaaagttttctcttcctagcttagaatggaagaccaatggtaggggtagcaagcccctactaagcacctacaccacagtggatgtcacaaagtgggtcttccataaatatttgttgaaatttttaaaaaatgaatgggaaaactcaaggaaaaagattgttcctggaggaattccttggatgatttatttgttatttggcgatatggatcagctggaatgtgaataatacaattgcttgtttcttagaatctattccactttcaatctttttgagtcacatttgtaagatttacagtacctatgttttgatgattgtatgggcaccaataaacagtagaggacttgttttcttatagccatttaaattttaattatcattgtgtagtgaatgccatcccatttgttcgacaggctgatctaccaaagtgggaactggagttgaactgaggagggacctaacagagtaatcgagatgaaagagaagtttcagagacgtgaacacgtaatacagttaaaaacaaactagacatttttagtgtattttagagaacttcctatgaggtcactagaacataaaggctgtgatcagaggcaaaggccagagtttgctacaggccaccatcttgatctgtcaagataacctggtctttttctactttaatatggtgctttcttatagcccaataaagaatagattgtttatactctttgaccctccattccctaaggactttttaaatagcagtttggaatcggtgggtacattgcttaatactgaacaggtgtttggcaaattcaaatgagatttcagattcttatgcacagaagatatttaaagaagcaacttttgtggacagagcccattccctgtaaccataactttgactcaccaggagctgggtttctgaggcaactattgcctttttctaactgcagccatctctttgtatatccccttctctccaccgggagcaaggaagacaaatgaggaatgaagataaagttctaggtagatagctggggctcattcagctcaggtttttgtctaatccagtgggtggatttgagtctttttcatatgaaagtattttagcaacttctagtgctttctacaacttccattttcataagttttacaaactgtgctctctgagggtggtctaagtgaggactgtatcttttcagctgatgttggaggagaggagttggtgacaccttcaggccttcatgatgccgtcagtctgggggaaatgactcatccatccaactctttgttgagaatttaaatgacaaatgacatatcaagtacagttcacccttgaacaacatgggattagaggaatcaacctcccacacagttaaaaatatatgtataactttagacacttccaaaacttaattactaatagcctactgttgaccagaagccttaccgataacataagcagtcaattaacataacacatatttcatgttatatactgtattcttataataaagtaagctagggaaaagaaaatattattaagataaaatataactcctattcgttaagtggaagtggatcaccataaaggtctttatcctcactgccttcaccttgagtaggctgaggaggaggaggaagaggaggtgttggtcttgctgtctcacagatggcagagtcagaagaggtggaggaggtgaaaggggaggcaggagaggcaggcacactcataatttctattgaaaaaaatctgcgtataagttgacttgcacagttcaaacctgtgtttttcaagggtcagccataattgctaaaatagcaaggctggagataaggttatctggagggggtggattgctggcctctccaccctcattagatagtgcatatccaatgccttggtttgcaggatgctaaagttctcttcaaagcattgtggtcttatagcgttgttgttacttactccccttgactatagcaattgaaatgttaaaggaaaacaaaactttctctaaagaatggctgtgtaaatcggtcgctctgttttatctccacaatttttctacttaagttgaataaatgttatttttcccagaagaagttagagagcatattcaagcaatggtttgatgcaatcctttataagttgtgagaccttcatgcgcatgtgtgctggggttgagtgcaggaggtagagatgacagtttccagtcctttctacgtgacacaggttagaattcccgaacaatgaaactttccaagaatgccatttcttggaaataactgctttttaaggccaccttaggcatgacttttaaaatggaacaatgaaaatttgcatttcaaagccatctaattggccctctattcttttgaactatgagtggtctttttaagtagatttcagcatacttaattttttttatatatgtgactttgaatttttttttctgcttcattagattttttataacttggccaaaaagttacttagtgatgcactaagtgatgagattctgtcttcaaacttcacattgtttttgtcagccttcatgatattagacagtatttaatgagatgttaggaaaggaataattttgagggaaatatacttgagtcaaattgaattcttagcttcattatgttaataattatttaattctaatttttttcttttaaaagttgctttcattttaaccatttaattaatgttatgctgaatttttatatgcattgaaatgcttattttgtgatatgaataatgcaaaacttctaccaaacaccgaagtctgtaattattgaaagcggagtttctgaacctgcactattgacattttaggacagataagtctgtactgttggggcctgtcctgtgcaaggcagaatgtttagcagcatctagcaccacccactagatgacagaatgccctactcccttcccccagttgtgacaattaaaatgtttcttaggcattgccaaatgtcctctgggaggcaaaattacccctcaacccctggttgagaaccactgatgtaaagtctaaactctttcttcccaataacagaaagggattcctcatcacagagagtgaaagcagaagccgtgtgtgttgcaaaaataactgtggaaatctgactggaaacattatattgtagatcattgtcctaggttaagtaaaactcaaaatcaaaggcaggctacatattgaaataatgcaagaatcaataaattatttttacatagaatatttcgggaccaaggtggaagtagactgaagtacaatatggagcactacctggagcaaggtagtaattcaatttcagcccactgaaggaaactgacagatcagattcaaaatgctgttgaccttgacgaatatttcccttgaatatgtgtaatatccttgacctatgtaagataacccgacatggaccagaagctttattgagtccctaattcctatattttgatgttttgatttcacaggtatttccagcttgcttttctctctcctttgatcctgcatgatatcgtgttctcttggttttcttgctgcctctttgtctcacctttcggctttcctttcttatgccctccacccgaacactggttatccgcacaagctaggccttgctctcctttctcaccttccttcttcattaactctcagttacctcaaataccagctcagtgctattcccaatctccaaaagctgtagaaacagacatttttttttccataactcctttgttggcaaaacctgacccaaataatatgaagcttttatagtcatcattgatcccacctaatgtgaacatgtgtgtatgtcactgcagaattgttaatatgctgatcaaaggccactgcccagatgtcattggtaaggataagtaatgtgtgatgtatgtgctgcaccatttttctaaagtctgaaaaattcagaatctaacatatttggctccccaagcattgggtaaggtacagctactacttctatgtgcagcatcacaagtcaatagctcttaatgatcccttcattgcttgccttttggatatcttccgctattgatggagcattctttcaatgcttgaaacaatttttttttaaattgtagcaattcgttttccttgctctaagaaacagaatattcctgataatgctgttggtactaagtactctagtcttcagaacttgaggttatctttttctttttaagatggagtctcgcttttgtcccccaggctggagtgcaatggcgcgaacttggctcactgcaccctccgtctcccgggtttaagcaattctcctgcctcagcctcccaagtagctgggattacatgtgcccgccaccatgcccggctaatttttttgtattttaaatagagacagggtttcaccatgttggccaggctggtctcaaactcctgacctgaggcgatcctcccgcctcagcctcccaaagttttgggattataggcatgagctaccgtgtccagcagaggttttcttaatgttccttttctctacttgcccagctcattaaattctcaaggcttctatatcctcatgcacaagtttcttttcatctttgttatcccttgcagtaactttagttttgagctgctggatcagcctccatttgcacatggccagcatatctgttgttttcctctttctatgatctactgtgaccttgcagagtaacattctaggcatttccacaaccgccctgacatggtctcatctctagccatgtagccacaggggcttttctgcaccattgagacacacagcttctttaatgtaaagtgttttgatgccatgtcctgctcattggttgattttctctccctgactgcagagctccttttctgagtatctgtccaccatccccctcggttttctcttctccatacaaccttccctcggtgcagcgagtcacattttagagggggagttgccttccaaagcctagtaaaaatgcaaaattcacaaaaatcagacctattttttttgtaggaaatgattcacattacgtaaaattggaagtgtaaagtgacaaccttttaatgttttatgtcactatttcaaattcacataaaataagaccatttgaaagtctgtctaccaagagctaatctgactttgtcttttcatctgcacttagactgcaactggtggtgtttcaccatccacttgctccagtgctcagatacttcatcttcatttggagatagctcatccctctggacaccctgaaaatgtttcagtatctacaatttgtaaaccactttaaataataatgcattacaatattatggctttctggtagctgaaatgaaagaattgtgggagatttctactcagttgaagaactctacccaactgctacagataacagatcatcaagggcttggaggggcttcagtagcacaccccagactttgactccatgagcattatctagagccacattttagtctgtgtgttggaagaagatgtaagtggtatgcttattgtcttagtctgtttgaggtgctgttctagaatagtatagactgggtggcttaaacagcaaacatatgtttctcatagttctcaaggctgggaagttcaagatcaaggtgctggcagattcagttcttattcaggaccctcttcttggtttgctctgtcctcacatggcgtagagtggaagctctggggtctcttccttgtcttataggagcactaatcccatgatgggggctccaccctcatgattttatctaaacctaatcactccaaaggctccatctccaaataccgtcgtattgggtattagattttaacatacaaattttggaaagacacagatattcagtccagaggactatcttactaaattactggttagtgagaaaatccaatgattatgacacaccaaagttaaggatcagagctcacaaagtcatattaatgttcatgacattgcacattctccatgtatgtccccgacatcagcattggccagggcaatagtttatattctgaattcatggaaaataatgcaggttttgatacagaataagctagccatgtgttatgatttgttaaagcaaccacagaacagggacatgtgtagaaaggtgtatggcccttgggaggtggtgttcttactgcattcccccaagtcatcaatctgtttgctgtgttgactgcatctggctctcctttcatgttcctaccatcacatcttctttgtgctttattatagaaattttctttatatatatattttctgcttgcaagtctttagtgctaatagacttctggctgcctgagaacaaggactgtctattcatctttcctgtctccagctctagcagagtacttggtatttaataccctcttaacaaaaattgccaaactgcctctgtgacccatttccagggggatgctggcaaaccaggtgacatctagaaggggggcaagtagatttctgagaactttttgaatccaaatgacataaggtaacataatgagtagttgatggagctgtgattgtttaggctggaaaataattatgtttgcaaaatatgttgtaatttttggcatacagagcatgggatacagaaaggagataaaatagtggttaagactttatagcagtgtcaccttgggcaagtcttggtgtatccatttgtaaaattgggacagaacagagtgattaccccactgggtagttgagaagcattagtgcttggggaggtattgatagtaagtgctcagtaagtggcacagctttctctattcttctacctatattttctcctcctcctctctttctcctctccctcctcctctccagctttccactgggggcattatcatatctattatatagacaaggaaggtaaggtcagaaaggttacatgatacatttgatatttctttaaaatatgtgaaagaagaaactataatctaagttttggcccattattcttttttggacagaatgtccatcttcaaacatttgggaaagcgttatgtagaagacagaggtgactcagtctacattgcttcagagggcagagccagggcccatgggtagatattacccacatcagtactaggtggcgggtgcaatcggaacttctcttcttccctggcatcaggaacggcactgtgcagatcgtaaggagtccacaaatcattgaattaatagaatttcactactgaaacaaggactagggtcttactatattctgccagggaaaacaagttttgaaaagttcttctgctgttaaaatatgtagagagagagttctcaggagtgatcagaaggacatacaatagcagagatggaaggagaactcaagctcaatcagagctttttcaggaattcagcaaatgactagttgcattaattctcaagttatttttgagaactgagtggtcagcagttttcaggaacagtttttattctgtcaggaagactgggaaaatgaagatgatatttaaaaataaaatccatgataattgtgaaagtgcccataaattcctggtgcaaggaccacctagtcaaggagacaggagaaatagggcatcttttacattattaacatgctgaatgggtaaccttacctcatttggtatttctcctcatacattttttaacataattttctcacagtgaaacactttttgtgcagtgatttctattcattcttttgactcttaagaaaaataatcttgcagatttttttaaagcatgatgagaataagaaatgcaagatatattgaaggaaggatcaagaagacaaaattagcattttttttgagacggagcctgcttccgttgcccaggctggagtgcagtggtgcagtctcagctcactgcatcctcggcctcccaggttcaagtgattctccagcctcagcctcccgagtagctgggactacaggcatgtgccactgtgttcggctaatttttttgtgtgtgtgtttttagcagagatggggtttcaccatgttggccaggatggtctcaaactcctgacctcaggtgatctgcctgcctcggcctcccaaagtgctgggtttacaggcgtgagccaccatgcccggtcaacactagcatttcttagtgctacactgtagctaagctatcatacatatcatctcacttaactcttcttcatttcatgcacattttgcagacaagaatttgaggctcataggttaaataattcaccctaggctctccagtaaagaagtaatgatctatcttaagaggcagtcaatagagagaaatttttcatagaaatagttctttacttctcttttttaaattgtctgggagccctaaattataaggcagttggtggcatctgacatatgctcgatttcccaaaatactcagatgtcgcatacaagtaatatctctgccttatttatttcatcctcattcatattttcccctaactctgtgcttctattaccccctgcgtgataaaaagtgtgttattcaggaagccatagtaattatgtatcagaactaatggaaaagagcctggcaaatatatctacttgttttatacatgagcagagtcaatagaattatccttgtgatctggaaggaatttaaaaccacgcagatgattctgaaaatattcttcaccttcaataacccatctaatttttttgagacacaaatttttgatgctatccctcatttgaatcctaaaaatgtatttgccatcctgctacagaaagatgtggaggtcagggagtaatgtggtctactttaaagattgggtttttccccccttaaacatttagaaataaaatatttgtaccacttcactggcagaaattcagtagcaatggtaagaatagagttaccttctgtgtctagtgttgcctttacagttgctttgtttcatagttttataaattgggctttctggtttccttggaaacccagttgtcgacattggttgctaaggagcagccttggctgcacaaagcataaggagctgcgagtctgctactgagtgacttcattcttggcagtaacaggcagtgggactcttaggacccgcttatggggggcctccatcttgattttcagcctgaaggattactatggctcttcctgatctttattctcctggcagttaccaaagctataggtgtctataggagctgagaattgtgtagcattttagagcatctttgtcctcaactctattttttcagtcacttgctatcaatgatttattcaacaacggataatctgtttctgcaataataagatcccaaataaactgtattgtcttctctgttttttttttttttttttttttttgagacggagtctcgctgtcgcccaggctggagctcactgcaggctccgccccccagggttcacgccattctcctgcctcagcctcctgagtagctgggactacctcgccctgctaattttttgtatttttagtagagatggggtttcactgtgttagccgggaaggtctcgatctcctgacctcgcgatctgcccgcctcggcctcccaaagtgctgggattacaggcgtgagccaccacgcccggccgtcttctctgtttttaagatgggaggtcttccttcttaaatttagcagtgagcaataatgaaagaagctaagaattgttcatccttgcaaatcagtgtggtagcatgacactgataccagactgtgtctgatgtacattttctaatatactggtttgaagaactagagattatagtacatgtaaatgtaccataactaaatggttatccaattaaaacaaaaaacaaagaactgtaacccacattttctgtattggcatacaacagatattatagttcttatagaaatatatccctaacttgagttataccgatttttgaacatgactttataagcttttaggcatagtaattcaggtgcggatctgtctgtggtcatggtccacatgtctgttttgtggatgtatgctgcacgaggaggtcaatgatgtgcaaatctttgagatcataggtagcaaggtcctcatttttcaaataagtgttaaggacatgtgcaagctccatttccatagttcaggtgtgagccagacagagccatcctccttggctgtctggagggctgatttgtgttacagcaggtggtgatggaattaaaccctaacaggacaccattcatcttccttgtttgttttgggtgatagcattgtgcaaattcatggcattgttttatctgtcagatatcttcagatacctgcttttagaggtagtttttttttgttttttgttttttgtttttgtaaacccacatagttaagtgagactcttgtcttaccctctctgaacctcatattcgttatctctagaattgggcaaataatgataccttatggttgttatgggagtgagatagcctatgtgaaatgtttacttaggtatctatcccataagaggcccttaaaaatagtatctgttttctaaaaaggcaaatccataaagacagatagattagtggttgtctggggctggacgtaggaggatagcatgactgcaaacaggcatgaggactctttccaaggtgatgaaagtgttctaaaactgaattgtggtggtggttgccaattgtatgtatttactaaaaatcattgaattatacgattaaaatgagtgaattttatggcatgtaagttatacctcagtagagctgttttaaaaagtagtagctgtaagtggtacagtagagaattaaactttgcttctcgtaggctgttctggataagcgagtaatatcttagatgatttgaggtgagatatcccagaatccatgtagtaatgcgcatgaattataatgagatcttgttgatgttatatattatgatacaacagaaaatgattattctttgtgattaccttatattacataatttccagttctatagaaacttccaactttcatgactgtagtaaaataattactgtggttttgtaatggatttggatgactctttttaacaaggtagggctgctggttgcagggtgtatggctgtgactcttcttttgagactcattggcatctggctggattgtatctattcagtccaacagctttattgatcacttaatatgtgttagtgattttctagaggctgggggtagaagaagagatgtgctcagttttagatgtgataagtttgagatctcttgttagttgtaccagagaagttactgcataggcagttggctacaacgctggaattcaggaaagaagtctggcctgaagatataaatcaggaagacattagcatatagataatatttaaagcaataaaaccggatgagctcaccaaggaaatacgtgtcattagagaagggaagagtttcaatgactgaccttaggttgctccaaaattaagagatgggaaaaagaaagggcacccgtataaagaactgaaaaggagtgactggttagataggaatcaagtcagcagaatggcatgccctgaaagcatatctgggacagagggacacttgtgcatacactgctaatggctcagataagatgagtcctgaaaatgtgatgattgagtagaataacctgggggtgtctgatgatcttgacagaggcagcttggtggaaataggtgagggagctagtttaggaaaacaaattagaggagaaattgatgcaaacatagacaagtctttcaggaagaaatggagaggaagctgggaaggaagtagggtagtaagaatggcttcaatctgatatttgaattattaaaatcgagaatttggtctatatggagtaatttagattttaatttctttggcatgcctctctcaatcaatatatctttactgatatttttccagttttgatttgcaagctctcagcttttacaacaaaattcgacttctgttgtgtttgaattaattaatgtaagatttttccctacaaccaaaaagcaatatagtctagtggtaaggaccatgcactttatgtcaatcaaactggagtgtgagtctgtcttctgctccttgttagctgtgtgaactgggaaaattctttagtgtttcttagccttggttgcctaatttgtaaaatttagatagtagcattcttgccttttagagttattatgagacttaaatgaaataactcaaaatgcctagtccagcatctaacacccatacttcctggtaaagtttagctttcatgatagccactaatttatactttgatatggagtaacatagcatagtagaaagaatgtgggatttggaattagccatacttgagtttctaccccatttcatctctcactatctgtacatattacttaatattgctgaatttgtttcctcatatctgaagtgagtataataatacttaacagaatgaggcttaaatgagatatttataaaatcacatagaaagtgccacacaaatgttaattttatttatttaaaatgaagttgtattttgtagagattacatctcttctattacatgtatatactaagaaaagagaaatcttagtatatttttggagttttaagtgttcaatttcatgggaaatttgggctccaaatagaatgaagcactccagtggcagtgtaacgagatatgttcatattatttctggtcaaaaattctgaagtgttaaaatgctacaagcagaagaatagaaatgtgcattctattatgcaattatataaaaaaatttccttgtagactgactcattttgctccaagtgacctagcttggaggccaagcaagtatctttttctctttcttccagaacaccatgtctcctaggtctctttataaagatgggggccgggcgcggtggctcacgcctgtaatcccagtgctttgggaggctgaggtgggtggattgcctgaggtcaggagttagagagaccatcctggccaacatagtgaaaccccgtttctactaaaaatacaaaaaattagctggacgtggtggcagttgcctgtaatcccagctactcaggaggctgaggcaagagaatcgcttgaacccaggaggcggaggttgcagtgagccgagattgcgccattgcactccagcctgggcaacaaagagcgacactccatctcaaaagaaaaaaaaattaagttaaaaaaataaataaagatgggaaaaaatgatacataacagctggtaaaaaccaaaagtgaaggagaatgtggtcagccaatccttgcagaaactttgcaagtaagaacaacctaatggtaaaaacttgaaattagtgtgaccttgtttgataaatatctaacctaacctaatagaaattctctgaccaaaaactggggtgacttgggtcacttttgagtcctcttggtcaccctttacagaggtagaatagcgaagtccagtactgttactactagtttacgtttatagagtactcagcccttttcaaaagactttcatgggctttgttgcttgtaattctcagaaccatcccgtgagataagttttgaaactcgtattacgtccttgttaaaaagaaacaaatggtttctttggaagatgctgttattgcctctgggtcaggactgggactgcagccactttaggatgtttttggatttaaaaaaccatattttttttcaacttttcaggcattatgcaacaaatgtgaatggtcatattctgagcttccttggagacttaaggattttattttatttttcataacacaagcctcttgcatcaaaattcatttctaacctcactcttcaccagacataaagttggccctcaaagagttctttgttgactggctgattgcactaaaggcaaggcatcctgctggagcacatgtgatcattctagttcaatcctaccgctgatggatgctgttgctctagtgttaattttaaggtatagcaccaagttctgacagttaaaatgtttagattatatgcattgtggttcactatggtgtacacctaacaagttgagtactatcactgctcagagagtaatggggggacatccaaacaagagacatttagaggcaattccaaagcaacacaaaaataaggctgatgttgtgacacaacctgagtgaaggcaaggatccaggtgggaagaggtggcggctctgggaaagatgacctgacttctggagaggagtctaatttgatgggtggaggggatgggaaggaaacataccatgaatataggggagatgaagcaggtcatttcctgtcaccaccctggtgactgaaagttgccttatgagcaagcattgttgctttcaagtggcctgatatgtggagcctcagggtgaaaaacaaaatcaattttaacaaattaagaaatgttctcattgaaggaagaaccatgaatagtggtgtattcttggttttttcacttcttgtctttatttctgttgcatgttggcatagttacttagcttaatttaaacttaatttaatatcgcttggattcaggaagaggactgtgttttaaaagaatccagagcccttgaaacctttttctctagtttaatagagttcagaataatattttccaagcattattttctggactgtacttttccaacaaagctttgtgcctagtttctttcttcatcagtgatcaattcctacaaaacttcagtttcttcatctgacaaatagaaattattgctaagtgtctcatgggattattaagattaaattgctataatgtgatgtgaaaactgtattcactgaaaaatgcgttagactatgctaaagtgacattatattattaaatgtaaagctataacttttatctgactgctatatttaaaaacagtaacaaattttattttatttttccttggtcttggcttaccttcacagtaacctggagttttcaactcatccaaaccagttcagtgtgttttgaaagactacgtactttggagcacccatcatggtcttggaaagaggatttgaaatgccctgtgttgaaactagtgagatgaattatggattttccccctgcattttcttaaagcaatccagaagtttattgtggagaacacatttaatttgagttgtgtgtcttaggccctattgtttcttaggtcatgagaagtatttttcaagctgtctttgttgatcagattaactagttattaaatatagaatttttggaaaagaattatgagaatttgttaaaaaaaaaagactgttctctatcaagattcagccaaagaaaacgtttaaaagtagaatttgttaaatctaaggatttaatttttggcctgtaaaagctatattatacaagttttacatagaagttctccaaagctgagtttaagatttatttagagaggattatattcactgaataccaagcagttctttttactgtggctttgtgtaaagagtttaggattgatttacatggcctcttatttttaacttgagaccaagacagtgtagctagccaaaactatgtacagtgtcaaatgcattttaactagatacagataaatttatctttgttgcccagcatgaaatcagccaggtcatttactgccagaataataggaacagaatgactttacaggcttagcaaatttggctctgttttttgataaccataaattttcaggaatcacaatataaaatgctggaaagatgtcttgtggatttttaaaatattaatcggtgtggtcatagtccatggttatgttcttaatacttaagttttttctttctgtacttgaaaaatttgaacacttatacatgtgcgtttacatcattcctttttgctccctaatatgtagaccagtaactttttgttttccatctaacacagatgtcccctataaaacatctggctgaaaacaaagcagatttgtgttctgtggggggcagcagactcttctcatttagcatagtgattttggagggtgttgcaggaaatgctgcctgctgtgtcagctcctaggggagaagggaatacctccaagaagcagattggaaacctagtggaaagaaccctggcatttcagtggcagcatgattgtcctcaaggaggtagagctgaggtgtggcaccaagatccactctacccagggctgcttaaggccttagtttctgaattatgatgcaaaagaaaggaaaagaggcctgttgttagcacaggttcttttatttttatttttattttttaattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagggtgtgatgttccccttcctgtgtccatgtgttctcattgttcagttcccgcctatgagtgagaacatgtggtggttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggtatttctagttctagatccctgaggaatcgccacactgacttccacaatggttgagctagtttacagtcccaccaacagtgtaaaagtgttcctatttctccacatcctctccagcacctgttgtttcctgactttttaatgattgccattctaactggtgtgagatggtatctcattgtggttttgatttgcatttctctggtggccagtgatggtgagcattttttcatgtgttttttggctgcataaatgtcttcttttgagaagtgtctgttcatgtccttcgcccacttgttgatggggttgtttgttttttttcttgtaaatttgtttgagttcattgtagattctgcatattagcccttcgtcagatgagtaggttgtgaaaatttcctcccattttgtaggttgcctgttcactctgatggtagtttctttagctgtagcacaggttctttccagacctccccactatgatggaagacgatgtatgtgcctgatttacttgggccatgctaagttcattacagcacctctaagtgaatgaaaaccatagagagaaatgtaccagtgattacttcaaacaatatcttgtttcttactgtaacaaaatctgtttgggaaaatgctgtcatttagactcattttacagcccaggaaagaagtgttgtggccaaggaccaatggggcagctctacccatgaattctaatattccagggccgttctgttccagaccactctcatgagaagaggtggagaagccctgggttgatttctagcctccctccttcctggctgcctaaacatgggaagtgacttgaccctttctctcaggtgcctgatcttgcaggaacgttatgtgctcaacagacttcatagggttatttgaggtgcaaatgacactaagtatattgtagctcttagcatattataaaatgctatttaaattagacacgatgaagttgttgttattctgatatctgggacttgtattttttattgtgtgtttttagaaggtggaaaatatagcatttggtatgaagaagaaaataaaaaaaacagccataattttacaccaagagctttacaattgctgttaccattgccgttgtgtgtaaatgactcagaatgtgcatagatactctactatatatttaattttatatcctctattcttttgttgtaatataatggcataagtattttttccattttacaatatcatgttaatgattatttaactgttggctatttagatttctggacaattttaaaacaatgtgccaaattagccagatgagtctttcctttgcttagtcacctttagtctctagctgaccttattttaggatgtggtgtgacaggtagcatggagaattttggattctcagggttaggttcaattcctatagttctagagataagagggtttaaacctctactatttactctatcaaagtaattcttttgtcagacatatttcttacatttggggtgggatgctggagattgtgatggatattgaaatatatcatatgaaaatatagataggttcttaaaagctaagaggccttggatctccacatcagtctttgaagagttgtcttgctgaattattcttcctttccagttttccttttgatcctataggaagaattacccaaattccaagtcactggaataccagctaacatttacagagtccttattctgtgcccacatgtttaacatcatgtctcatttactcttcacaacaaccctgtaagatgtgtgctgtttctatgcccattttatagatgaataaatggaggcactcagaggttaagtaatttaagatcacatagtatgtggtagaggtgggatttcaattcagatcatttctctgggaaatcctagacattagatggcacagatagctgagaagtccattcattttgtgttcatgctttccatagactgcatattttcttcaactattctcaaatatctgcagtccgtttaaagtcaagaattccaaagaaagcatttttttacagaagagtgcttggagaacatttctagcattgtttaggaatatggttgaattattagtaccattgcctttcattatttaatcatgtttaagaaaaggtaatgaggtcaaagtaatggcatggtgacctgtttttacttgagaataaaatgctaatgataggagataggtacccttattatagaataaatatgaagatttttgcactgaactttcatgtttcattacctttcttcttcttctttttttttttgtacaatagaccctgttattcctggtaaagatgaagttacccatttcctgcttttcccctgactttctttctttttttttttttaatagacggagtctcactctgtcgccaggctggagtgcagtggcgctatctcagctcactgcaacttctgaccccctggttcaagatattctcctgcctcagccttccaagtagctgggattataggcacacgccaccacgcccagctaatttttgtatttttagtagagatggggtttcaccatgttggccaggatggtctcgatctcctgacctcgtgatccgccaacctcagcctcccaaagtactgggattacaggcatgagccgccacgcccacgccaccccctactttcttatggactaaagttaaatggacctttgtcttatctgcaggaaaatggcatttgtgttgcacacgagcaaacttacgatgaacagttcaccatacatatttccttctggacatttgctgcagtgtattcagtgatgcctaaagctttgtgacttctcagattagtggatgcttcattttgcctgatgtgttaaattcaatgaatgcctctaataaaaatcttgtgcatagcaagaaaataacatcacgtgtgaatagtattcatcaaatactgtgaggcgcttcccagtgttcgcttacttttagtgtgagatgtttatcatacctttattacttctcattttacctgattattataggctaattacagttgtcagagtgccaaaacctacccttcaggtcatgttttaaaaatgtattaatctgttttaatggattgtggagatttcttatgacaatcccaactcatcattaatttattcatgtaataaatatttattgcctgcattctctgtgccaagctgagtactaggaactgagtatatgctaattaataaagctgttatttcaaagcattttaaggaggttgaattcctgactagctactaggaaaaatacaccaaatattattgtccaataaaagaacaattctgttcagctcttttcacgttttcttagaaaggtaaaaagaaacaaattctcctattctgaccatttccctaattcccatctagcaaaaaggtgagtggtctggcaggtgtggtcacttctgtaatattgggcatacctgtatacttcttacgtctctttgctcctttcttctgtaactgatgccagacttactccaaaaataagagcctcaaggccttgaagttactgagaagcagagtaactgtgcatatttttttctcttatatattttgaaaatggtcagagtctaactgaagccatgatctagtggcctagcttccttgtgaggcagagaagacattcagagggaagaagttcccacgttctctctggctcttcagcattgttgtcttcatcgcttgtaatatccctgggaccctgggataggagaggaagaactggacctccagaatggtcatctagacttttccaacatatctaaaaggcaaacccaaaggcactttgtggtattctggtgacattggaggagatttctgctaaaagttaataatctttatcatagctgagatgatgaaaatcatgatcaacatcagaatcagttcatttccacatgcacgtgatgctgtattggctccaggcaagttgaattaaacagacacaagtcctgttctcatgaggccactggcagcatgttacatgcaagcaaccaaaggacatcagatacagacatccgcaaacaaatacacaaagaccttgcattatggtcatctcaggaaatatactcattaagtttgcagatgacacttgggtcaggattatcgaccttttgacattagtagacatcatggtgacctgaacatattgtcaagttggattatcaaattggaacgatggcttgtatattcaatgtttatttaaggtagatccagtctagtctggaagaagtttccacaatgacgcctatccgtggtcagttctcttctctcttgctttttaatttgaaacatcacagtttgcatttattaatcactatcaagtcgtcatcctcatagcgattatttggatatctttatgtcaggcagccactttatgtaattatctctaattctcacaaaagctctgctgcaagatgtcattattttcattttaaggatccatcaacaggtttaacttttaaagaggtatattaagtgatagctgggattcaaaccagaaactgcttaggccgagtagccaggtgcctttctgtctagggtaacaggtgggttgttctccacctgttttgtgtttgattgtgaaccttaggttctcaacactgacaataaagcaaaaaccaagacagtaagtccctgcccccatgatgcacattccaggggataccaggcaacatccatatggccttcaggaggcttggacaaagggggatgatttaggagtgtttgattctttatatgtagattattgatgagtgaagttcaaaaacagtctgtaaaccctgagcatctcagagttaaatacagtatttcttgaacatcaaagccactatataaattaatgtaggtgttcctgtttataaaatttataaaatgggaacacccacatttatttatataaaaacccacaagggtgacattttaaaatgacaggaagctcaactgaagtgtgaatcacaaccagaagtcaaacagaattgtacctgacaagcactccaaatttagacagggttctcagagaggtgcttaacagatgaaaagtctgaaaaatgggactttggggtttccaacgagttgtggtgacttcagtggtattttatgaaaaacaacacattgatggtggatattgaaatgtaccatgctgtgatttaatgccagaaaatctctggctgccacttagttttgagtagatgcaaggtaacgctattaaatgtttggttgttttggaatattgatttgttgggctctctgtcaaacactaagttgagccaaattatatttaagttgagccaaattatattcacacttcgtcatttcactcctatctgttgcagtatttaaactagaaactatttttgccatttttccagatatattatttttattaagtgtcatgtggactggtatatactgctagaattatttgtgagtcactctttgggtagaaggagagaaagtaactaaaacaaaagaatccaaatggaaatttgtggagaattgaggctttttaaatgttttgcttacagttttattgccctctcagccatcagaagtgaaaccacttatgtgctttgaacagcagctacctatctaatcttctaattttagaaaagggagtaaatatttgtctttagatactttatttttacttatcataaaaatacatgtgtaatggggtatgtttttcttctcgaatgtgctggggcttacttcaaggctgtaactcgaaattggccatagatgagaagaaatgccagttctcagtttaagaaagccagagtggggttacttcattccctgttgctccaaatgcactgtttttgtgcccggctgattgcagttttaagaattctatccaggctcatggtttcacaactcctccctcaactcccccatcatcgccaccaccacatgcttcctctgagtcttttaaaagatctgtgtgaccccatcccccttacctgagaccaggattgtgttctgatcagttccatatgcttccatcctcatatggctgtgtacagttttgcacacattgttcctaaccaggtgttgcattcatcacatctgacataatgatcactttttcttccagcctatggatcattcctgcagacacggcattctgggggttgttggggcacagaataaatactctatgggtcttcctgtctgcatccttggttgtctgagttatggccacaactgcacagttctttgattggtatcttatctttagcagtttatgttactaaattttttgagagaaagttttgttgcagtctggtttttaaccagacatctttttttattaactcatttaattcattattaactatttgttggttattttgctgctgtatgcacttgcagagtgcatactgaagtatgatgcagcaagatttttaaaaatctctgccagtcaacacacacgctaggacacacaacagcatgtaaatcaaaattaatgattatgtatttatcagtcaagtataatacggaatgtctgtgtttgataaacatctgtacatctatttgcatactcacagaagactccattaatcgttctgatcatgaggctgatataattggaaaaagtatgctttctggccactgtaccactgagaatgggaagttggtatttgaaagacagacaatcagctatgaaagagtgacgtagtactgagtagataatacatgattgaatgaattgttgattaataggcattttgttatactaagaaaatggaatttagaccaaaaacacatgttcatgtatagatagctcatgtgaattgaatattgatattctacttagattatgaaaatttggctgggtgtggtggctcacccctgtaatcccagcaccttgggaggccaaggtgggcagatcacctgaggtcaggagttcaagaccagcctggccaacatggtgaaaccccatctctactaaaaatacaaaattagccgggcttggtggtgttcacctgtaatcccagctacttgggaggctgaggcagaagaatctcttgaactcaggaggtggaggttgcagtgagctgagattgcaccactgcactccggcctgggtgacaagagcaaaactctgtctcaaagaaaaaaaaaaaaaaaagagatttaagtgaagtcatctttgttatgaaaaacatgatatactaatagaaattctccttcaggctttagggtattctgaaaatcagaagggaatagctgggttagaacaatataagcaagaggggttttcttttattccaactacttgtagcatatttgtttaagcacttcctgtggtatttggggttaaggattacactggaaaaccagtcagaccccaccattagttctggctacccactttctatggtgcaagctctctacggtccagagtcaaatccctcaagtcaaagtaagtggttttcttttgtgcttgtatttctttcccctgatgctggcagttggccagtggggtttagtggagaaaatagtctctggagggacaaagatcttgattttatttccaggcccactgtgatgatttcatagaatagtgccttataaactgcttttggcttattgggagaaaggtattatttaaatgccaagtttctagcattaatatttctccatgcagcagtaaagtgtgtgtttatattactatgtgaaggaggtaatggatgagaaagtggagcagtactgtagggaattgaaaagagaaagcttttatcctgatctgacttaaagaaaatacttttatacacaatggcactttcctgaggcgcagacgctaattctgtttgtttctcaatgtaaatgaagctgtatggccaaagcactatgatggatggagcactgtgatgatgagctttgcaaagcatgatttgccatctgatttggagaggtcattctaacaattctcaacccacagagcagtatttttcctataaaggtagcgttttgcaggtggaattttttaagaaaagtattagaatcaattttatttaccttagctactgtctttggccacgaatgtcaattgagaaatccagtagatattctgatcattactaacttattcctgagaaaaataagggatattggatgtcattcctgatctattcagggagttccagctctgaattaatccctactgagcatatactccccactaaattatatgttggcctggatgccaaattcaacataagcaaaatcaaatgctcaatcgagttctcacagtggccttccatatcagtgggggtcttcattcttctgagcctcaaatctttgaaacgactttttctacttctttcccttcagataacccctcaaatagcaaatcctgggtctaattttataatatctttacatctttcctggctgccgcaatcccattttagatgtttcttatagctgtggacctctaagatcctcaccttgttctcagcctatatctagaattgcttcatccttcctcactaagtgccttactccagacttacctctgatgttagcttcacatttcttaatttgccttctaattagatctccctctcagtcctgagtcttgatcctgcccttggcactaatatctggttctcattccctactaaaattcattcttgctcctcacacagcctagcccttggttactctgggaaaagttccctttctcagtccatcaggctctcagaatgctgtcctggcttggacgcttgtggccagtgttacagggaggacaactctgtccagtgaatggcaattgtactcgattttccttcacagagatggatccttaatgtgtgcttgtcaaaattccactcttttttaaaaacccagttctaatcccatctgcttcattatgtctctcagtaccagcagcccacaggtttcctctctcctctgaatgtcctattagagcactgatgaattattctcttgatatttactgttattgttcagaatatggccatgtgcaaagatgaaaaacagtgactgtttatatacaacttgtcttatcccccccaaaatatataagcattttgagggcagaagtcatagtatgcatcctcacattctgtgtggtctttgtcccagaagcatatgtttaatagacaagcattcatgactggccgactttctaaactcttcttaaagcatagtggtcataggaaaaaagataagctcagcctgaatacagagctttgaaatccctctctctacacccccatgtttcattctgcaaactaaaagccatgctggctgcagagcatggctttaatctattccataaatttaatatcctgaatctgaacctcaactgaaccctgcacaggctgaaactacaaataatttttcatgggtgtctcacacaaaacaaggcctgaacaaagacccagatctcttttaaatggtattattaacaagcaaaacttgcagttcatctctctgccctaagaggtttacaatggaatttttattttttgctaatcaacctgattgaataactgattgatgtctgccttaaatagtgctcattcccaaatgtggtgttacatagatttaagtaacagtcgctaatatttttcaagattaagccctctggggcacttaaatcctcacttataccttcaggttttttaaagacaggaaagtagagattggggtgaagttactcctttgaaagaataaatcattttgaagggaaggaaaaggggtgggacgactggtgttgctatccatggttctgatttgttactaaaagacaggattcatctggagaacatatcactgatgtggtttacagagtcatcatcctcatcgtcatcatcatcatcatcaaatgctgagatataactacttttacactataataaaattttaaatattgactatatttcatatgtatgtgtgtgtgtgtatataaactcacatgtgcatgcctacctaagggtgagtccttggtggtagttttaaaacagtatcttctaatcttcaaagtctgtataatataatgccatttgtgtaaaaaaggagaatatatatgtgtgtgtgtgtatatatatatatatatatttttttttttttttttgtcacagtcttgctctgtcgcccaggctggagtgcagtggcacgatctcggctcactgcaagctctgcctcctgggttcaccccattctcctgcctcagcctcccaagtagctgggactacaggtacctgccaccacggagaatatattatatacacacacatgcatacatatttattgttatgcatacatttaacatatacatatattttcattatatggttaatttttttttttgtgtgctctggaatttctttcttttttttttttttttttaaattatactttaagttttagggtacatgtgcacattgtgcaggttagttacatatgtatacatgtgccatgctggtgcgctgcacccactaactcatcatctagcattaggtatatctcccaacgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatcaaaaccactatgagatatcatctcacaccagttagaatggcaatcattatatggttaattttttaaagtttatttttaataaacagttaatttttaaaagtttatgcctttttatatttttaatactgttttaaaaatcctataataaatcagaactgcttaaaaatagaaataaaagacctattactgacctcaacatcagtgcactctggcaagctttaaagaagttagaatgaagttttaaaaatcctgcagtcaacataaagggataaaatgtgacatggatttatgacagtgtggtgtctgaatttgttatatttaatataagtaagaaaaataaattgaacagcagtacagtggtgttctccaggaacccgtcaaaaagaagcactggggaaaatgcggggaggtttccccttattcttctgaaatctccaaaaggaatgaaaaatggaaaatttagtaagagagaatagacactgagttcactccctgtttattgaaagaaagccagctggttaggaatagtcagcacgagacagttcattttctcttgccggtgttttaatagggcccaggggctggggtagaactagagtttatagattaataaaagtcacaacagagggcagaggagcaaagtccatgaatctcaaatcggaggggaagtttcaaaggctattctactaatgcgtccaggttggtatgtcgaaaatcaagtcattatttatccatttacccattctccctccctctcagcccctcatccttgagccctggtttctgggaacggctgttcttctggccatccatgcttaaaggctctgagtcctctctaatctctttatttgccttttcagcgaacccagtgaccagttttgtgaaatctgtctcttgctgtttttcagatctgctccttctcataactcctactgcattctccatagtttgagtgctcattaccccttagagatgagtatatacagaacgcatagtgtggcaggattcatgatgccatggttcatatccccaccgcactactttttatgtagtggcaaatatacaacttgttagttgtgtaactagttgtgtaacaagtccccagcttgttagttgtgtaagctgtgacaaatgcacaactcgttagtgtggacaagacctcagcaagatacacactcctagcttctgtttccttatctcttaaatagacataaccatagcaagcagctgcttcattttatttttcaggtctctgctcacatttacctcctcatagaggcctttcctgatcaccatatctaaaatagcatccccattactctgtccttttatcttactttattgttcatttgtgactacctgacattctatcaagtgtctgtttgtttggttggttgtttctctgtacttcccctacccctctcccaagtagaatggaagtttctcaactcagtgtttagttattagcataataatagcccagctatgttgtgaaggtcctgagatttactttatttgcaagctaaaaagttagactgtcacattttcatggatactggcaaaagatagaaaactcctgggtcagaaatgaaggactttattacagcacagcaggcaacatgagctccatgtttgtactggttttccccatgagtcccatgctggagatgtggagtagcctcggggattcctgggcatatactgatgatgtgtcactgctgagaaattccaagcttagaaagccccctatcttataagggttgctaccaagcctttgccccagccaaggacattatcctggtgatgaaacaaatatgccctttaccctgaaaaaagacattgtctctatcttccaaggctgtttgctcgacccacaaatttgcaaagataatctaagacaaaagctgtcatcagacatgtagaagtgtcatggagaattgctatccaattctgcttttctatcctttatcttccatggcttttacactaatcctgcattacaccaaactgcagcacatgctgtttccctttgtgtcaggtagcttcctctctttatgcctcagtgtgtgcttttcattccagagtctcctgggtaacaccagatctcatcttcaagacctatctcttcccctagatatctgcatagcttgcttattcacttccttaatgtttgtgcttagaagtccccatatgaggtgttcctcttatctgaaatagaaacctgccccccacccggcagcactgtcccctttatcattatcaccctatgacatatatatgtcacaatatataatacatataatttatatatatatatatcgtgatactatatacacacacattgtgaaatatatgtcacacttgtctatgtctcctttctctaaaatctaatctctttggaagtaaagacctcaaatgttagatgtgctgctgtaacctcagtcccccaaacactacctagcacatagtagacggtaaataagtattggttgactctgttaattttgcattttcctttctccatggctatttccagatttactaagtagaaagtgatctctgcatccgctgagcccttgttctacttgacttgtctttctctgtgatgataatcctgttctgccccttattatgaaggtacatacctgccccgctcgctagactgtgagcttcttgtaggcagatttgttctcttattccagtggccgcctagtacctcacacagttctttcatttagtaggcactcaatcaatgtgtgttgcatttcatagtaagtagaaagatcaggcagccttaaatatagcattccttttaatacttgtttacttagcatctttagtaattggaatgcactctctaacagaatttggaggaaataactgatgccaattggttgaagctaagggaaaagagatttcagctaaatacaagggaaaacaaatggaacttcccaaggtagtgactgcctcagagattgtaagcaccccatcctcaaagaagctcagtcataggactcaggctgagagactacttagcagaaggttggcagcagattcaaggacagaatgagtgtttgggtggggagtgtggtttgtctaggggttcatagacgtctctcctacaggctagcttctatgacttctgtgtgcatatgcactcatttacccatccatcacataatgacatggagcagtactttctaagcctagaggtacagttttcttttcatccttttgggttgagctttgattcttttggcttttcaatttcacagcaatttgaatacgtctcctttacttctcatgttttcagtgtttgtttacaagtctgtctttctaagagactatgtaaccccttatgagcaaaattcgtgtcttatttaactacctattcctagtgtttgtcctagagtcttagagctccttggattttcacagaatgaatgaattatcaacctaaggttggtcatttctatatttttattactcagattttgaggctctttgctacctggacttgctgagtgacccaggaatattgcctttctttctcacatgatatcctctctactttgctccttataaaacaaattcttctttgaatttctgtagggtaatgatcttgtcattgctaagagtagtgagatgattttctcgtcatctaatacagttctgttatcatagcaagcaagaaagtgagttattcagtgcccagataaaaggaaacatctcaaaaggcaattactaattgcaccatataagctcagtgatgagagcaagttccgtgatgagatataagttgagtttctcaagtaaaaagaggtttgaatggtgggggatatttttaaaataaagtagcagctattacttgccatctctaaagtgatagtgatgaaagtggagttgtattccaaatcacctggggggctcaggcttcctgtgaatggcagcctttaattctaagaaggtaatttaactttcattaaagatcttttcccttctacatagcatagggcctttttctgaacagattcattcccttctaaggttcttcttttattaatcggtaaacatagctttctagatggctatcactataataaggaaagtattgaagttcagaaagctgctactgagaaaaaaaggggcattgtacttttagtccaaagaaaggtgaggctgaatagtaccttagtgttcattctcaactttactttgatttttcactactgtaaaacaagctaccattcttcgcttaaatcagggtaatttcagagagaaaaccagtgccatgtgttagatgagatttagtgactgaatgaacagaatgaaaagacgagtgaatttcaaaaaaattgtcatggttattaacaaaagagagtgcccatgaacatgagggtaaggattaaaagaccacacagagggttttataatctaaaccagcaagaataaagcaagacaaatgtacttatgtgttgttaaagaaataaaaaaaaattgacttgtacataaaggaaaataatcttttggcatctgaaagtgtgaatatggttgagcagtaaagtgattatgaggctactttttcaagtgagatggctggtgaggtttggtggttgagaagtcatcagtccttttcattatgatgtgttgaaacactgaagagtctccagggaccttgatgaccagataggcaaaaaatgaatccttaaagattatgcaaacatgagctggaaggattagtgtctaagaaggggagatcagaaaaatgttttgattatggtgcttttatcttctcctcatttttaaaatttcttaaatatctattcatttattttgtagtaaataatacgaaaggaaatgggttgtactttggcccttaagcactttagtgtttggggtggagtgaaatgtgttttagcctctgtagcatcacttctcattggctgatgtatcattgttgtgaatggcttgttgacatgtcactgggcttacaggccaagtttaacttttcatgttttttacatgacctactggcactcctcattcctgactggtttctgaactggtccacttgatgaccagagagcaagggatgtccttgagcatctttgaatcctgacacagctcctgatatggagaagacgctcacactcagtaaatagagaaatgaactgaatcaggttaatcacaagggacaccggtggagatggtgtgcactagtgcaaatcctataatttgaaggagaacttgaacctcatgcataatgaaggacgagattaagttaatcctttggtataaagggaaagcacatttaaaaaacgaatgaaataatggggcctaatcctcacatgtcacaactgcctgaatgggtagattttatggcaggataagggaattggcattgggattcttaaaggttgcaaaccaaattaggattttgtgatcttctggtgctggttggcactcaattctccctgaccctctctgttgaatttaatttcagctacatcattgttattgttcaagtccaccaagaatttaacatccatcagcacacactagagtagtacactatggctgtgttaaaaattctgttcaatgattgcttatttaactcatgttggctttcttcaattaactttttagtatatcaagatatttgaggttgactaagaaatatgatttttcctcactccccagagctatttgtgtaaaagatattattaaacatcaactattaataggcccaaagattctaatgatgatagcagttatatgttaaagtattattcagttataaaatgaaagtttaacagtgctttaaacatagtaggctccaactatgtgctggagctggcgtgtaccagctcacttgagctgactgttaaaatttccagaattttctgagccagttgttaaacacttggtagctgtaaattagctatggatgtcatggagggagcatttataccagggaaatcagcagtcattacaaatcagggattccacccacctcagcaaaaagccagttgttaaatatttttcagcactctgctggttttcagtcatatttgtattgaatgattttaacataatatattagagtctttgtattttatttttattctgacaactccactgttattgttacttttgctctctttccatagccaattttataagggtaaggacttatacatattttttaaaatacttgcaaaactgcaaatatgatttcaaagaaaattaaattatgaacttgaatagtggaacagatttattgccatctttgggataaaatttttgagacatttaacaaaagatcatataaaagggtaacagataattaagatagaaaacatgaatttttatctaattttaaaaatagtaattggaaaaggattctgttagaccacatgggacagccaggaaactgtcttagaggacttggaatattggaaaataaaatggacaaagaatgggaaagtttattttagaaaataatactttaatggaagggatctatgcaacaaccagattgccacagtgcattaaatgtctcctgaaagagacatgttagaggctttcagatatgcatttactctttcaggtcattagaatttggggatggattgacacattcttagcaaaaatcagaatatgctcatgtttcttaagcagccacacttacttgatatggtcaggtgcagtactaaacaatctaaaatagtacacaggctcttcaatcctgcatctcataatcaggaggtccagaaaacaaaggcttccttttttctgcaatacttagtttcattttcttgggttttctattgtctttggaaagtgatgtgaaggagaataagatggaaagtgcatggaagtcatgagatagagtttaaagggagaaaaaagaaacagaatgagataagatgaggagataaggtaaatcatcatgggtaggaaattacatgtgaaaccactcccagcctccctccacttccagcccagcaatgctactggatagatttccaaagccaaagctatttccagagtggaaggagccagaatccggagtcctgaggcttttgcagcatttgcccacaggtgctgtgaccccagcttaccaatgctcaagaataatggcagtcgtaaacttgcacactatgcaggatcttgaccatcactgtcaaggaaagagagaagctgactttcccaggagcacacagcttattagtaaagctgaaagtaaagtctcttattttccaatttagtgctgtttctagtgtgttattcttggacatcactgaattgaatgtacagcctcatttgttttaaggtgacaaataacctggaaattattcagttgagtgagacagtctgccaaatggttcagagggactcaggactttaccacactgagggaaacccaagactgagaatatacattctttataatagcggtgtattttgagatcagaaagtttaaatgtaatctgcattccataaacttgcaaaggaaaatataaacagtattactttgtgtaaagaaaaataatattgtctttaggtgcctgtcaatatatataatagttattgatttcctaaacaatataaaagaatatttttatactgttttagttgtttctttcttgggctaacatttaaaatattatcaagaactttatcagaaatgctttgtccctagtgaaaggtttccagttttagcatatatccaatgctaaatatatcagttggctccagcttggcattcacagactactttttaatttttaattgacaaatcagaaattatacttatgatatacaacatgatgttttaatatatgcatacattgtggaatgactaaatctggcaaattaaaatatgcattactttacacccatatcatatttttgtggggagaacacttaaagtttactctcctagcagtttccaagtatacgatatattggtttggggttttttagagacaaggtctcactctgtcgcccacgctggagttcagtggtgcgatcctagctcactgcagcctcaagaactcctggggtcaagtgatcctcgtgcctcagcctcccacagtgctgggattacaggcatgagccaccacacccagccctcaggtatttgatatactattgctcattatagtcactatgatgtacaatagatctcttgaatttatacttctgtcctaactgaaattttgtatcttttaaccaacatattcccaattccctcttccaatctctggtaaccacctttctactctccatttctatgagttcaactactatagattccacatgtaactgagatcatgcagtatttgtctttctgtgcctggcttattcacttagcataatgtcctccaggttcatccatgttgttgctaatgacaggatttccttctttttttaaggctaaataggattccattgtgtacatgcagatatatatactatgtttttaacccatgtatctatccattgattgacacttagattgcttccataccttggctactgtgaataatgctgcagtgaacatggaaagtgcagatctctttgacacactgattcatatcctttgatatatacagaaatgggattcttggatagtagggtggttccatctttaattttttgaggaacctccatactgttttctattaatggctgtactaatttacattcccaccaacagtgtacaaggggttcccttttctccacatcctcgccaaatcttgttatcttttgtctttttgatagtagccattctatcaggtgtgagatatctcattgtagttttaatttgcattttcatgatgactactgatgttgagcatatttttgtatacctgttggccatttgtatgtcactttttgaaaaatgtcttttcaagtgctttgctcgttttttaattggtttatgtgttttcttgcaattgagttgctcgagttcctcttatgccagactatttagaaagagtgaagtgtgatgtaggtcatgaagttcagctgcccaggaaacagctgattttcacttatgcaaacttggttctgacttcactcacttggccaccagtgctggcctttatgtgctgtatctatggctttggagtttcaaatttcaatttcattctgttgttctggtctcattagtcccagtccttctccttgaagttagttatttcatatattttaagtcgagagttactgaaaatgggaaatgaaaaatcattagctttacaggaatggggtcataacacactccgcagagggctctgagtcttggatttatctgtgaagagattggatgcagccactttgtggaatgtcccacttcagtttctttgctattacctattcctcctgtgctctgtgctggcacagccatcagatttcagagcaaagggttaatgaaatttcaaacaaccagtttacttttttggctttcttgagaatgtgatttatggatctagaaagtatcaccaagtcatggaagtattttaaggaatgtgttatatgtgacattgtctgttaaatcacagtcataaaattgttactgttcaggcgctgtttagctgtgtgtgttagtttatgtattaactcagatgctgttggatgattagagacccattaagtactatttcaattacttcagtaatttgcattgtgacatttaagttagtcatataatcttaagtaaatgttaagccacagtagagtgtatgtttgcttctgcaagcttattaagcaaggagagaaattcttattagaaaagaaagtaaaggttcatcctaaccagttctcataactttctttaccaaaataacatttaggttttttttttagatattcttcctgaatcttatcatttaattgtaaacttagggtttgtttaaaaaagcaacactgcaaaatagaagccagtcttctttcctagaattgggtcatgaattaacctaaactgtactaagaaagttaaagtgttgatttacttcaacatacctttactgggaccctttattgagcactgaacttggctctgaggaactttttttttttttcttgacttggagtcttgctctgtctctgaggctggggtacagtggcgctatctcagctcactgcaacctctgcctcccaggttcaagcaatccccctgcctcagcatcctaatgtagctgggactacaggcgttcaccaccacacctggctaatctttgtgtttttagtggatatggggttttaccacgttggccaggctggtcttgaactcctgacctcaagtgatctgccagccttgggctcctaaagtgctgggattataggcgtgagccaccacacccgacctgatgacaaaatttgtaaagctcaaatatgcaaagtcaaattttgactgagaagactatattatattccaatttttaatttgttcaataatttgcttgatttttttgattcttaaaagcttcttctaaaacatttatacatttgctaatgtacttaggggaaagttcactgatgttagcaatttaccttgaaatatatatatatatatatatatatatatatatatatatatatatacacacacacacacatatatagacatatatatattagacgattattatatatatcttctatatatatatatatatagaagatggattttgaatagatagagcatgggtagatggctggatatgtgatgaggtgactatggtaaaatgttaatggcagggtctgagtgttgggtatacaggtgttcactataaacattttttcaactttattgcatgtttgaaaatttccacagtataattttgaaaaaagtcatgaatccttctactcagattaagaaatagaatattattactgcttctgaggtcagtttgattttattataaggtatatatttatttttatttgtagcaaagtaagaaataatgtacttagaaatcaaatagtaccaaagatgtataacaaagcagaggctttacctgtcccatctttccttgaaagtcctgttccctagacttccattttctcaaaaatatcttgggtatttacctccacgtttcttaaaaaaatatgtttattttgttatttcttgatttttcatgtttagatttttaacgtttttgataaaaacttgttatctttctcaatttccctctgtcaccctcctgcatccatatcacgaatttttagtagtcagtagtgtttacattttattgcagagtcaagtagtatactattattatttcatttgctgcaaaatttgctctttttgcttggagttattagttgactcatttttaaaattttgctgagttttctatgtacctatctgtttcttgagatatgttaaacattaatcaatattaatttccatattcttaaatgtatcagatgatctaccaattacacttccttcagaaaattcttttggaagcctacattcccctatgcattaggtagggttgaatgctttgctttctgtacagtcatcatctccacagtacagttttaagaaaaaataaaaactggacttccctttaccattttcatgagtgtgttagtccattttgcattgttataaagcaatatcagagactggggagtttatatggaaaagaggtttatttggctcatgattttgcaggctgtacaagaggcatggcagcagcatctgcttcaggtgaggccacaagaagtttccactcttggcagaaggtgaaggggagcctgcatgtcatatggagagagacagagagcaagagaggggaaggaaattgcagactccttttaacaaccatattgcatgtgaactcattactgcagggagggcaccaagccattcatgatggatctgcccctatcacccaaacaccgcccactaggcccctctccaacatgggggatcagatttcaatatgagatttggaggggacagatatccagactatatcaagagggaacctccttttggcttttactactttctagtttttggggaatgtatctcattttttggaagagtttctctgatggtttcctaacaaaggatacatgtaaaataaaaattgtgagaacttgttcatctgcaatatttgtttttattcaactctcacttatgatgttttatacaatttaagaacttttagcagaatttcaaaggtcttgttgcttccagtgttgcaattataaaatctgatgctattctccctcatatttacttctatattacctatttttatttgtttctttctggcatcccgtaggatctattcattatctctgatattgtgaaataattttgcgaatgatatgtattggtgagaatcttttatcattagtgtactgggcactctttaggcactttaaatctttactgccttgttctgttaatttttcttatattatttcattgataatttctttctctttgttttctcttctttgaaacttgtataagtcagatgttgaacctcctatattgatctttaaagtttgtcatattttctatttcttaatttttttctgacttactgagaaattaattttaccttttaataaagtttttttttaaaatttctaggagctttaaaagttctttattttttggtgtttatttttcagaatactctctttctttttgtggatgtaatgtcttaactctctgaggaaattaacattttttcatggtcaattacactttcccaaatttaccttttattttcccattttaaatgctgtaaatgactgtatctttactttctaacattttctaaaaggaagttcaagaatttttttaaagaattaatggctttcttattttaactgctttccagttaagtgggatgtaaaacaaactttttttccctctaaatattaagtgcagtgatgttactccatctgattttaagtgggccacagatttaatttgagtgaacaaatatatgcttatgtagaagaaagtgaataattctcaataattgggtattagaccaccttaaatgtgtttgaatgttttctcaccagaattcatttagaaagaaaagttattaaaatggaacagaacagacaaaaaattcttttgatttcttgctctaacttcctttaaaataaatgccttgagtttctgttatgatccctttcttcagggatgcagagtgtgtgagtcagaaccatattggtggctccattagatgcctactagagacctctttcaagagggaattcattgaaagcctctggcttggtagtgttgactttcacatttagctgtgttttatggttttgtagctgtttgtaccctttggaagccctgatcataatattgttatttgaacattttctctcctccatgttttagagaattgttgggacttaccttaattgacagctttggtcaaaaataaggacacacatagaagaacaatggttgtattgtggataggaggtggagaatgtttcattggtgggcaattttgactgtctaaatttaggtggtggtttcaaatttagccactagtttctcaaccaatttagtgagcaaacatccctgttttaaatcaggttgcaatgaaaaaggaaatgagaaagtagttttatccatactgtatattgtgagaaatacagacagacataatttaataaccatgtttaataaatttaggatatgcgtggaaatggcctgtgtcagtcccacacaaattgtcctcaatcaggatgtaaaactggacaggatgccaaatattccctcatgtgtgatccatccttgccttgtgtgttaccatttcttttggagtaaagacctgagccactgaagcaaagctctggctttacactgtgttcacagcccccatttgtcctgtccccaatttgaattgttctagtaatgggaggaacagagtagccaagggaatattttccccaaatatggggcaagagaagaagagacaataaaaattccttatagatagagtcatttttgagagaatgaatttgtattctcgtattcttactaatgcataattgttaaagatatcatttatcttactagaagctaaaatttgaaatatttcagcatttagagtgtataaaatttcattaaagtgagtggattgaagtataggtaactgtgtatgtgtgcatgtgtacaagagtgtgtattaaaagcaccgtgaataaactccacagccatggaattcaagcagagtgtttaaaatacttggaaacctagactaaaatataattctattttaaatattctggcatttagaatacaatgaagcaggttaatatattcagcttcctttttctttttagagaacaatggatgagacaaaaacaatctaactgtattacaaatgtatgaaacaacctcactcaagggggtggaggtgctgaacaaagtaacatcggaagtgagtgaaatctgtaagatgaaggcaaaaaaagctgtacataattattgtcctgtattttaaaaagttgtttcccgtaggagtacaggttaacagttctgatgctactatagatgtatgctggaattggacagttaagtaaatggatgcccgatggtggaagccaggtactcactgttggagtggaatgttacagataagcaaaggaggagactaaaatgatgcaagttgtagattagagttggagacatcagtatgaactcaggtttagtttagtatagacacagatggttacatatagaaatatttttcagtacgtatatatacattggttggtatatttctttgctctatcaactgagagggcctagtagcaatgaacacatataatacctggattttggtgtttaataccattctccaatgaaagggaacagaggtccttggaaaaatgacttattctaggactagggaaggaaatatactgatcagcctgaagaatcttatagtgccaaaaagtaagcaagtgctaaaataaaaacaaaataaaacaaacccataatgatggagatacatcaaaaggacacaggaaccgatttaaaatgctcacaatggccaaactggaacaatttgaccaacacattcaataaagtagccttggattataacccaaagtataaagtaaatatccatggttcatactgatataaatagattgaataggtagtaagtgggggaggagagataaatctccaagaatttcaaacaatttaggtagatattttgccctgaaggaagtggaacataactccccactccttaaaatgtgagttgcacatagagacttcattccaaagagtacagtatagaaaggagaataaaagattaacttcacagttgaaaaacctgtcaacactactcagccaggtgaatagagtcaacatcaatagtgataagtcatgctgatagaatgaactcttgacagtatgcacttagtgttataaggatgccgctttacccctgtagtcttcctccccaaatcctataatctcagttttaccatgaggaaaaccttgacagtttgagggatactactcagagatttgcagggtattcctatggaggatcctaaaaactgtcaaggtcatcaaaaacaaagaaagcctaagaaactgtaatagccaaaaggaccctaagaaaacaacgactaaatgtaatgtggtgtcataaaggagatcctgtaacagaaaaaagtacttaagtgaaaactaagaaaatatgaatgaaatatggacttcagttaataatccatgcattaatattggttcatttattgcccagaccaatgtcaagaagcatttctcctatgttttcttctaataattttacagtttaaggtctcacttttatgcctttaatgtggaggtcacttgaactcaggagtttgaggttgcagtgagctatgatcatgccactgcactcccacctgggtgacagagccagaccttgtatctaaaaaaaaaaaaaaattaagtttaaatttaaaaagaaaagttgtctgtattatataaatatctgctacttagtaaggccatcttcattttaaatttagggaaaatatactttattagacactgcgttcaaaagtgttttgctaataaattcataaaaatacagcaacatatttatgtctcttagtcatactttcagaatttcatgattaaattaggtctttgtttagctggatcaaagatttttttttttaccttgtcgcttagttttggaagatagaagggcagtgtatttgtatgtgtgtgtgtgtgtacatgtgtgcacagtaaccctgtctatgcaatactttcaacaaaacattttaccaagaaaattgacagaaatttaaataaaaagggaatttttaaaagtcagtgtttgcctctctggtttagctttagaagaaagtggtgctgaaaaaaaatcaccgatgttcgcacattttgaagagtgtgaattttattcaccaatttgctttttataccagaggccagctgctaccttttggaagagtgaaacatttcagccagaattgcctgcagctcagtatagctccaatggcagaagaaatcctaccagattatgtcctttgatttttcacagattttgttcagaggatctggcaatgggttgcagtttcacacttcagaaatacatggtggccaagagttatttctggagttttcttttaaagccttatcagttgttgagattctctgtgctcctgaatccatttcctactcattccttacctgaaatgagatatttatatcttttctaagttgcttttaaatttgaaaactgcatcttctacaacagtgacagatcaaaatgccagctggacatttgataggattcttcattggtaggcgcctgacgaatgactactaagtcatgtgaaatactttctttagtcataggacatggtgctgtgaatcatgaaatgttagacataaattttacacacaggggattacattctaaaatgagtgctcaagatccttggctgtggaattagagaaacttcattcaagtcttgaatctgctacctcctagatatttgaacacattcttaactttacacctcagtttccttatctgcaaaatgaaaaagaaaaatagtgtctaacgcatgaacactaattgttgtagtattaaaggaggtaactttgctgtgcttgtcatagcgcttagtaaaattaaatagatattaagcattttcattatcatgctggcatttatggaagacatgccagctacctacccacctacctgaatagcatcaccaaatatgttgcttctaaaagatcagttgtgcataagttgcttaggaacatgtactggaaaagcctctgagattatgcatttgattaaaacaaaaacaggtatgtgccaaagaatatcattgctcctttgggatcttgacttaaagttctgccccataggtacctcagtattccatctctcacttctctttcctgaccaaagctaagctctaggctcttgttactgtatttggttctccaggattctctgccctgcccctgggaggctctcattcctgtaaccaggaagcactctggaagaccgaaccatctccgggccttaaaacaaacctcaggggcagggatggacccatggtggggacagtgacctgtcctgcctcttcattcacacccatctttgggaactgttaccagcttagcaagcaaggtaacaagtcactgagcttttatgggacccagcttccttgttcataaaatgagaaagctaccaaagatgaggttgatggtctcttgcttctccattattctcttggattcaataaattactggacatatctaggaaaaataaatgtcacagtcaccgcctccaagaggctttctttgttcacaaagtcttccttttattaccactcaggctgcagtgagctgtatcttaaaagtcttaatgtgtctctgacacattataagccatacccatggaaccttggaagttctttttttacagtaggggattagattttctttctattttttaaattttctttttttaattgatacattatcacatacatgtgataattagataaattcatataatgtgtaaagatcacatcagggtggccgggcatggtggctcatgcctgtaatcccagcactttgggaggttgagacaggcagatcatctgaggtcaggagtttgagaccagcctggccaacatggtgaaactccgtctctactaaaaatacaaaaattaactgggtgtggtgatgcacacctgtaatcccaggtacttgggagactgaggcacgagaatcgcttgaacccaggaggcagaggttgcagtgagctgagatcgcaccactgcactccagcctgggcaacagagggagactccatctcaaaacaaaacaaaacaaaacaaaaaccacgagaaaaaaaggtcacattagggtaatcgggatatccaccaccttaaatatatatcttttctttatgctaggaacattagaaaaattctcttctatttttaaatatgtaatatgttattgttaactatactcaccctactgctctatggaacactaggccttatttattctatctaactgtgtgcttgtacccttcaatcaacttctttcatcctcctcaacccctaccctttctggcttctggtaaccacagttctattctctatcttcatgagatcatttttttttaaagcttccacatatgagagagaacaggtgatatttgtctttctgcatttggtttatttcacttatcataatggcctccagttccattcatgttgctgcagatgacaggatttcattcttttttatggctgaataatattccactgtgtgtgtgtgtgatatatatatcacatttttctatccattcatccattgatagaaacttagattgattccatgtcttggctattgtgactagcgctgcaatagacatgggagtgcagacatttcttcaatatattgatttcctttcttttggatatacacccagtagaggaattgctggatcatatcatagttctatttttcattttttagaaagttttttaaggatagagataatgctgtttttaaccttcctaaagagctttaccaacaattacattcaaaattaacgtattattcattaaaattataaatgtatagtatataaatgtttaacatgtataaaatctgataacttaatatgtaaataaaatgtgactttctatgttatatatatcatatataccgtatatgatcttatacctacacatacacacacatatacccttttgggttcaaaagcacataaaaatataaggagtcattgtgattacaatccgtagtaaatggtggtctagtgttatgtagaacatcaaggtatttattcgacttgccgttcaaggagtccaagaaaaaacataccacactgacacaggacaggcaagcccccaaactggggcttagccccaaaggattcctggctttgcccaggaaagaattcgaggtcgagccggtggtgttggacagcagggtttattgaagcggtagagtgcacagcagcagcagagatgctgctccttgaggagagggctacctcttaggcagtgtgcccagaggagcagctcagaggcagttctgcagtcatatttatacccactttttatatgccaattaaaaggcagtttaggcagaaacttccaggttgtgaggttgtttccatggaaaggggtggtaacttatgggtgttatggcaatggtaaactgacatggcacactgatgggcatgtcttacggggaggtgcttccaccccagcctttattggtaggtgcttctgcctctgttttagctagtcctcaatttggtccagtgtccaagtcctgcctccagagtctagtccctcctcctagctcaatatccatggaaatattatctatttggataatgttgttatctttataactatcacagtgtggccaagaagagagataacagaggttaatctctctgataccttttttaagtagtatataattcaaattgccctaaaacttatgttgattataattgaccactgcttgtctaggaattgtaaggatacctaaaaaagtatgtacgtacttttgccagtgacaaaagtaacaacctgaattccttttgcaacaaaattatatcagcacaagccagcatggtggcttttgcctgtggtcccagctgctcgggaggctgagggaggtggatcacttgagcccaggagttcgacgctgcagtgagctaagattgtaccactgcattcctgcttgggcaacagagcgagacactgttttcaaaagaaaaattacataagcacagactggatgttaaataaataattagattcaagctttaaattatttggaccctttccccccaatactacttaatagcaatataaactttaaaaaatgatgggagccaaagaacaagataattaaaaaatgagttatccagtgcttcatttgtggtttcagtgtgggtagtaagacataggttttggttccaaattaagttttcaatcttaggagggtcaaggcagacataaaaagattattccaaatatcactgcaaaacattatgaaacagatgctatagaaagaaaaggagtgaatgagccagggagaggcaaagagagaaagagagaagatggacagggagcaagtgaaagggagagaattagctgattcgcagagggagagacacaatagcagacaaaggggcagccatgggcagcgatgtgatttggtgggcaggactgactggaggtgggagggtcttgtgctacccccttgatatttggctggtgttttcatggtcatagaggagagggggttgcagcaaaggaggaagccacagtggtttgatgcccagctagtaatatgctgcacgtgtgacctttccgcctacctaagcctttccgcttttataactggctcattccctgagctcccttcctgaactttctccttaccaacaccctttctttcaaatgggaagaggcggcgtgtgctggaaaccattttccctgattcttgttaaatatatagaaatttcgtgagctggtggttaaactgttggtagcctgaaatcagtcctggtgggaatattgacaccttggaaattgatgagtgagagctttttattttcccctcaagagtcagtttacctgctcaccactaagagaggacttgcctgggtaaaaatttcctgaaattcatatggttttcctacttattcatatttgtgattgatatcatgacttaagtccttcaaaatttcaggaatagaattgactgttgggctaattttttaatttaaagcagtttgtaaatccaagggacaaacatgtccatttaatatttaacattaaaggaatgcacgtcacttctaggagatcatcacagggagagctggggaaattgaagagaaatgactttagagatttcaaaataaaaacaaaagatacaggaaaaatatattgtacagacttagtcataattaaaccaaacttgaaatgttaattttaattgataataactttaaaattctaatttaatttctattgattctattctgggagaaaacaaccacgaagtttctattatccttaattccggttttctttttaatccttatgattgcattaatatacacgatacttctttttagactggagactaatttgtttaaaattttttatattcatgacttcagtgataaaattttgagttagttttgaactaagtacccagttcgctactggccaggcctggacaaagaccttccctcctggctcctgctttttctatggtgtttcttatagatttaaaggatggccccattgctcattatctatcaagcttatattattttccagaagtgtgcaaaatacttcatatttgtttgcaaaatgcttcatatatgataaaggttttgcttttgttgcccaggctggagtgcaatggtgcgacttcggctcaccacaacctccacctcccgggttcaagtgattctcctgcctcagcctccctagtagctgggattacaggcatgcgtcaccacgcctggctaattttgtatttttagtagagatggggtttctccatgttggtcaggttggtctcaaactcctggcctcaggtaatccgcccaccttggcctcccaaagttctgggattacaggcgtgagctaccgcacctgtactcatagtcattgagtgccagtcctgtaacagactcaggttggcactttacatattttatctaaaaccctacagccgtcccatatggtaagtattattactccccactcagaaaatattgagtggggagtcacaccaatattgagtcacaccaatattaagaataaatggtttaaactgtttgattccaaagcctaagttctttaccctatgccagcctgcctcctatatattatgcgattttaatctgcctattaccttatgaaatgcacagaaagtattatcactactttatggattaagttttagtcagatagctagaaatgtcctctgacttcctgtccagtgatcctccccagatggccaaaattacatgggcaataacaaaattaaaataaggtcatcatatctgacttaatgtgaaactttagtaggacattatttcaaactgacaaaagcttcttctggattgaacacaaactgcatgtaaatgtcgttaagtggttcatattttaaaagcgtgagtgtaggccaagaaagaaatctccagctactgtttgcctgcttccatcagaatgatatgtttggcgcacagtgtgttttgtatatcagtcctgttgtttatgggaaataccattcctcacccatccacgttcccctgttactaggtcccagctactgccttacagagaaggtgatgtttcatatttgcttgcttgtttgtttgtattataaggaattattcttagcgatgttaaaaatgattctttcccatgcaaggaacttttagacacccaagtttacactctgcatttgcgataaaaggaagtaggaaagtggagcaggagcaaaatgcagaagacaccaaaagaacctttgcagagagagtgtcctgccagggcatcgacggccgctcccggggcaggagctgagttaagtagagccccagcactactttcctttcctgatgtggctcaagggatcattgcaaaaatggactgtcccctattggaacataaaaaggccaaatcagagtccatttgacctatatcctttaaaactgcacaactgatggcgggtggtggggtgggggttgttagaaagcagttctaagagccaaaccgaatggcatggcatgaatctcaaatttatttcactatgattacaaaagcaatagctacttggatgtaaaagaaaaactgggctgggcgcagtggctcacgcctataatcccaacactttgggaggccaaggtgggtgaatccacctgaggtcaggagttcgagaccagcctggccaacatggtgaaaccccgtctctactaaaaatacaaaaaattagccgggcctggtggcaggtgcctgtagtcccagccactcgggaggctgaggcaggagaattgcttgaacccgggaggcagaggttgcaatgagccaagatcatgccattgcactcctgcctaggcgacagagcaagaatccgtctcaaaaaaaaagaaaaaagaaaaaaaaagaaaagaaaaagaaaaaagaaaaagaaaaactgatttgtagaaacataatacctaatttacagttgacaacccactgtggggttctaagccacccaggggagtgaaagaaagattaatgaatggtttaaaaggggcctgccccacagacctgtccccttcccttttttctcttctccttccacctaaagtgttgagctgcacatccagtctgacctccactgctgagacctcacgtctatcaggtggggcctagcagggatctgggtgggaggttcagtcagatgcaaacagcagccagctgtgtagaagccacgtgcaaagcagttcctcctgcgctgacatgacagccacgcgtttcaacaacaaccacaacaaatcgcataggggatcagaagaccatgctattccattttacactaaccacttaccagcagcctcccaggaagtcatcaaatacgtcactgtaaataatactgaggatgtcaaaattcatctttacaacttaacaaatggtacttaattatctaataagaataaggaacctttttatattgtcaaacgtattaccaggaaataatttaaggcctgctggcaataaaatcacaggactgatcttttaaaatcgcatttgatgacatatgtacgaacacatacacacatatatatgtacgtacatataatttgtgtacatatatatctaaataaaccccaatcctttgacaccattaccactgcagagttcaagctacttggagccgtgttatagaaaagcaaaatacttttgaagctcgtcttttttttttttttgtggttgatattggacccagtccatgagcctcacaagaaaaatcactcttttgtgcttaaaactttttagcctaaatggaattatccagtttgatcacacacattatttgctaatttgattttggctattttccaaagtcaaatccagattcaaaggatgatgactcaccactatttcgggtttttgaggaaatgggcccaggctgtgaagggctgaaactccagagacggagtctgagcaatcactgtggtgctgggaaaagcgtaggagtgaggactgttttgtgtcatcttatacatggtttagaaataagtcctgtggcttatcagttatacctgcagaacacagggcaatgttctttcttcgagttgctaagggaacaatgcctcccaagacgcagaggtctgaaataacaaggtgctgggccggcattgtgggaagtgtggcttggtgagagcacagcaatgagtgaatgggatgggagctgatcagttggggagattccctgggacctgcctctctgctgcaggcaaaaaacctgagaaacgtttattctatttgttctgtgccctatatcgataacttttctctgttgaaaaagtttgctttgagtataatatttatttttagtaatgtactgtccccaaatttgaataatgaagatactgttccctaatggtcaagtactatccagactcagtgtgttaaaaagaaatgggtcaggcatggtggctcacgcctgtaatcccagcactttggtaggctgaggtgggtagatcacctgaggtcaggagtttgagaccagcctggccaacgtgatgaaattccatctctactaaaaaaaaaaaaaaaaaaaaattagccaggtgtggtggcgggcacctacaatcccagctacttgggaggctggggcaggagaattgcttgaacccaggaggcagaggctgcagtgagccaagatcgtgccactgcactccagcctgggcaacaagagcaaaactccgtctcaaaaaaaaagaaatgaggaaacagaaacaaagcaaaagaccattggttagctaatcactcttgaatgtttgaatatgagctcttacagagtgacagtggggttcagacaggtgcattcttttggtctgaattagatactcaataatgaaacaatctggtgattgtttaacactgcttcattcaacgtttgcaagattttgaatgggtaaagcctcccttggacgtgctctattttcaagcaactaaaactcattaatgagttcctggcctctgcgtttgtagatctgggtcagtggcttaggtccatgctgtgctcactgtgttatcttggacaagttacttaacctttctgaaccgtgtgtgtaaaattaggttaattgtttttgcttcccagggttattgtgggggttacatgaaatttaacaatttgtataagcatatgacaatatctggcatggaagagaccttcaaatccaataagaaatggaatgtaggtatcactaaatatcacatgaacattttaaaatgttatttgtaatgaaaattctgtggaacagatcttgtttttccattggtttctaatacataatggagataaactttaaccaaaataccccaaatagaactgggcctcctaatagtccatcggactctcttgagcctttcctttgctatgattgtgtctcaaaatcaggttctttgagagcactgggattctgcttgtatctcaaaagtaatacacaattgctttgtttagtagagtctagtatttaacattaaaagtgcattgaatttaccttggcaccatgctaatacaaattataaggtaatggaacgttatgagatacgtgtattcattcagcaaatattgtctggttcactgcaagacactggggaatgcaataaggaaaataagacagacccagtctctcctgctgtgacgctgatagaaaaacagacttccaatggataaccacacaaacacatgtgtcatgtcatgtcactatgactcatgttacaaagcaaatgtatatggtgccgtgagagtgtgcaatagagttgaatctgaccagggaggtcagggaagtgattcctgagctgaggactgaagaaagagtaggtgtcactgttaccggaaagagtcccgatccagacctcaagagagggttcttgaatctcgcacaagaatgaattcgaggtgaatccataaagagaaagcaagtttattagagaaataaagaaacaaaagcatggctactgcataggcagagcagccccaagggctgctggtcagctatttttatggttatttctggattacatgctaaacaaggtgtggattattcatgaattttctgggaaaggggtgggcaattcccggaactgagggtttctctcctttttagatcatacaggctaacttcctgatgccatgtcatctataaaatgtcatggcactgatggaattttctcttaacatgctaatgcattataattagcatataatgagcagtgaggacaaccagaggtcacttccattgccatcttggttttggtgggttttggcaggtttcttcatcacagtctgttttatcagtaaggtctttgtgacctgtatcttgggctaatctcctgtctcattctgtgactgggaatgcagcccagtagacctcagtcttattttacccagcccctattcaagacagatttgctctggttcaaacgcctctgacatcacctgggtgcagataagatgagcatttcccaggccaagaaacagcctggagggcgggaggaagcaaggcaaaggaaacgaggaagttcagtgggtatggaacagggtgaccaggagtctcatatgaagctggagaggtcaccagccctgaagggctcctgtgaaggcgcaaagggaaacgtggaacattgaagtccatgagccatgtggtcagatgagcatttcaaaagaccagcctgaagtctctactgtttggaaaatcataacagaatctctgttttggacttagtcaaatctcaaattataattccactatgcagttggattttagaaaaatcaaatcttaactacaagtggtgtatccattacaagtagacactgagctgctattttttatagtcagtagttaagtccacaagaaatgcatattacatttcatagtaattttaaaatacctggaaagctgaaaagcaagtcttctaaaacatcaacttgattaacttaaaaatcaaatatgaatcacaacaaacaacagaatataggtatttaggccaggcatggtggctcactcctgcaatcacagcactttgggaggctaaggcaggaggagcacttgagcccaggtgttaagagaccagcctgggcaacaggaaaccctgtctgtgcaaaaagtacaaaaattagccaggtgtggtgccatgcacctatagtcccactacttgggaggctgaggtgggagggtcacttgagcatgggaggcggaggttacagtgagctgagttcacgccactacactccagcctgggggacagagcaagaccttgtctcaaaaacaaacaaacaaacaaacaaaagaaaatagatatttgattgccccagctaatgtactaggtaaagaaatatttttcttcacatatagaaattcatggcaccttaaatacttaactcatctcttctgtatgcaccccagagctgcagtaattatcttggaggatcagttgttgacatgttcattccaaataggcatgtgttgaagctattcgatttattcactcaccaaagctctgtaatatttcccagatcatgtcttagcaatgcatatccagttttattgcatttaatgttggtatggagcagcagtccccaacccccaggcctggtggcatgttaggagctgggctgcacagcatgaggtgagcagtgggcaaggaagcattactgcatgagctccgcctcatgccagatcagcggcagcattagattcttacaggagtgtgaaccctattgtgaaatgcacatgtgagggatctaggttgagtgctccttatgagaatctaatgcccgatgatctgaggcggaacagtttcatcccaaaaccatccatcaccccacccccatttctgtgggaaaattgtctttcccaaaactggtccccggttccaaaaaggttggggactgctggctatagaggataatgctacattgaaaatctctccatgtgaaaatagtttgaatccttagatattagccccatcatttgttagtatttgaaacagagaagttagaaaaaaatcaataaaagaattttaatatcttttaaagtttttttaaataagtagatttgattataactcaaggatgggtaggtctctatatcaatataccttgttttggattaatgagggatgctgatatatttttacaacattatattcatgttataagccaaccatcaactgcattatactggttcattataagaatgcctgagaagctgttgactaagagtgtgtctgcttgtattgaattttgagcagttatgtttccaaggaaaccactccattgtcaacaaaagattcactcaaagcaatgcaaaaacgtttgccaaaaataatccaaccttattattaaatgtgacttcaaatgtcctccacagccctaaagcaataattaaaaggggtttacattttttgtcgattccatttaataaattcaccataaaatgtatttcaaataatcatttaagtggtagaaagtaaatgatttacctgaaagatatatccagttttgaaagttaatgtcttagatgtagtatggatctgctaatgaagaattgattagatctttgctttttctattaataaatctgtagttgtgtatagtgaaatcttatttgtctcaaattgttgacagttggctgtgggttgggttgtagtttgtttttgcattatctatgaagaaagtctttgcaagtgtaaaattcttaatatagttgaagacatttttgcatggccatctttcaatattcactgctctagcatattctttaaaaaagctgacaagtgtcaggttatttctaactttaataatgccagatcaacacatttcctgcccaatgttaaaatcattgaagcaaagctctcaaaatacctggttcacaggcacaatcataggcttcatttttatttgtaatcatatatgtaatatgaataaatgtatagctaacatgacagtttgtttcatttaatgtgcttaactttgggcaaatttacctctcaaactgaattgatggaagtttagtgaaaacacagtgcatgtctttcctctccccccaccatgaccatcctagatcaagtcctaattatctctgacttagatacgtaaattgttgcagttagagcactttgcaatttacctctgtgttgctgtaacagtgatcttttggaaacagattaaatcacgtctaaatttttttttatattttaattcagttttgcttcataacatctgaagtacttaatcatggtggtaaaagctgtcccatctttctctcccataccattccctttaccattcttaccatgaattttcacaaaattgccttacactttgctaattagggacattgcctataaatgggcctatacaatatgtggcctttggttcgttttgcattcttttgcctgaaaatttatcgtgttttcatgatgcattcatgttatagcctgtcagtggtacttcattcctttttatggctgagtaacattccactgaataaatataccacgttttgtttatcaattaatcaatgatgaacattaaggttattccaaccttttgtctattaggaattatgctaaccatgagcattcatgtacaagtttttgtgtggccataggttttcaagtttcttgggaatataccttcattctttcacatgtgggtgtctggttgtcctagaaccatttgttggataggatattccttctccattaaattaccttggcatccttatagaaaatcaattgaccagctgggcacagtggcttatgcctgtaattccaacactttgggaggccgaagcgggtggatcacctgaggtcaggagttcaagaccagcctgaccaacatggagaaaccttatctctactaaaaatacaaaaattagccaggcacagtggcccatgcctgtaatcccagctactcaggaggctgaggcaggagaatcacttgaacctgggaggcagaggttgcagtgagccgagatcgtgccattgcactccagcctgggcaacaagaacaaaactctgcctcaaaaaaaaaaaaaaaagaaagaaaagaaaagaaaatcagttgaccataaatgtataggtttatttctggcttctcaattttattccattgatctttatgtctgtccttatgtctgtatcatactgtcttgattgctttagctttttaggaaattttgaaattgggaagtgtgtctccacctttattcttctttctcgggattgttttggctattctgagttccttatatttccataagaattttagatcagtttgtaatatctacaaaaaaaaaggcagctgagattttcaatggggataatgttgaatctgtagaagaatttggaaggggttattgccatcctaacagtattacatcttcaaatccatgaacacaggatgtcttcccatttattttggacttctttaatttctttcaacaatgttttatagttttcattgtgcaagtcttatccttctttagttaaatttatttctaactctttaattctttttgatgctattgtgaatggaattgttccttaaatttatttttagatttctcgttagtttatagaaatacagttgatttttgtatattgattttgaatcctggaactttataaaggaactcgtttattctaacagactttttgtgaattccttaggattttccagatacaagatcatgtcatgtgaaaatagagagttttatttcttcttttccaatctggatgccctttctatcttttcttgcctaattgacctggctagaacctgcaatccaacactgaatagaaatgaggagagcaggccaggcacggtggctcatgcctgtaatcccagcactttgggaggcagaggcgggtggatcacgaggtcaggagtttgagaccagccttgccaacatggtgaaaccccgcctctactaaaaatacaaaaattagccaggcgtgatagtgggtgcctgtaatcccagctactcgggaggctgaggcaggagaaccacttgaaaccagaaggcggaggttgcagtgagctgagatcccaccactgtactccagcccgggcaacaagaaactgtctccaaaaaaaaaaaaaaaaaagaaagaaagaaagaaatgaggagagcagacatcttcatcgtgttcccaatcttagggggaaagctttcagtatttctgtattaagtatgatattctctgtggagtttttgtggatgctgttttatcagactgtgaaaagttcattctatttccagtttttcttactgtatttattatgaaaggtgttagagtttctcaaatggtttttctacttatattgagatgctcaagtgggtttttttccttttttatcaatgtggtattacattgattgatatttggatattgtgatggccaactttccatgtcaacttggaggatgttttggataagattaacattttaattgggaaactttgaataagcagactgccctccataaagtgggcagtcctcattctattggcctaagacctgaaaagagcaaatgacccaccttcttgagcaagagggtctccaacagactgccttctgacttcatctgcactgttggctatactgggtctctttctgctggtctttggactggaactgcaccatcagctctcctgggtctcaggctaccagcctttggaatagacatgcaccattggctctctagggtctctgcctgccagcccatacactgcagatttgaacgtgccagtctccgtaatcacatgagctaatttcttacaataaatatctttatatatgcatatctgtatctgtctgttgaaccaactatctatgcacatctatctatctctccctacagatatctatcctattgattctgtttctctggagaaccctgactaatacagatattaaaccaatcctgcattcatggaaataattcctgttgctaatggtatacactcctttttatatgctgctcaactcagttttctagtattcggttcagcattgttgtatctatgttcacaagggatatttgcctgtagttttcttttcttgtgatgtgtttgtcttgctttggtaccaggataatactagcctcaaagaatgaattggaaagttttatttcctcttttttggaagagtttataaagaattgttgttcattttctttacatgtttgatataatttattagtgaagtcatatggtccagagatttccttgtggaatgttttttgattactaacttattctctttacttattacagggtctaattagattttttacttctttggtagtttgtatattttaggaattcgggcatttcgtccagattatctaacttattgatttacaactactgttagttttcccttttaatcctttatatttctgcaaggtcaaaagtgatgacccctcttttactcttcatcttagtattttgagatttctctctttttttctcaataagtttttttttctagctaaaggtttgttaattttgttgatgtttttaaagaatgaatttgctttcattgatttttctcaattaaaaacattctgtattttatttatgtctactctgatttttattattgctttcctcctactcactttaggtttagttggcttgttttccaatttccttaagtggaaagttagattattgatttgagatctttcttttttttaagtaaaggttttacagctatgattttgtccctaagtattaactgcatcttatcagcttgtgttgtgttttcattttcgttcatcttgaactattttgtaatttccattgtggtttattctttaatccattggctatttaggagtgtattgtttaatttccatatattcataaatttctcaaatttcctttattaatttctaatttcattccaatgtgatcagagaacatactttgtatgatttccacccttttatatttatcaaagtttattttatggcttaatacatggtctatcattttatggcttaatacatggtttatcctggagaatattctatgtctctgttgagaagaatgtgtattctgcttttgttgggtgggctgtactatatagttctattcattctattgttttatagtgttgttccaatcttccattttctttttgatcttctgcctagttgttttatctattatttgaaagtacagtattgaggtctctaactattattgttgaattgtgtacaggtcccttcaattctgtcagtttttccttcaggtagttttgggttctagtgttaggtgcctatatatttcttaattaccgtatcttcttgatggattgaccctttgtcgttaaaaaatgtccttctttgtctctaggaacaatttttgccttaaaatttattttgtctgatgttagcatagccactccagctctcttttggttacttttggcatattatgtcttctcattcttttacttccaaactacttgtatctttgaatctaaaatatgtattttgtagatagcatgtatttggatcatgactttaaagaaatagtctgccaattctgcttgcaattggagtgcttagcccattaattaatgtaattactgataaactagaatttctttctgccattttgctatttgtttttatacattttaaggcttttctggttatcttactccattactactttttttttcaattaaataagtgttttctagtacataattttaaacctcttattgtttcttttacttttttttttattatttttatagtggctatcccgaggaatacaattatcatcataagacaatctagtttggtataatgccaatgtaatttcagttatataccaagactttgctccaatatagctctttctccttcctcctcttttgtgctattattgtcacacaaattatacctttatacatgaaggcggtgttataattgtagctttatgcagttgcactttgaatcagatagaagaaaagtgttacaaaccaaaatatatttttactgtatttcacatttacatacttatatatttgcctatgtacttggttacctttgccagtgctccttagttctttatgtggaattaagttaatgtcttgtgtcctttcatttcagcctgaaagagtctctagtgtttcctgtaaggcatgactgctagtgacagattttctctgtttggggtttttctttgtttttgtttttgaaggatagtttagctggatatagaatatttagttgatagttttttttttctttcagcaccttaaatatgtcattctgctgccttctggtcaccaccgtttccaacaagaagtcagattttaatcttttttagactcttattaagttgtatgcttgctgatatcttgcaggtcactgagggactgttcatttttcttcattgttttttcttttttcgttcttcagactggataatcccagttgacctggagacaaacaaatgggaataggggaagaaaaatgccacaaagctgactcttcttccttagagtcagctgtttaataaatgctcctcaaattggtgcaagcctttggttcatttccagacttctaagaaaagtttattttgataactttttgccattgtttttatttctatggaggagccattccagaagtgcttctttatcatatatttttttaactcaatgacctaaggattgtgttcatcctttatgaaagctattcaataaccatttatcatcttaatccatttgtattactacaaaagaatacttgagggtgggtaacttatagagaaaagaagtttatttggttcacagttgtgcaggctgtacaagaagcatggcaccagcatctgcatctagggagggcctcacactgtgtccaatcgtggcaaaaggcagaggacagccatgtatcacatggcaagagagggagcaacagagaaagatgagggaggtatttaacaatcatttatcatggaaactaataaaacgagaactcactcattactgggaggatggcacaaagccattcatgaaaaatccacccccatgacccaaacactttccattaggccccaccttcaatattggagatcgaatttcaacctgagactttgcaaggctaaacaaaccatatataaaccatagcattgagtaatactatgagccatgtatcggatgctgaagattacaatgtgcctttcgctgtcttttaaaactcagtactgcttacattagctccttttgtagttgcaatttttgtattgccaagagttaggagggattgaataagaagcatatgaagaaataagcagaaaaagaaaatctctagcatagtacacctctaatctatacatgaaacatagttaatgtgatgatgtttagaatcgtgataagtgttctcaggtacatgaagcttcagggatatgaagaagaggtgatgtgaacaaagaagtgaggtcattattatgtaagcttaaacacattgatgcatacattagtgatgtatatatactgtgctgtgtagtaagtgaagaaacaggctgacaatacttttgataagactctggataaataattatctgttaatctatcagttacactttttcaggtctggcatttggggctagaaggagaaaggttcagtagaaaggtccaaagcttaaggaaacagtggccaagttatttgaaaactgagttctgttttctacataggcttggatcttgggaatacgggatagtttgtttttaatcacaggaaccatcttatcagtttctataataactaaaagaacaaatatgagaaggttaaggaacagcttaattaaaatgttggagaaaatgacagaaataaattaattcagagagtgcctttgacattaatcatggaaaaaatgcatctcattttggtagcatacttagaaaaagcaaaataagaataaatttgcatgccaattagatgcaaagataccacacatacctcaagataaatttgagatcctgaaacaagcaattgggtctataatattttgtaacatattcatttggatatgtgcgctatctgcatttttagtgaaagaaaatgcattcaatcaagggccatagagagagtgctatcaacaatattccaagttctaaactaaattgcagaagattgtctgtgcaagttcacttataatgtgtataatttatatcacagcaaagtaaatatggatgaaagaaacatttgaatgagaaagggatacacttttaaaattttgcccaacattttatacttttggatagctaattttttatttaaaaattatattcttccataaataattatccatgagaaaatctttataggtagccttataaaatgttcacagtaaattaacacatttgaaatcaaaattaataggcactggttgtgtataaaagaagcatacattttgattcatgtaatttgttcaattgagcaaccatgtaaaaaataattatgctacatttgtcagactcagtttgaggatgactaaaagatgattaatgattttgaaacatgcatagaaaaacattttaaactgatttttaggaatgcttaaaataattattaacttcaagttataaactgcacaagaaaattaacttatgaattttatgccataaatcaaatttgctcccttaagagaaaagatttttgtttatatttaattgaaaaaagaaaatgaatcaatagaaaggttatgtacaaaattggatttgtgtatagggatgtgtacaaactgagtctatagggtacacatgacaattggttacaattttacaatcataatgtgtagtgtagagaaatcaacagcagaggaaccactctaacacattaagttccttggtcaaataaaagagattctcctgttgaataacagaatttaaaacattttcagtggtaggcaagtgtgttaatctttcctggccatagtggaaataaaggccgtagaagaactgagtgatgttattagcagtgcaaatagagttaaaaattgccatcatctagaactgacctcatgtgcttgggaaactgaatcttctcgccacagatggctctaatgagtcgggaggatggtgctgggcagaggtcagtgttggaagtcctttcttatggcaaagagtttgcagtctgtgcatgcatgtgtgtgtaagtgtgtgatgagagttgcagttgtgggatgtaagaaataaaatgcggctgctttttgtatggcaaacagaaaactagataaacagtaaattttgagatctggcaatgataggtaaagagggggctctgataattccatgtggtggttggtgaagcattaccctacacacaccatattaatgactagtttcagagattgagaatgcaattaaatatctgctgtaaaatgatattgaacaccatttagtttttcattgattctgaagtcatgtttggatcataccataccccagagtactcactacaacattagctatcgagtcatacgtttttatagatgtgttggttaaaagagaattctggtttcccagaatgttgggtatcaaactatcccctgcactggattttatttaattccaaaggttatggactttcccagttgtgttacattctatcttcatcagtctaaatgacattttgctcttgacattctgttcttctgtgtctagccttggagttttgtttttcagttatttaaggatatgatcacttccttctgagaggctgtgaaaataattattccacgaacagatcccgcagtttggagatacgatcagtaactccaattctgtattaaaagttgctatgatccttgtctccttccttttttattatttctaaaaatgttattacctttcaaaaaaatacatctttgctttcacagggattcatgtgttattttatcaaactgcttagtattcaccttcttaaggtattatgcagttgctgatatttttctgcaaggcaaatcgagcaacctttctcatttggttggatgtttttgtttggagttgttctgtctgatttcgtgccactagccatgtgtaacttaaaatgagagtagtctgacttgaggtgtgttgtaaatgtgaagtacgcacaccgtgtcaaagacttcatgccataaaataatataaaatatttcaataatttttatactgattgcatgttaaaataacattttagattattagattaaatacattatcaaaattaatttcatttatttctttttagtttattaatgtggctactagaacatttaaaatcacatatgtggcttgcattatgtttctattgttcgaggataaagaaaatgtgttcaggttgttgcaggatccatgataaaaactcatggggtcatgtccttattgtatgcttctctcgtgagatgaatgatagggaagaggaaatccagataaaagaaagtgactgtttggtaattattggctgtgcttttctcttctaccattatgtgtatgctccgttagcctgatttgcttggtttaattgctgggttgggatggcttcttgatgggggagggaatggaatcattgtgctatttagggctccttttaatggtgaccccttgactagttgatcattaatagttcactcatatgactgggaaggataatggcagaaaggaaatacagaaagtttgtattaaaatatggctaatacaaatatgagatatgctgcattttaatgtactgtaggttaaatttgcaaacctattctgtagagtaagcatgtagcagtttgtgttgctttccattagtctgtgcctggggttacatgtataaagcagcagttcccccagactagtgattctagccatttgaacacgaaatgtgaattttactgcataattgatctggttgtttatatcagtatttcttggcaagaccatctaaatgaagtaaattgtccatgcgctagccttctggttgctcagtagttattacccaaataaatatatgaaagtattcgatgtcctagccactgagtgatttgctggttaactggttctaatttctaaacctgtttatgcttggatttgcagaagtgtgacagaataaatatggtcatgaggacagtcttctaacaaattgatgtttttcatctctagtctgaataaatacaatgagggcctgaactagtcagtgagagagatggagaaggcaattggattaaaaagcacagatgcaaaataaagtcctttgggaatgatcactggttggcaggtgtgggtggtgaaagaaagaaatggattccaggtaagccctagattggtagtatgggctaatggctggatgttgatgccttttacagggtaagggctgctttaggagaggggcaagattgaaaataggttgtgacaggctcattgttaggcatgttgacatcacagcatcatagaagctctggctgaaagaaaacttaagttccatctagtccaataacttatggtaagattggtagtttaatataataaatattaaatgccttctgtttccaaagctctatgccagacaccagaactcccccattggaaaaaattaaaaagctggctcatttgagggtttccattcctaaagagctagtttacccaggttttactgcaaaacagctttgggtgattcccccttccttcttcatcactgaggcttgtcaataaggaaggatcccacatggggagtcactaaccctcaagctaaacaggaaagcttcagaaaacacaggttcaaactcattgcagatgagagatggcacttcatatttcctgaagaaatttggaggatgttggtgtaactaatcctcattaatgtattgaatatctgctatatgccaagggctggaaatatattggtgaatgaaagagacataatcactgctcccacggagcagatgcaatcacatcaaaaattgtgtgggggggcggatagggagagagagagagagagagagagagaaagagagagagagagagggagagagaattaataatggcacattagaacatggtaggggaaaaggatgtttaagccaggatctgaaggatgagaagaagccaccactgaattatgcacggaacattcttctgtggttaatggaaagggcaaggtcaaaaacatatgatttacttgaaattctgatgagtctatagcttaagtttaaacatctattttctttttaaatatacaccacttaaacacactaatatactgaataatttgattatttttctcaatcatgtttgttcttattgtaagactaatttttttacagactagaaaaagatagagaattgtgatcagtttacctgacttacctgttgctgttgttatttttcccagcaactccaagagattgcaaatggtttgataacatttctcccatgagaaacttttctggaaacagttcatcaggattgggctttcatctgtattagattagttagtcattcacaggttgttaggtgacagtcataggttgtaagcattttaggtatgagaaaataaggctgtaaaaaaaaacagtttttatcggctgtaatttaaaattttaaaggcaacaaaaaagttgctctctgaaatataattctgaagaagaatgcaaagtaagcttcatctgaattgaagagaagccagcatttccaatggcaagaattaagcctgttcacgttttcaaacatgcattttgtttatatgatcttcagctctctataaaattttagagaggggtagaggagccaagatggccgaataggaacagctccggtctacagctcccagcgtgagcgacgcagaagacgggtgatttctgcatttccatctgaggtaccgggttcatctcactaagggagtgccagacagtgggcgcaggccagtgggtgcgcgcaccgtgcgcgagccgaagcagggcgaggcattgcctcacctgggaagcacaaggggtcagggagttccctttccgagtcaaagaaaggggtgacggacgcacctggcgaatattgtgcttttcagaccggcttaaaaaacagcgcaccacgagattatatcccacacctggctcggagggtcctaagcccacggaatctcgctgattgctagcacagcagtctgagatcaaactgcaaggcggcagagaggctgggggaggggcgcccgccattgcccaggcttgcttaggtaaacaaagcagccaggaagctcgaactgggtggagcccaccacagctcaaggaagcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcttcctcaagtgggtccctgacccctgacccccgagcagcctaactgggaggcaccccccagcaggggcacactgacacctcacacagcagagtattccaaaagacctgcagctgagggtcctgtctgttagaaggaaaactaacaaacagaaaggacatccacaccgaaaacccatctgtacatcaccatcaacaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgatgagctgagagaggaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactgtgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaaacccatcagactaacagcggatctctcggcagaaaccctacaagccagaagagagtgggggccaatattcaacattcttaaagaaaagaattttcaacccagaatttcatatccagccaaactaagcttcataagtgaaggataaataaaatactttacagacaagcaaatgctgagagattttgtcaccaccaggcctgccctaaaagagctcctgaaggaagcgctaaacatggaaaggaacaaccggtaacagccgtggcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattatataatggtaaagggatcaattcaacaagaggagctaactatcctaaatatatatgcacccaatacaggagcacccagattcataaagcaagacctgagtgacctacaaagagacttagactcctacacattaataatgggagactttaacaccccactgtcaacattagacagatgaacgagacagaaagtcaaaaaggatacccaggaattgaactcagctctgcaccaagcggacctaatagacatctacagaactctccaccccaaatcaacagaatatacatttttttcagcaccacaccatacctattccaaaactgaccacatagttggaagtaaagctctcctcaggaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagattaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaagtaggtattgatgggacgtatttcaaaataataagagctatctatgacaaacccacagccaatatcatactgaatgggcaaaaactggaagcattccctttgaaaactggcacaagacagggatgacctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaagataatttacagattcaatgccatccccatcaagctaccaatgactttcctcacagaattggaaaaaactactttaaagttcatatggaaccaaaaaagagcccgcatcgccaagtcaatcctaagccaaaagaacacagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttgtacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgagggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggcgatttctcagggatctagaactagaaataccatttgacccagccatcccattactgggtatatacccaaatgactagaaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacattctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaataataataataataataataataataaaatagctctgtggactctgaaaaaaaaaagatggtagagaccaaaaaaaaaaaaaaaaaaattttagagagaaggtcagtgttaaaaatagcatcctgttagtagttaagtgattggaaatgataggcattgcaattaggtataattggaaatatattttgttcataagaagaaacctaaatatatatgtggagttttatagactaaaaattgtattaattactccttaggattgcctttatagtctggatgattcacggtttgtatacgacacacaaaataatgatccctaacttcttagaagtcaaagatcatccaagatatcctaaatataacataattaaatatttcattaagttttattgtatgccaaaagtgatcagatggatatgctctttagaacaaatcagtttcgttagttatttgaagacagcaatggcttatagatttatgtttcaatgtttatgttcttcttttgctctttctctccttacgagtttttctactcacaaatagtatggatttggaaaagatcctaaaggaaatattattttagggaatagaatatattcaatattcttacaatatagaatatcttccggttcccttagtgtagttcatctgccttcctgtttgttgctcttctttaagactatttagagctttccagcatgcaatattcatctctactcacaaccccaagatattttgaggattctccaagggaatttggcggagattttgctgggaacagagaggacttggacaaagattttgcaaattcaagactgtatgattctatattcacatttgtgttaatacagccttgtagcctactaacactattctagaacactcaaattgcatgtcttggctgaagcttctgactgtgaaatattaaaaatctctactaagctttatcagtaagaaggcactattggtattcatggatttgattttcatgatttcaggtgtttgaggctgttcccgaaggtctgtgatatatagttattcaaaattgctttgaggctcagcaggagtggtgagcagtcaatctatgacatagttgggcttatgcatgctgctgagttgaccaatgagccttgctggcctctgggcacactctcctcccatgcacatttactttccctaagtggtaagatcttgatttctttgtgtaaacttttcatcaagatataaatctttatggaacttgaaagcattatgttatgaatctgagcacaggaaacagcaattcagacattttcatatttccaaatacttaaaggtatcaagacggtcttccaaatacatactctcttatctgattctcatagtaatatcatagtccaccttacagatggggaaacttaagctaagaacctgtaagttacttgactggggtcagctagcttttgccctaaacctgagtcctctagatccaaacttcatactctgtcctccacagttgcttctggatctaggccaccccaaatagaaggctctttgcccaagagcttgcgaatcagtttctcagacaacaaaatgaagtaattttttctcccccgtggcctctcctttcagggctgcgccccctcctttcccctctcctgggaagcactggcctctggtgtctttaaacatggaaagtggcaaagcaggttttgtacagcaggcaaaaactgtttcacaagagggccttgaattgctaaaatataaatgtaaacatacatacaaatttggcaatgtcatggtacagtgtatcaggtttcatgctttatttgatagtttcacacgtagatgtggctcttgtggtcctttcttgtttctcttcccagtttaaaccagaggttctcacagcatttctctaaactgtgtgtctgtctgcccgctggtttgcgggtctcccagctccttggtacggctgcctggaaaaggtgcttgtcttcattcacattttcttccttttcctttgtgcatgatttccctaaaagtttctatgtaatccaaactttctttttttcttttaagttctgggatacgtgtgctgaatgtgcaggtttgttacataggtatacgtgtactatggtggtttgctgcacccatcaacccgtcatctaggttttaagccccgcatgcattaggtatttgtcctaatgctctccatcctctttcccccgaccctccagcaggccccagtgtgtgatgttcccctccctgtgtccatgtgttctcattgttcaactctcacttttgagtgagaacacgtggtgtttggttttctgttcctgtgtttgtttgctgaggatgatggtttccagcttcatccatgtccctgcaaaggacatgaactcattcttttttatggctgcatagtattccatggcatatatgtgccacattttctttgtccagtctatcattgatgggcatttcggttggtttctagtctttgctattggaaatagtgctgctaatcccaactttctttaccaactccagcaacacaagcttgccgccatgctgctagcccatctctgctctttgctatcactttgcctgcagcagctacagcttttgtggttgaatagcatatttccctgcacccttttctagtgttttccagagatacctatggagtgttacttgatatccttcgaaagcatgttcccatctttttagattttattattgtttctctttgaccttaaaatgaagttagtaatagtttgacatatgcctttcaagatgcaagattatttactaaattttccttatatgtgatcatcacattgttaacatttgctgacctccaaaatgggttgggataatgagtgatcattgttttttgttaagtcttttctttttgcatatacattttatttattattctttacattcagaatagataccttttattagaaacattcagctaccctttccaaatactcactcttacaagcacttttaaattataatctattaaatcagctagcactcaaacttcttatttatgtttcaggacacatgtgaaagttaccttacttagaaacctctaagtaaatgcggtttttgactgcagttttggcagtttttttaatggcaaaaatcatatacagtggcatttgattaaagctctgttgggcttaccagtctctttgtattagtttcatgctaatgatgtaaaatttcagtgccacaattttatttgtaaatatattaatacttagccagattgttgtgtacatttaaagtaaataaagcatttgacacacagtagacaataagtggtagcaactattactatttaaaacttgtgaacaggccaggtgcggtggctcacgcctgtaatcccagcactttgggaggccgaggcaggcagatcgcttgagcccaagagtttgagaccagcctggacaacatggcaaaaccctgtttctacgaaaaaaatacaaaaattatctgggcatggtggtgtgttcctgtagtcccagctacttgggaagctgaggtgggaggatcgcttgaaccccggaggccgagattgcaccactgcactccagcctgggcaacagagcgagactgtatcaaaaaagaaacaaaacaaaacaacaacaacaacaacaaaaaacttatgagcaattttgtgcctcactgagtattctcttcttaagataacatgaatttattaattttcttgttgtattttcactttatattctatttcttttcccccaccccagccctttaccctttcatttattcaacaaatatttattgagcccccactatgtgccaggtcctgttttaggctatggagattctgcagtaagtgataaaatcccctgctttcattgagctaatattccagaaccagtgcatgttacttttttgtttttgtaatttttaaagtttgtttgtaaaatgtgctaggagctccatttttagatagtctctggaaatgcagacacagtggaatcattttgtgatcacatactgaattattagagacagttcagaaaatgatgtggctttccaaaaaggaagctgacgctgattcccttctgataatcaaggaaaggcctatattaaggcaaaatatcagataaatgtattattttgttgttatcaattccatgactttttatatttaatctttgtgttttattttgcttcttttcagagtgactattattattttagaacaaacaaaacactctacagtaaagttaacataaagatataaaattttatttactcattgctctttctttaataagaaaacttaaatttttaattgcaaaagcaatatgtgctcattattagaaaaattggcaacagaaaatgcaggtaattaaattttaaaaatcataactacttccataaaatatcttttcagtccttccaatcttttcaggatggccgtatatctcttaggaaaataaagtcacagtgtacaagttgttttgtgttgttttgtagccttttgtaacctttgacttatccatatattgtgtagtttttcaatcaatattctttaatataattttgataggctgtatattttgtatagctctaacttatgttgcagtaccctattgttgcctatttatgttgtttccagtttattttcagcctttataagcaaatcttgccatgaatcctagtctcagcaaatatttcttgtatcttcaaatatatccttatgataacctataagaagttaaattgaataggctattatggttctggttatatgtcgtaaaattgctttccacaaagatttctaaagtttatatttctccagtagtgtataagacacatgtttctccaaaccagtaataatatgaaggatagcaaattgggtggatttcacacagacacacacacacacacgcatgcactagttctgtgattctttgttataagtgtctgtggcagaatgaaaatcttcaaggtcagtttctcctccttggagaccaaggtttagtcccagaaacattctgagcctggaaaatttagctcacacccaccaaaatcacatgagattgattggaatcagcttggcatcaaaatgctcattcaatagtttatgcaactggctttccagtctcagataagatcagatagtttagaaagtatgggcagattgctgagaagaggacacactgctagatctgcctgggatccctggaccagacccactggctttggtcacatggagaggagagtgggaaagagcacagaccagggcaggggactgccctgacaaggcctccccagccctcagggtgcagccatagctttccttagagttgaaatggtgccttttatgatttcctaagaactgtcgctccttcggaatttataatttattaagttaatttgccacaggatttaaaacaattagtcaaatcatgtggttgtcacaaggatggtggatggttgaaagaagcaacaacctaaaagaacatgtatgttcacacacatacatgtgtacatgcacatatatatttgcagatgagccagagacagccttttcctactggcctcaatatttgttttctaattcttgatctcccagcaagtatgagcttctctctgtgtcccaatataaaactatacttcaattttcttatttgtttattgcttaaaatgcctcagtggaaacaaaattttaatgtagcattagcatttcaataactttttaaaccctaaaaaagattgccattcctccaagaaaatctgttgttatttaacgttgaaggataaaattagctgtaagggttattttagagtacatttcaagctcattttattctctagcacatattattctagcgaatattggttgctaggttttgctgaagaaatcctttgacttaaattggatgacactaaattgaaactcagaacacttttaaaatgtggaagttaccagcacattgaattaactgtattgtacttgttttggaaatgtttgtcacctcacttggcttaaagtaaagaaaaatgttgaaaagaccaaaaagcctgtgcttatataggcttcaattcttgcctacaccaagccttgaattggccatcacccaggataaaaattggctattttttatcatatgttttacctggccttgtgagtagagttgttgtttttaaagagagattttttttttaacccaacttcatcatcctcctaaaaggggataaggtagataatccaagctaaaaacagttctttgtacaacaacaaaaaggcaacagtgcgtccaagcttcatctacttgatactgagaagaaaccaagcaaagcttccaattagcttgatctgtacaatgatgggctttcattcccagttaattaagagggattcagtaagatccaggccgtgggttctgatctttcatcttccaagaaaaaaaaaattacccaccaaataaaaacttaactaaaaggaaacctttgtttagagattctccagggtgatgagtcttacattttttatcttgtggtaccacacagttcttcttttgtctccttcatcacttgcagggtgcacatcatattccatgccacacatcctttccatttaaaacacaaagtcaatgagatgtcttctggcagacaaggggtgtgatgttgagttccatgctaaaggagtcctagcatccttggaaggtcaggaagaaggggacctgaaaaggcatctggcttcagcctcctcttttatagaggaggagactgaggtccaggagagtgaaatgacctgcatgaggtcacacaaaccaggagacttctggaacccataggcagctggttctttccattaaactttattactttgatgttgctgaaagaattattgtctgttcaaaaaggtagcattgttttttgctgttggatgtttctttcaaccttgtgttttgttactgctcctaaagaatcagttatgcggccaggcgcggtggctcacgcctataatcccagcactttgggaggccgaagtgggtggatcacctgagatcaggagatcaagaccagcctgaccaacatgtagaaaccccatctctactaaaattacaaaattagctgggcttggtggctcatgcctctaatcccagctacttgggaggctaaggcaggagaattgcttaaacctgggaggcggatgttgtggtgagttgagaccacgtcattacaccccagcctgggcaacaaaagtgaaactctgtctcaaaaaaaaaaaaaaatcagttatgcatacaacttttatagcaatgtgtagagtacatacttaatgtattaaaaatgtaagtttgtgaaaacaattcacatttactcattcaattaaccaacatgtatttattgaatgtcacctatgtgctgagtactggcaatatcaaatcagataatacgtgatcctgcatttatacattggaacatattcagggtttttattttgcttttgttttcttgtaaaacatcatatggttaacaggttgtgattattcttgatggctttattttatttatgatgtctaaattccccaataaggcatttcaaatgatctttcaaatactttgaagttaggttgctttcgatgactttagtaatggtatttaatggtatgtaaatggtatataatactaattcatataatatttaataatattattttagatattaaaatatggtatcccgctcttaatgcagccttgcaaatgagaatggcaaatccaaagccattaggtgatgaagcttgtcacctgcaatgcctggtagctgctgatgtggccagacccctagactttcttcatcctcacccctagaactgccatcaactgggacatgccagagagtgttcttgcaggttgatatccaaagatagctgacttggtttccgtccttaagttatgataggaactctagaactcacagggggaaaaaatgacagtagagagtaagtgcccagtgagaaagaggaagtcatcactgaggggaacggccattaataagcctcttagattgtgtggggtttaagatttgccttgaggattacatggaagaactgagggaatagggcaggctggccatgtaatagaagaatgctagtcaaggttaggggtgaagtgggggaaaggcctcacttgacttaaagcttgcagttacttactttccttcctattttagccacatcaagtaattagtccctcttcctgcataactgtcccagatgcaaacgttttgctccctagaatgtaagacttgtttgggtggattgggagatttcagcaatgattgctgctatttgtgtataaaagtcagtagttttgtaagcaacagtctaggattagctctagctgcaggtcagcagaccgcaagcatcatccttccagaccatctcccaacagatctcctaccaatttcctccaagaagagtttggtactagggcataataagacatcaggtagcagtaatgaggagaatagaatttagtttaatattgctatttttaaattccagcctcataatagctctctttgtgtcaagaaaacaaaattaggaagaatggaagtcggaggcctcaggagaaagagtctgtctccctgatggcagggagggccttgctcagccaggtagaaggggtttttgtgctggtcctgagaggaagaagcagggattttctattccaaattgtccttgaaggaagagagacaaaaagagagaaggaaaaaagagtgaggccacccataccattgactataatctcaagaaacacagtgtgccaaacttttggaaacttaggaggattccattcagctcaccccagctctggaacaggcaggctggcagctgtgctgagtgaatgtcatatccattgactattcagaaaaagtgtaattgtgggagcagaaacttatttgggaattttttttttttgtttgagacagattcttgctctgttgcccaggctggagtgcagtggcatgatctcggctcactgcaacctctgcctcctgggttcaagtgattctccagcctcagcctcctgagtagctgggactacaggtgcatgctactgcattcagttaatttttgtatttttagtagagaaggggtttcaccgtgtcggccaggctggtctcgaactcctgacttcaggtgatctgccttcagtggcctcccaaagtgctgggattacaggcgtgagccaccatgcctggcctatttgggaaattttttaattgtacctaaaaatcaaaatcctttatcaccattgaaattagtgattatcttattctcatatattttggattcactgcccagtgataaaaagcagtaaatgttcagtatctgttgtagcgaaatctgtaataattgcagctttaactgaaactctttctgcattgtacgttctcatctcacctggaaatattttagggtgtagctctaaaaaggttagggcacttttttgaaaagcataatcacaataccattatcttatgtttgacaaatatttattgaaagtctgcagtgcgcatgatagtgagtttctgtcagggaagcaaggagagactaacggataaggagagagggaagaatattttggttgcctagaaatgatcaagaagaccactctggaccccagagtttggcataagtatgatgattctgagtggcttaattggaggggaagggagattggtagagacgcatcggctggagaacagggacccgaagaggcagaagagctattcgtatggctgtgaggtgcctctgaagagccatcaatgtgggtgtgaggtttctgcattcgcaggagatattgaatggagaggattatgaaagggctctatttttctttttaggatgataaaactcaaaactattgaagggcatttttattttaataatgatattatttatcaaaatgtttagcattttctgacaataggagtgtattgtgtcgtagttttgtactttatcttaaggacgttgtgagtcaatttttcttctaagactcctacactttcttatacttcttaattttattcagaatttaaaaaattatgttaaaattttagggcagttgaagggacactaaaatactcaaaagggggtcagtaactaaagccactgaggaaggtgggagtggagctcagcatgtcaaaagaagaattgatcgagtgatgatgccactccaacaatggtctggatcagcaatcagaacatgggaaactgctgaccacacttagtgggaaagtagactggttgtgctttatattaaatatcagcaataagctggaatcaaaaatgctaaacttcagattgctacaccaagctacccaaaacaccccaggacctatgcattctggttagtcaaaacatttctgtataatggaacaaagcaattgccagtagttaatccatgagaagcatactttgctgtttggttggttttttgcttagttttggtttggggggaagttcttttatatctgatttaaagactattacattgcaagtttcatgacttacaaccatagttggaatgttctgtatgagaaagaatgttttcattagcaatcagtcatttttaggttaggactgaactaatcaggccaacaccacctcatgatcatcggtattaaaaactattgatagatgtaaacatgtgattggctgtttaactgttttccattgtcagaatgaaattaacctgtgaaattagagccatgcgtgttccattcacactggaaaaagccaagagagggaaaatgttctttgcctccaaagcaagtttttgagatttctgctctacgatgattttccccttaaaatgagagatgagaaaagaaattaaagataatcatatctgcctaggttttagttggattggggcctatcttcattagtaataaatctcatatttcctcatcattaaaaagaacttgatccagacaatacatgctcatgttcagtggagaagatcacgagattatccaaaatgggctagccttggctttgcatttgtgtatggatgaggctgatattggatttaatttcaaaccacaaggtgtagccccaagagaaaggagccattctggaaactaattggctttttccatcctaccttcaactcaaacatcattaaactctgtttctagcaggaggagactgttcctgcatgcagatgtagggaagtggttaaggggctttaaagggcttcactgcatgtaaaataaataacacaggaatcagagtgttaaaaatagaagctctgagtaaatagctatagctttgtggccaacaggtcgaatgctcactctcagtattaaatgggcaaaaataaagttatgctgtccatatggatgaaagcaaagcatgtataaaagatgatgcacagagtggataatacccttcagataagtggtgtattaatcagggttctccatagaaacagaaccaataggttgtgtgtatatatatatatggaaagagatttgttttaaggaactcacgtgaacatcgagacaggcaagttcaaaatactcagggagggctggcaagctggagactcaggaagagctgatgttgcagttcaaatctgctagaatggcctcctgcttgtggaggtcagccttttgttctattcaagctgtcaaccaatagatgaggcccacctgcattacagagggcagtctgctttgctcaaatttagcaatttaaatgttaatctcatctaaaaacaccctcaaagaaatgtgcagaatagtgcttgactacatacctgggccccgtggcccagccaagttgacacataaaattgaccacctcaagtgggaatgggcattgcacatggtgctgtttgcaataccagcacactgaagcgaatgatgaagacgggaggccttaatctatctctccttcttaaagcactgatgattttatttacaactaaaataggttggcagggtgcagtggcttacgcctagaatcttagcattttgggaggccgaggcgggtagatcccctgaggtcaggagtttgcaaccagcatgaccaacatggtgaagccccgtctctactaaaaatacaaaaattaactgggcgtggtggtgggcacctgtaatcccagatgcttgggaggctgaggcaggagaatcacttgaacctgggaggcggagattgcataatatttaactccagcctgggcaacaagagtgaatgaaactccatctcaaaaaattaaaaaaaagaaataataaaattaaaatagatgaaaatattgttggccttaagtaaagcctaatatagaagatattttaggaaaactgttgtaatcttattgcttatgtttgtaacatttctgctagatttgcatttataagaacagccaggaaacaaagatttatggtaaaaacgtgtgatctcacgtacgtgggttagtttatcttttttgaggttgtctctcacagcctgctgctaaaaataagcagtcttctattatttgctcacctgtgatttagtcagaaaagccagtgtattctaatgagttgggaagaggtgaaatttccattcagaatggtaattttctgttaatcatcattgaaactgaagagcctcccagattgttcctcaacatttgaattggcctcagtaaaaatgaaagaagacaaaggaacatttatatgaaagtaaaatgttcttattctttctggttttgctaataaaactaccagattggtttccttgtctttgtcctctgatctgtttacattccttttattatattttggtgtggcccattaaaaatattgccccatactaactagtatattgaaaacggatagaattagatttcgtaataaagtgaacttagttcactcaaatgttaagtcatttcctccactgaatccttgtagacacaggcatttggattgtatctttacaatatgatattggaaaagatgagggaatattggtaatttgaggtgaaaaagaaaactcttataattgaatgtggatgctttgtctcttcttggagcagaggtttaagaaagaaaaggaagaaactccaccactacaaagctaccttggagaacacttagacaaaaatttctcagagcatatgctatttggtgaaaattcacaaattgctcttcatagctttctgaatttgtgtcatatctgcattttaaaattgaatgtgctgcagttccaacctgtatgcttttgaatgaaccttaatgatgggccatttcttattgccgtcatctgtgcctttcattgctgatttatgtcaacttcctttaaatgcattgtggtatttaggcagtggataagatagtaatgccatcgcatgctggttgcttaatgatgcaattgcttgaaaatttaaagcccataatagctttaggtcaggttcagaagttcatgttccatgccagacatttgaagactgaatcagagcccgagcactgccaaaatcatgccacatttgtcaagcctggccttgggtaaaagctgttggaagccgcccattcatccaagccaatcactgataatgaagcttgagggaacatgaaatatcttttctaaaaagaacagacaacctcaccagttggctgccttttttttatttttagtataattaccaggggcaaactgtcttgcagaattgctatcttatattagctttgagtttgtgttcttgagacctgatgcaaggatgttttattagctaagaatatgtggtttgaggtcagctgaacatgattctttcaggtttttcttgtgggctgtaatgtgattgactattctgtggtgtggaagcttacagctagaaaagaaacttcaggagaaccactttcctgttttcacgcttatattttatctgactaattcgcttggctcctgccacaaacatccatcagtgaacagacttctgctacagggaaagttctagaagagctgcccacctggaacacttcagtcaagcctgaagctggaattgtaaagtgtgactgattccaaaatcaccatgccccaacctactcctgctaaatgttagattttttttttttttggaagctgcatgttacttttccccttttctttttttcaaagggctcatagtattggttccagtatctcaaaaggatgttttgcagatgagagaaaagtacttgaaagagtctgaaacgctggaaggactagagatgttaactggtcactttccctcactcctgcctttcatattccacactcaggtctttaaagactttggctttgaagagaggaaatgaaatatgggagcctcaaggctgatacttatcctagctttttttttttttctcatgagtgttcagagaaaggaattgaatttgaattctctgaagcaccatatgataggtagttctgattaagttgtggctagatgtctttgatgatgttattaccatcatcaaaaaaatgttaactaattcctcatgtatgtaaatctttgtaattcagaacacactcactttacctgattctcacaaccacttggtaatgaaggcacggcaggtactggtttcatcctcatcccccaatgtgtagatgcggaaactgaggatgagaggtaaacctttccccaagtttcacagatagtaagtggcaagtctaagacaaatcatgctacgtccagtgcttttcctgtattttatgctgcctcctgccttctgtcagcagattttggtggctgttggaggaaagaaaattataagaaaaattataagaaaagatccttgctcttgatgagtttaaggtctacctggagagacagaactgaggcatgaaagagacaaagaagaatgcaaggtaggctgtgctaagtgttcagtcagtagttttgaggttacttgttgctggagcgtcatgtaggagaggtgattgatcgaaggcagggacagcagagaaagctttcgggaggaagtgagagttgagttggtcttgaaaggagagtaggtcttagataaaagagagcagagcagcttgagcaactgtatcacagaagcagatgcatatgacagtgcgtaggaggctgagcaagcaattgtgctggacccacatattacatcagggagacattgcaggcaaggctgcagaaacagcaaaaggaccaggatgtgaaaatcttgaatgcctgaatttggatttaatccattaaataaggagaagatatccagggcttcagagcagtagcttcatgtgtataatcgattagagactggagatcactgatgggggagtagtatatcagtgcagttcataaaggtggtagaattaaaataaaggaatgaatgaccaggtcacacaaaggaaaaaggatcaggattttcaggggaaagaggagaaatagagtgatcataaaatgtattgtccaacctaggacattttccaagacaaatgctacactggtcaggacagtgggaaaacaggcacaaactgggactttcctaggcaaattgaacatatgatcatactggtcaacaatgatgctggggttttgagactggggcatttgtggtcattgatagaaggaaaatcagcaaggccagtgatcttggattttaagcttcaagatgactgcagtaagtcaggagtagatttccagtgcaaagttagaaatgcacaaaacttgtctgtataaccctttgtttcacctttcactcctcttttaagcccccaacattaaaaaaaaaaaaagcactttcttttgaaggaagcaaacaaagtaaggaatggcagccacatcctagtactgtcaacatgttgcattgtaattctccattttgaaacgtgagcctggatgtactgtcaggaactcctcatctttgtgagactatggcttgcaaaagcaaatccttgcatgttttcccacatccgaggggatcatttgtctctgaagtggattcagactactttgcgtttcaaaacagaattgaacgtctgtcaacctgttaaaaattgagattttcagaaggaagaagtgcgaactagaaggcatgagtgtgggaacccctataatctatgatttcattatagatcaaaaagaatttgttcattaattatcagttagcttgggacttttcagagaggcaattaaaccaaaatctactgagccagggtaatcataaaacataatttttataattaaatatgtcatttaggcttttatttgacattttaggtgatttatgtggcactttccaggcattagaaaaagcttgatcaatgccgtgtataagatcttcctagcattacccccaaatagatgagtaacttgtcatatgaggttagaacagggtaggcagtttcaagctcacaaaatgatctggaatcagacctggatttgctaatggggggaagagaagaatcttttcctcttccatcctaggttcacagctgaggcccctataacaagagatagtttaatgagagaaaagcatgcaaatttacttaatacaagttgttgttgttgtttgtttgagataaggtctgtctgttgcccaggttctagtgcagtggtatgatcacagctcactgcagcctcgacctcttaggctcaagtgatcctcccagctcagcctctcaagtaactgggcatgcacagccatgcaccaccacacctggctaattttttaaatttttcataaaggtgaggtctcattatgttgctcaggctggtctcgaactcctgggctcaagtgatcctcagcctcagcctcccaaagtgctgggattacagatgtgagccaccacatctggcctttaatctaaatgacacaggagtcttcataaggaaatgaagacctaaaaaaatagttaaacttctgtgtttctatgctaagtctgttgaagagtgaacagtcatggagacgtatgattggataaaggtctgatctaatggtaataagtggggggaacttagcaaggcctgtttgttcaggttcttcttggcatctgtgtcttaggcacttttctttaggtaaagagagggtacctctcccatgagggtcttatgacctgcttcatgggagaaggggaggtgggtgaaatgagagtgaccatcccatttctgctttttctcaaatgacaaggtgccatattttggggtagcatgttttgaactccatcaccaaggagagggtatgtcctcttgccttgtaaggaacctggtccaccaggaagcctgaggcagtcatcacccagagcaggaatttgaaacactgactctccatggtcagttttgtattctccagtcctactttgtagacattatgtacaagagaatttatcagattcaaaataacttggtgggaatattcagaaatatctcacttaaaaaaaaattccccacgttggctgtttaaaaaccaacaaaaatagtaacattttaagtcttgcttggagttcaaaatgagcttggaaaccatctgccctgacttaatctagagcgttcactgagtgtagacaactctacataggtgctgtgagggatccagagatttctaagcccagctggaagtcctacactctgtatctatgaaccaagtggagaacaggtgtttattacaccaacagccactgtctctactgcagagcaagttcagagaaggctgggattggccaggcatgacctggggtggagaggtatcctgggagccttgtaactgaagatgaacagagagacagtgagaactcaagcagagatcagaggcgcaatagccaattgggactgaagttctggagcatcaaagagcgccccctctgggagaaaggatgtgcttcaaaggcctgggcaaggtggaggattcttgcaggatgctggcaatttgtctagcattaatagaagccgtagtgtagtattaaaaattatgacttaaatacacacaaaatttagttacttttcatttgtattttggtatttagtattagtacaacttgtactctgatattcaacctaattttgtatccttggggacaattaacacatggtttaaataggaagacattgttgggaactaggacctaggaccacaaatatattttctatgctttttacattctcatcacgagtgtgccaccttcagatataattttcatatttttagtagacatatgtaaaaaatgtaattaagactgattaccccagcagctgtgctttctttaaaaaagcaaaaaggtatatctggcacctaccaactcttagtttatcacatatcagttattttttaaaattaaatattttcttctaaggtgaaaaatgtgaagaaaagtctttataaaggtgatgttttgctggatgtggtggcttatgcctgtaatcccagcaattcaggaggctgaagcaggagcatctcttgaaaccaggagttcaagaccagcctgggtgacataatcagacccctgtctcttaaaggaaaaaaaaaaaaaaaagccaattagccaggcgtgatggtgcactgtagtcctagctactcaggaggccaaggcagaaagattgcctgactctaggagttcgaggctacagtgagctataagcaagaccctgcctcttaaaaaataataatggtcaggtgcagtaatgggattatacacctgtaatcccagcactttgggaagccgaggcgggtggatcacctgaggtcaggagttcaagatcagcctggccaacatggtgaaaccccatctctactaaaaatacaaaaattagccgggtgtggtggtgagcacctgtaatcccagatactcaggaggctgaggcaggagaatcacttgaacccaggaggcggatgttgcagtgagtcgacatcgtgtcactgcactccagcctgggcaacaagagcaaaactctgtctcgaaaaaataataataagaagaagaaagtcatgttttgaaattccaaagtatagatattttgcaaaaagcaaatttacaagctgttccactacacatgtatcttaagggagtctgtcaaaggggagatagtcaattcagaaaagcagagcatgcggtaggtgttggagagagtgaatatgttatggattctgtacccctattatcttctaaatcatgggctaatttgtaaagtttctatttattgtttgctgaaaatttacatttacattgctgaagatggcctgcaggtgagagagcacctgcaggcaatttccaatggttgtttagatcctggagtttgcgtccttcatggcgtgtgctgatgataccctgtgagttgttttgggcggccgcaaagattcaggtctcctgaaacgttctgggctgcagccatttccttactgcaaatgaataatgaatgagctgtgggttaaactaatagttcaagataaaatcagaagctcattgcaacatgggcaactttccttcgtcatctccatggaaactgctatttgtcaagacacactagtatttcagaagacagtgaggagtcaccagttttttaacttcaggtcagctgttgaaaaatagatttaagaagcacagattgagacagaatgaatacagagaaagccatctgcatgcagtgggggagctctgttagaccattctttgggacttttagaaaaatagatcataaatggtataataaatattaagctgtaagatttgaatggaaaattgagttaacactttttccctcccccaacactatgacttggcatctggctgggccacatagtgagtgagtgctcagacctcatccaggtggccttcttgcatcacagggggagggctggcaccggtgttgcaagaggtgagagcagctggctgcacagcactggtacaaaacgggcaccctcacctcgcacatgcatcaggccgcggtgtcgccaacagcctgggcgtggggtccccgctgcaggggctgatgtcagcatgctgaggtcacattggggatcagatctcatgttgcagcctggcagtgggtggggcgggggccgacgcatcccagcgctgagaacagtggcactccagccactcagggttggagggaggaaacagtggggctgggtcttccagccccatcaggactgggaggtgctggggaaagagggaaataaggaacaagaaatgtccaaaagtggggctcagaagtagatctagccaggtggctggggctgccttcaccagcacagcacgcaggaggctggcctgagactggggacccctgaggatgggctgctccttgtccctagtgagacagatgtggggagcagggaggagattgtgccataaaagctctagaaatgttcaggcatcaataatatgttaagaaagcacctcttcacactgtaagcttctggcctctggagcacatagtattgggttacctcaagtccgagggaaaagaagcaagtgttacagactgggactctatcttggctcccccactgtggccgcgttactcagggcgggttaggtgtcttctctcagcctcctcccatttcatccgtgaaaagaccaggtagtggtgcccctcagggtcattttattttattttttttattgttgtggtacataatggtgtatgtattttatgggataggtgagatattttgatacaggcatgcaataagtaataatcacatcacagaaaatggggtatccctcccctcaagcaccccctaagggtcgttttaaatatgaaatgagacaatacgtgtgaaaagatgaagcccagtggctggcgcctcactgctctcagtagaaaattaaggcatttctcttcactaaggctgtctacagaagtctcccccttgcctctaaaaagggggtcagggttcaagccttctcctgcctcagcctcctaagtagctgggattacaggtgtgcaccactatgcctggcaaatttttgtattttttttagtagagacagggtttcaccatgttggtcaggctggccttcaactcctgagctcaagtgatccacccatctcagcctcccaaagtgctgggattacaggcgtgagccaccgctcccagccgccactgatacttaattctcagccagtctcagtctctattgtccacccctttctctgctcaattaatgagagaacaggaaggggaggtaatttaaatacttttctacacaaaatattattaggaaaatggagcttttacaagagcattaaaccttttcagtgcaaacagaaatgcctttacatgatcgtccaggctttcttgcagtgaggaaactttcctcctcaccatctttcccctttctctttagggctgatctccctccctgaccacatgttctgtgcttcatacccattgcgcgcatcatcacccctgaaaaactaaggtgtagctctacttacaaatgcagcctctgcttagggaaggatcttggatctgcctgagaagaccatgagggtcccatcagtttctgtgtttctccaacccctcccctgccctacctccaaagccattcactcagagatgcagaaagctgcgagtgagcgacaaaagaaaccctctcaaggagctaatgtcaggcagattgtgaaaagtgctgtggtttttgtgtgtgaaagaggtgatcacttctatacccctcagtatgtgcttttgatttcccacattatttagctggctactcagatctgattaaaagcatgtgtacgagccaaggtatagcaatgaaagtcaaacacagacccatgagaagatttaatggaaacaaactatactgggagttcgcttgctagggtgggtttgagaccagatcctcaacctcctggttctcccctgcctcctctgtgaaccagggataatgctgcttcattggcctttttttttttttttttttttttttttgagacggagtccactctgtcacccagactggagtgcaatggcatgatctcggcttactgcaacctccgactcccaggttcaagcgattctcctgcctcagccacctgagtagctgggattacaggcatgcaccaccacatccagctactttttgtatttttagtagagacgggattttaccatgttggtcaggctggtctcgaactcctgaccttgtgatctgcctgcctcgacctcccaaagtgctgggattacaggcatgacccaccgtgcccgaccttcatcggccttttaagtgaggactgcacctcacgaactcttaatatcttctccactctctgattacgattgtttggactttttacttttccttaaatctggggatcaatactgctgtgctgaggatgtggctttcttcctgataaaatatctatttcttccattggaatacactttaatttgggaacaagcatcaatcttagaatagatccttcatgttctgctagttggcattactacctggccaaaggggaggaagattctggaaagcaaaggaaaaagggcctggaggggcagcccatccccagccagtctctcctgagcctgtaggctgccaaatccctcagtcccaagggccaaggctgccaaggacctctcctttcagtaacatcaaaaatgagatgacatcaggttaccctttactagtgcctagagagttgtcaattacctttcagtcacttaccctttgctaattgcaaaataaacagactccgcagcctgccttcaatgacagcctcgtctcctgtcctaatatttatatcttagcctcttattaattgcatttcattgatcatttcctgaatactcttcttcccttttgcattttcagtactccaattttttttttttgtttgtttgtttttcaaagagcaggcatcagagtcagattttctaaagggcctgccagtgccacacctgctattgttgatcctcataccctgtagatccctaaggatggctaatccccttcacaggaggcattgtttccagggagaatgggcttattggctttccacacctctgttagaaacaacagtggagaaggatgatgtggaagggaagtgagctggtagcaggtctaaatgcatccataatcagaaagatttccagatttccctaattgctgtttttattcacagaacttctattttaagcgcacacactcacatgtggattgacaggcaccagccactgtaatggctgtgtctgtctgtagcgactgcaaacgcttgtttccatggtgacgggaggcaccacagagacacaattatggtgctgctgggaccagggcactgccacaccaggaggcctctcaagtgtgtgtgtgtgtgtgtgtgtgtgcatgcgcacgctgggggcacagggttgctgtcgagtgcggagtgtgaaaaagccaagcggggaaggggttggggagataggcagagggaacattcgctggtacagaagcctggggggtagtgaagagaggtgatacctggatcaggggaatgatagaaaattgaagaagaaggggaatacagatgggaaaaggaaaagggcaaacaaaaatggaaaatttctcctctctgcagaatattattgcccctccctttgaaaggtttattgtggcagaattatctcacataaatttgccaagtagagaaatagactttagcgagcagaggcagacggttcaggcagtttgggtgtcagagtttttctgtaactccaaagttgatagtttgctgcctccagctcaacagccccatcctggagaggagatgaattgctccctcacccactgcagggttttctgggcatgtgaagccattacttctcctctgggctctgcccaaggtggaggcacccagtgttgtctccaaacaatgtcatttggtctgagtgaattacatgtcaggcaaatgaggcctcgtcaagttctcacagagggcacaactgtttttcagagaccttgaaaggatgcccagaggattccgttttattaatgatgacttggtgaacattgactgaagtcctatcctcggctgacagacagacacccaccctaggggtcaagcaaacaaaagggaactttctggggttatccttttaggctctggttgtaaaaatcagtggttctctggttccagattgagcacttattgacaacctactgtgtgtcagcagttttcacataggctcacctgcaccactgtaagtggtgttggccccatttcatagtggaaggcctggaggctcaaagtggttgagcagtttccccatagtcaaggaggtcaagtcaaacccagatttccagattgcaattcagtgcagtctcctgttcaaggaggtcaagtcaaacccagatttccagattgcaattcagtgcagtctcctgttcaaggaggtcaagtcaaacccagatttccagattgcagttcgttgctgtctcctgtattcactagttctcttttatgccaagaaaaaacttttttaaaaaatttctttgggtacacagtaggtgtatgcatttatgggtacataagatgttttgatacaggcatgcaatgtgaagtgattacatcatggagaatggggtatccattcccttaagcattatcctttgtgttgcaaacaatccaactatattcttttagttattttaaaatgtataattaggttattattgactatagtcaccctgtggtgctatcaaatagtaggtcttattcattctagaaaaaactttctgatggaaggattcaggcccaggagtccccactgagcctgattccactcatgcacttggtgatggaaggaccaggacatggtgagcaggcccagcaggtgtttggccaaacttggctcctagacagaagtgctttccagagattaacatgctccaccagccttacaaaagaaagccttatggaagggatttcctgtccatctcttgaattttctgaagagttctgggttggctcatgcctgtaatcccagcgctttaggaggctgaggcaggaggatcacttgaggccagggatttgagactgcagtgagctgttatggtaccactgcactccagcatgggcaaaacagtgagaccctgtctctaaaataataataataataataaagagttctggaccctacaggaagcttgataggtaaagcagaccaaaaagcaattcatggtcgggtgcagtggctcacacctgtaatcccaacactttgagaggccatggcgggaggatcacttgagctcaggagttggagaccaacctgaccaacatggtgaaaccctgtctctactaaaaattcaaaaaaattagccaggtgtggtggcgggtgcttgtaatcctagctacttgggaagctgaggcaggagaatggcttgaacccaggaggtagaggttgcaataaaccaagaccatgccactgcactccaacctgggtgacagaatgagaccctttcaaacaaacaaacaaaaaaaaagcaattcacactaatcaatggactttgaaccttcctaatcatttgtaacgttccgcaacagatgtaacttaacaatcaggttttagattttcgaaaaattgtattccaaatccaaagattgacaatgaagcatcgcttgtgttatttatagtaatttttgttttgctttgttaatgttcacattgtgatctcactgtgggcccactctggttttagaaattaatggaactttaggtatcctgacttcactaagttgaaattcacttgaatcggttgccctttctccctccctccctccctcctccctctctctctctctctctctctccctttnnnnnnnnnnnnnnnnnnnntctctctccctttcttttcttttcttttctttctcttgaaatagggtctcactctgttgtccaggctggagtacagtggtgtgaatcactgttcagtgcagccacgaactcctgggctcaagtgatcctcctgcctcggcctcccaaagcaaggggattacaggcacgtgccaccagacccagccttgttccctctttcctttgtgaaaagtgcctatcccagggggctgtgacctcaccttaactctcttcctttctggcccaggatccctccgggtgggtgtggtgaaatcttaaatgaacaatgcatttctataaccatcaggtactactgcaatattttataattagagctctcaaaaattcatagaatttcagccttgggaagagtttaaaaaaatacatgaatgaagggttctacctcacacccactaggatggctagcataaaataatcagaaaataacaagtgttggcaaggatgtggagaatttggaactcttgtacactgttgatgggaatgcaaaatggtgcagccaccatggaaaagagggtgacagttccttaaaaaattaaaaatggaattaccttgatctagcaattccatttctgggtttatacccaaaagaattgaaagcagggtctcaaagacatatttgtatacccatgttcatggcagcattattcacaacagccaaaaggtgggagcaacccaagtgtccatcaacagaagaatggataaataaaatgtgatatataatacaatggatgattattcagctttaaaaaggatggagcacagaggattcttaagggcagtggagctactctgtatgatactctaatggtggatctgtgtcataaatttgttcatagaatgtgcaacacagagtgaaccctaaggtaaaccatggattctgggtggtagtgatgtggcaatgtaggttcatcagttgtagcaaatgtcccctctggtgctggatgttgatagtgggggaggctgtctgtgtgtggggacaggaggtctatgggaaatctccatcccttcctctcagttttgctatgatactaaaatttcccttaaaaaaagtatatattttttaaaagcaaggaaattctgacacatgctacaaaatgaatgaactttgaggccattatgctaagcgatataagcctgtcacaaaaaaaaaacaaaacactttttattccacttctatgagatacctagagcaggggtccccaacccctggttaagaactgggctgcactcttttgattaatgaaaccttatagcattatgaaatggctctctttgttcctagcaatattcttttctctgaaatctactttgtctaatattattattacctctttggctctcttttgattagtgttggaatgggatttttttcccccatccatttacttttaacctatttgtgtcttcatattcaggactagggctgggcatggtggctcacacctgtaatcccagcaccttgggaggccattgtgggcagatcacttgagcccaggagtttaagaccagtctgggtaacatggcaagaccccttctttaaacaaaaaattacattaaaaaaaaagaagaagtactgggctgcacagcaagaggtgacagcaggatgagtgagcattactgcttgagcatgccagggatttaggttgcatactccttaggagaatctaatgcctgatgatctgaggtggaatgatttcatcacgaaaccatccccgcacccagcccacgtccatggaaaaattttcttccaagaaactggtctctggtgccaaaaaggctggggaccatgatctatagtattcaaaattaaaaagacagaaagtagaaggggctacttctacttttgctaccatgatctacagtattcaaaattacaaagacagaaagtagttgccggggggaacacggagtccgtgttttgttttgtttgacacagggtctccctctgtcaggctggagtgcagtggtcgatctctgctcactgcaacccccacctcctgggctcaagccatcctcccacctcagcctcccgagtggctgggaccacaggtgcgtactactgcacctggctaatttctgtatttttagcagagatgggttccaccatgttggccaggctggtctcaaactcctgagctcaagcaatcctcccgccttggcctcccacattgctaggattacagacgtaagccaccacactcagccagggagttcatttttaatggatacagagtttcattttcacaagatgaaaagaattttgaagaccagcggtggtgatggttggacaacaatgtgaatgttcgtagcactgctaaactgtacactcaaaaatggtttaaggcaggagatctttatgttatgtgtattttactatggaaacaaaaaataaaagtgtatctcctattggtcccaagtagatgggattttgttatattttcaacagcacactttgagttgtaatatgtttttcccagaatcacagaagagccagtgtgctcaggtccagctgacttagtgccagagctgctcagagaatccttcatgtccagttgaagaggaaccaggccgcctgcatgtggttgcctttgcggagacaaaggtcattttcagcccttattgcagggtaccacattgcaaaaactcactgctctccagctgttaagatttgaataaggtaaatgaccgtgattggcctttcgccactgggatttgttcgcagtgaatcatcagcacttgactgaggagccagctcagcatctttttaaaagtaaaaaagaaaattcagttccttcccttttagccaaaaatgctatgagtcagtactttggcactgggagtggaaagcagtgagaaacgagtgggcctttgggatctgacgggaaaggatagctctgggacaatattgtttatggattggctgtcatgcatttgccaagcaatggcagtggctgtttagaagctttctgcgcctcaccccattcacatgtcctctttctggctgtctcagttctgaaccccatgcagagatcagctgacatcccttgtcttccatgaaacctcattgattagtccttccccggccgggtcttctgaatcccgggctgtattcttttacttttaatagtcattggaaagtcgcttggcacttcgttgacagcccttgggctactgcctttttgtgggtaagggttgtcttccaggtggagaatatttctccagaccaaaaacatagcttctgttttgtggcctcatggcttagcagagatctgtatgtgagattgggtactgggaacagcttggcaagttattaacctctgcagagctcaggtttctcattttaaaaataaagacaactaccattaaaggaagatcgtgttttcaggattagataagacaatataggtagagcacttagcactgtggctggtgctcaataattggtggttattactcttactagtaaggtaataggtgtgtattctgtttgggagttaacctgagtttactacccttttagaagatagttccatcattccgataattcatgccgttgtcattttgtaatatctttgtgtgaaatggggccttacagaaaaaaaggtgtggaaatctaacgtaatctcttgtcagggtaagtgtaaatttgagtttcctggaggtctagtgacaccaagtggcgaattgtgatattacatgttggttgtttgagagtgttcaaattctatttcattggtaaaatagcaaattattctgctgtgtatgatttctgagttttcctctcttaattgtaatctagtattgagtgagaatggaaagaatattataagagtactacattgtagacttattgaatgaaaaactggaattctagaccgggcacggtggctcacgccggtaatcccagcactttgggaggccaaggtgggtggatcacttgagcccaggaatttgagaccagcctgggcaacatggtgaaactccatctctactaaaaatacaaaaattagccgggcgtgatgtcgcgtgcctgtaattccagctacttgggaggctgaggcaggagaatagcttaaacccaagaggcagaggttgcaatgagccgagatcgtactactgcactccagctgggtgacagagtgagactccgtcaaaaaaaaaaaaaaaaaaaaaaagaaaagaaaagaaaaaaaaaactggaactctaaattgcacaaagcagaaaatcgattcttaatgtgcaagtgttttcttcatgtattatttatatcctgtcaacacagtgacatatttgaaattgacaccaatttataatggatcgttagtaatacttccttaatatttctttcagggacaatgacattctgcttattatctacccagtctgtaaagaaagctgacatttgaatactcacagagctcttgttgacaatgtaattgtgcccactgtgtagagaacgttagtcctattaacttatgatggcttccgaaccttgactttcttcatggggaaagaaatgaacaactttccattatttgctatgccaccgagacaacatctgggcctggagttagtgcttgaacatggagctgttcttgggtgtatgacaccattcttaggtactgaagagcagaccagagttgatgagctgggattttctaaacctaatcatttgttctcagccttcttcatgtcactgccaacattcatctctggctgtgatctggtcttgtaggtaatttcctcattcattattcaaggtattgtgtggaattaaaaaaaaaatagcccattagacccatcagaatacacctgatgaccagtattaaatgtgtgcatttctgtactttaattagcaaatacctaatattggggcaatggagaaccatgtgcttaagtcaaaagggcttcgtgatagtcattcaccaaaatatacctcctcagaaagagtccttggactcaccaatcctttgcttgccctcaggccacttatttggggtgagctgggagtggctgacatacccttccctcctgcccaccccaaggaaggagcgcagaaatgcagacagcagattgctcagggggaaaacttgcccaatctgcccagacactctgagttgggaacataatcagctggcatttatgaggctcatagttctgtattcagcttcctgatatgcatgaagtaacttatatatttggaacagttgataaaatttgaatttatctttctctctctgtatatatatacacacacacatacacgaaaaatacagcattttatttttgtcatttcttaacatctggagtggatgcaagtttcacaaatgaagctttttgaattatttctgatttaattccttaaataatataatccagattccactaaggcttaagctctctatatccttcctgaggctttgttaattctttgaggacactgtgctgatgattgttaatgccgtggtctgttcatttgtgtgactgaaagtgtaacttagtgcagcgtccagccaggcatgcctcacttaaaacctcggagaaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaaaaattagccgggcgcagtggcgggcgcctgtagtcccagctacttgggaggctgaggcaggagaatgaaatgaacccgggaggcggagcttgcagtgagccgagatcccgccactgcactccagcctgggcgacagagcgagactccgtctcaaaaaaaaaaaaaaaaaaaaaaacctcggagaagctgaagtgctgggaggacctttctcagggtcactcacagaattctgcctcgagttcacaggcttaagcatcatctgctaagggttcaccaacatccctgcccagaagtgttgctgaggctgttagggaggagacggtgagcactgtgccagcctcggcaagatgctgaggtggcagtgtggccaggagcttccatctgggctgcagctgctccaaagtcacctctctctctgtagcatcacgtgcctgtgctgtccttccttacttgcccacgcccttcctggactgatcagaactggtcaggactgacctcctttctcctcccaacctgcctccaaacccaccctacaatgctttgaaaaagaaccctacccgcatgtcatcctttggggctggcttggaaccccgaggaaaacagtgagctcaatctgctaaacaattgatgctgtgggagactagaggagttccctagaggactggctcccctctgtgtcattgcttagtggcccagtgataagccacagaggccactgccattgaggaaataggtcggaggatgtggtcccctgacacattacagggaggcttgctttggctttgcagctggtagtgcattgtggaagttttcaaatcacgagtagatggccactttcagagtggatagggctccctaccctgttgagttggcacacaaaaggcaagggagcgtggcccagatgtcattagacatcaggtttccactggtaggagatccttctggtgatttcaggtgagttagggcagagccatgaaggaatcaagggaggaagcctgagcagatctgtatgatgccccaacccaagatttcctagggaaaactcatccccgtgctcagggcacagtcgtgcctcctccttttgtctccagtttctgagccgttttatacaaagtcatgctgccagaactctggtagcaagtggggtgggggtggggtggcctccagccccttgatctcaccttggagctggtggaagaggatagcgtccttcgtgggctgtgtggtggggacttgtccaggaacagggagtggaccctcagtgtcgcctccctgcaccttgttgcccttgtgtttctggcaccccaggttggcaccgtgaccagctagatggtgccatgaaatgaggtctccagcctgatgcaggtcagacccccttttcttcttttcagtggcaaaggtgagactcatctctggttctccagaacaggtcataagtgttttttcctgcccaagcctactggtccctcacactgtgtcctctgcctcgcccacaccacaggctgcacctgccctcctgctcctggatctaggcagctcagtggtgctgtttctgcagcatggatggattggtgtaagacctgacctagtctttggtcatgtagtgtttacagttgtgcacaggtgttgtgcccttggggaccttacacaagctctgccctcacttttttcacagcacactaagcatggaaatggcacctgcctcaaagggctgttgactgaaatgagatcattgagctgaagttcttagcaccattcctggtatgttcattttctagggcctccataacaaagtaccacatactgggtggcttaaacaacaaatatttattttcttacagggctagaggtcagaagtctgagatcaaggtgttggcagggttggttccatctgaggcctctatattagtttgttcttacacttctataaagacatacctgagactgggtaatttatgaagaggtttagttggctcatgattctgtgagctgtacaagcttctgcttctggggaggtctcagaaaacttacaaccatggcagaaggtgaaagggaagcaggtacactttacatggccagcaggagagagagagcaagaggggaagcgttacacactttcaaacaaccagatctcatgagaactcactatcacgagaacagcaagggggatatccgcccccaagatccaattacctcaccatgtccctcctccaaaattggggattacaattcgacatgagacttgggtggggacatagagctaaatcatatcagcctctctcctaggcttgcaggtgggacaccctccccttgtgtccttacacggtcttccctctgcatctgtctgtgaccaaattccctctttgtgtaaggacagtagcaagatcagattacatcccaccccactgacctcattttaaagtaatcatctgtgtcaaggtcctctcttcaaatgcagtcacattctcaagtactcggggttaggaattcaacacatgaatctgaggggggctcaattaggcctgtgatctctagcaaataacaaatgctcaacgaatgttagttactttttcctgggcagttattctaaacttttgtcattttgttttatttgttttattttctatttctatttttatatgtctatttgctacttagtaaatgacccttcctcctgtatttttttgcagaaaaatgaggtaccagggcataaacttattcaacttacagaatgttcttccctctcctttgccccaaacctcactgacatcatccctttcctgccagtctcagaaaggggggtttctctgtccctgctccaggttcatcctcactcctctgtgctctgacctcctccaggaccatgagccagcccctgctccctcttcctcacatcttcagttttctgccatcttctccatccttaacctgtctgcaggatcaggttccccgttccttgaccctgcctgtccttccagcagctgagctctctcttttttgccttttctcattggagcttttgaaggaaaagcctacattctgttctcttctttttgtcattcattcatttattcattcatttgttgagcaccttctttttgccagcactgggctaggcatttggaatctaaagatgtgtattcatagtcccaagaccagagaagaaaacagatcattgtaatataatgaggtgtgtggcatgccttgttagagaggagcccagtgggccctataggaggacttaggcacatctggcccaatcaaggcatagaccgaggtgcgaggtgcaggggagagcttcccagaagagggccctgctctgagtcctgaaaattagatgggccatgagcaaggggaggtcttcccaggaggggcaaaagcctataagcaggaggcctgggatcctccaagtgggtggtattttctttcctcccctttgctcctcagctcactgacctctgcatgtgcctcgccattgaaaggatttcatgggggttccactggacccccactaagtgacctggagaacgcagtgtgttctttatctaatggaccacctcccctccttctgcctctcctcccttagccccaccctcacctgccatcctcattcctttctccatctttctttctctgtcttcgtggaagctcctctgctgtgggccccagaatgtactgggtgctgactcaggcaattgggttattagtgatgtcagcaaaggacaggaggaagagcaggcatggggatgtgggaataataataatgcatttgtacagcatgaggactgggagttttgtgactggtgagatgcagtggacagaggagatgagagagaaaggtcaggactgcaccaggaggctgcgtgtcatcaggatacaggatacagggtgtgcttgagccatgatggtctatgggatggggcctcccttttcctcatttcttacatcaaattaggttcaaaggtcctttgtttttccactctagccatcttttgagtccacctcactgcagtattcatcatgcttccttcccactctgtctcagtgctgccccccaccccatctccttgctacctctctaacatgccacttgctccttgtcacttctctctgtgtggcaacctctgttgactccacatatcaatgcagaatacctccggagctttcaggaatgtttgtaatcagactccccatcttaaatatttatcataaattgataagcaaatagttattggatactatgtgtgtagctctgaggtagtgagcttctctgtctgtatgtctctttctctacacacacatgagctgagcacttagtaagcagtcaagatctcatgtcaaggctgaggcaggaggattgcttgagcccaagaggtcaaagctgcagtgagctatgattgcatagcgacaccccatcttaaaaaaaaaataaaggctacctgtcaaatggttgattaagaatctacatgaggaaagaacttgctgaaagatgtttgagagccacagaaaggacctcagaggaaggaggaggagagaaatgtctaggtggtagataggaccagttggaggtatgctggtgctgagccacggaaatggttgagctgtgggacaaggataggtatccaagtctgtggtcaccaatcaatgagtgtgaattttaagtcagcagttggaaaaggagaagctcctgggagtgcagttaatgaagaattggaaggatttagtctagacgtagaaaggaagtccaagataggattattagctggtagaagacaggaattatttgtaacttgctccctgtccttgtgcaaacaacaacaacaataaaaacaaccgaggtccagggatgggatttcatcccagaggtgcgttagcagctccagggcccagcattaacagggagagtgcctttactatggaattttttttttttttttgagatggagtttcactcttgttgcccaggctggagtgcagtggcacaatcttggctcactgcaacatctgcctcccaggttcaagagattcttctgcttcagtctcccacattgctgagattacaggcatccatcaccatgcctggctaatttttgtattttcagtagagacaggttttcaccatgttggccaggctggtctcgaactcccgacctcaggtgatccactcgcctcagcctcccaaagtgctgggattacaagcgtgagccactgcacctggcctactgtggacttttgatgaaagcacgcatcttcctgtcttcttgtatctcatcatttctcaggggagtgtcatcaagctctaagtcttagcttcggtgtcatgtccttcaacctaaaatgggaactagcatgcatgtgttgttccaaatggcagagctcttgtgcggggtccagagaaagcccttttaattcttttcttctttttcagtgcttcagttacattgaagccaatcaatcattctctgcctacttcattggcaaaaattattcaagaaaatggtatcctgataacagactaccctgacatagcacagtcacttgtggaagagtggaaatcttataacttcagttggttgtttgagctatacagtgctaaagagctgggtttaactcacttttctttttaacagaactgagtgtattcctggggcatctgctcttgcctgtcaagtatgttaccctaacaaatttgtagcttgtttctctgttactccatgggccctttgctgcttccatggccctggctgttcataggtagcccagtctcatctctgttctgccactgccccgtgtgctaactgaggctggtgattaacatttagggcactgaaatgaggctactctttctgcttttgacctcaccaattctccccacaagatatctgtgaaattaattgtcttagttcattttatgctgctataacagaatacccgaggctgagtaatttataaagaatagaaatttgtgtatcatagttctggaggttgagaagtccaagatcaaggtggctgcaggttaggtgtctggtaagggtccagtttccactcccaggatggcaccttaaaggctgcatcctccagaaggaggaacactattcttcacatggcagaagagcaaagagccgagaaagagagcccaccgccaatagtccttttatgaatgcattaaacacacccatgagggttgaaccatcacggcctaatcacctcttagaggccccacctcccaatattgatacattggtgattaaatttcaacatgagttttggaggggacaaacattcaaacagtaggattaaccatttttattcttttggcaaaatatcagaagcgggattggctagaaaaatcctaccattcaaaaaatgctaatatcattaggcctgatacattaaagcaaagtgaatggtctcaaatgtggggaagtggcacttctgatattgcttttcacaactaatttctggatggagccacgaatggaaaacaattctttaattgttaggaagattagcaaaacctaggaaagctaggcagctttgaaaagaaaaagtgtgagggtctcggtcccttaatagaaaggagaaagagacctttagattgtgagagagacctcaaacaatgtcatagatcatttggctgctataacaaaataccatagactgagtggcttataaaaaacagaaatttatttctcacagttctggaggctgggaagtccaagatcaagatatcttggtgaggaatcatttcctggatcacaggtagtatcttcttgctgtggaaggggaaaggcagccttctggggcctcttttataaggtcactaatcccattcatgagggcttcactgtcatgcctaatcacatcccaaaggtgccacttctcaatactattacatcgggggttaggattcaacatacacattctagggggaacacaagcatttatctcatagcaaacaaccaagtcaccactgattttgcccctttgacaactgagtcagtgtgtgttgggtggagggccagcgtttcttagggaaagaggaaccctgatagggaaacatgccatctcttgtgagcacactggacaagtttcccagggctgccttaataaagtatcacaaacttggcttaaaacaacagaaatgtattatctcccagttcttgaggccagaagttcataatcaaggtgtcagtagagttgtgtttcctcccaaggccctagaggagaattcttccttgtctcttccagcttctggtggctccaagtatccttggcttgtggctacctcacttcaatctctacctccatgttcacatggctttctcctctctatcttctcttctgtctcttataaggacatttgtcactggatttagggccaacctattaatctaggatgatcttacctcaagatccttaactttttccaaataaggtcacatctgcaggtactgggggttaggacttggatgtatctttgtggcagccaccattcaacccattacataccagtggagtcaggacttcagacactcacattatatgtcctaactgttggttcaaaaactatgctcattatagttgcaggagaagtgaaaattccctgagacactgtacccttgttacatatggtggtaattgccctgatttttatcttcttttaacatgtagcattttacaccagacccagggaaatttgctggagaggttgtgcttcgttttgaactgtagatgagcattttgtttccttgttggttggctgattggttaggacgtatttgggagaatgccatgggttgggaggtcggtacagtcctgagaaaaactctttcttcagtttgtgctcaaaggccattgtttgtagaaatgtcctctatgctgggactgggtaaggttttttcttcttgttttgttctttcattttttttttctcttagaaagtaagcctgagaatctatgatctgctgagagaattacttgtaaatcagaaacttggtgtgtcagtacccaatctcgcagccctcctttgtgagagaataattgcagctgccccttgtaattgaatttcagagaaattccaatagatcaacagtcaggtgggctataatataatgctattgttgtattgtcagtgtgcaagctgttagtgctaatttgactttctgccgtagacttgtagacagtagtaattgcaagtaggagcaacttcatctgatgttcaggaaaaggaagctaaggggaattctgctggaggaagtgtcagatgaaggtgctctgtagagagcccaaagcccaaacaggtgaccctcactggtcaccgctgttgctcatgctgtgttgagttttgcggcattaagtatgtccacaatgttgtgcaaccaccaccatcatccatctccagaactttttcatcttcttcaactgaagctgcagactcattaaacactatctctctattcctcctcactccagcccctggcaaccgtaattccacctcttgtctctatgaatttcactattctaggtacctcatataagtgaaatcatacaatatttgtcttttgtgatggactcatttcacttagcataatgacctcaggattcatccatcttgtagcatgtgtcagaattttcattcatttttttttttaaattttatttttactttatttatttttgagacggagtcttgctctgtcatccaggctggaatgcagtggcgtgatcctggtcactgcagcctccgtctcccagattcaagtgattctcctgcctcagcctcctgagtagctgggaccacagcaatgtaccaccgcccagctaacttttgtatttttattttttacttttttttttaaattttttttagtatttattgatcattcttggatgtttctcggagagggggatttggcagggtcataggacaataatggagggaaggtcagcagataaacatgtgaacaaaggtctctggtttttcctaggcagagggccctgccgccttccgcagtgtttgtgtccctgggtacttgagattagggagtggtgatgactcttaacgagtatgctgccttcaagcatctgtttaacaaagcacatcttgcaccacccttaatccatttaacccttagtggacacagcacatgtttcagagagcacggggttgagggtaaggttatagattaacagcatcccaaggcagaagaatttttcttagtacagaacaaaatggagtctcctatgtctacttctttctacacagacacagtaacaatctgatctctctttcttttccccacatttcccccttttctatttgacaaaaccgccatcgtcatcatggcctgttctcaatgagctgttgggtacacctcccagatggggtggcggccgggcagaggggctcctcacttcccagacggggcggccgggcagaggcgcccccaacctcccagacggggcggcggccgggcagaggggctcctcagttctcagacggggccgccagtcagagacgctcctcacctcccagtcggggtggcggccgggcagaggcgctcttcacatctcagatggggcggcgaggcagaggtgctccccacatcccagacgatgggcggccgggcagagacgctcctcacttcctagacgggatgacggccaggaagaggcgctcctcacttcccagactgggcagccgggcagaagggctcctcacatcccagacgatgggcggccaggcagagacgctcctcacttcctagacggggtggcggccgggcagaggctgcaatctcggcactttgggaggccaaggcaggcggctgggaggtggaggtggtagcgagcggagatcacgccactgcactccagcctgggcaacattgagcgctgagtgagcgagactccgtctgcaatcccggcacctcaggaggccgaggctggcagatcactcgcggtcaggagctggagaccagcccggccaacatggcgaaaccccgtctccaccaaaaaatacgaaaaccagtcaggcgtggcggtgcgcgcctgcaatcccaggcactcggcaggctgaggcaggagaatcaggcagggaggttgcagtgagtcgagatggcggcagtacagtccagcctccgctcagcatcagagggagaccgtgcaaagagggagagggagagggggagggggagggggagagggagagggagagggagaggccagaattttcattctttttaaggctgaataatctcttttatggttatgtcatattttgtttatccattcatccatcaatgaatatttggattgtttctactttttagctattgtatgtagtgctactattaacatgggtgcagaaatatctattcaagatattgctttcagttcttttgggcatatacccagaagtggaattgctggattgtatgggaattccacacttaattttttgtgagaaatcagcatgctgttttccacagtggctgcatcattttttattcccacaagaatttcacaagagttccagtttccccacatccttgccaacgcttgttattttccattttctgtttatttgttaataatggccaccctaatgggtggcaacccatttccattttcaaatgaattgtattttcaaaaaagttttttcatgtttcttgtttcatgtgtttgttttgtttgtctctttaccttgagctttctgtttttcctcagcatttcctgatctcctgacatcttgtttcaaatgtctaggaactctccctgtggccctcctctctttggaatgagaagttcagatcccttacagtctcttattgttcttgtttttatttgtatatggctctgaacagtatttctaagattgggcacagcacaaaacaaaacggctgagagagagagagagagtgagagaatacaagtgctctactccacccctaagagtggaaggggtctggatgcagagggattaagcatagttgattctcagtggcttccagtcagtcttcctaaaagaggagaggagcaatgtggtttcttaaccattctttagctgctttctaatgatcttttctttgtgggaggacatttcaaggtttccctgagcaagaattttctctttctgtcctttgcacagcaactggtaaactgagatccttaaaaaagtaaatatttttaaatgtggaaacatcgcttacaaccaagtgaataacatctggctaacaaagagcatggcactatcagatggaattagggcacatgcacgcagtacaaaagctccagatgctcgtgttaattcagttaaattcgagtcaaagaatcagtggagccggtcctttggactgactggtcctataaatacaaatggccaacgcatgcccagcctggctcattgatcaaacagagtagagatttattgacatatacaggaatattctttttctactgaaagatggctatgtgtgttgtacttatttctaaaattattggcatcatgaatgacacattcatgaggtacctgccctgtgttcagaagactgttaggtagagaaggagtaaagaactgcactggtgatctcagaacagtgtcttctagggcatgatgtaaaggaacttgcagatttcatgttagagcaacttaagttatggcttaagtcagcggtcagcaaacgttttctgaaaagggtcagagagtaaatattttaggctttgtgaaccatatgatctctgttgcaactactcaactctgtctttgtatctggaaagctgccatagacgttatgtaaacaagcgagcatggctgtgttcctaagactttattcatgggcactgaaatttgaatttcctaccatttttacctgacacaaaatgtgattcttcgcttgagtttttttttttttttttccaaccattttaaaatgtaaaaaccattcttagctcaagggctgtacaaaaagatttggcccatagatttcaatttacggaacccgtggaagtcatagcttccaagaatgtttctttttgatgctcagatttttgtatgtgtaggaaaacttggatgcaagcaaaataaaaagtatgttctagcaaatggtttacaaagatttgaatttatgagatgaaaacaaatatttccggccacatgcctcagtgtaattaggtttgctgatttaatgtcttcctgaaggcagaattttaggtagcaaagtgagcctgccaagtaggaaaggaagacggaagtttaaaaactctagcactgcctatgaaatcttaaatcctgcattcatgcaatttgcatgttcatttcctcttttacaaaatgctcctggaattcttatggtttcattgttagtgaaaattgtttctttttttccccttcacaatcctatattacaaattctccaaacctggcacttcacggcatattccttttgaatgtctttaattctgcaattttatacacccccttatcttacaaatttaattagtttccagaagttctgcagagaaaatgggccataataattcttgattattgccacttatcttcttataatttgatacaagaggattttattgcatttttaaagtagttttaatctgaaaaagatagtcctctccaagtttaacttcatgcagtagtaataatttaactactatttcctggttctagaagtatttttctatctaaaaagaaattgcttttctcaaattattgtactaccattgtattagtctgttttcacactgctgtaaagacatactcaaaattgggtaatttataaagaggtttagttgactcagagttctgcattgctggggaggcctcaggaaacttacaattgtggcagaagggaaagaggcatgtcttacatggctgcagattagagagaaatgtgtgagaatgcaggaaaaactaccatctataaaaccatcagatctcatgagaattcactcactatcacgagaacagcatgggggaaaccacccccataatccaatcatttcccacaaggtctttcctaaacacctgaagattaccattcaagatgagatttgggtggggatacaaagtctaaccatgttatccgtgataataatttaactacttcgtggttctggaaacacctagaacattgaagttctgagttatcattgaccagaacaatgccagaaaaatttcataccctttaacctctcagcataagccaattcttgataatcccggtcttcacattcacaaaatatggccaagcaaagcttcctattatgtctcctaccctaccaaaacattcaataagagtgtctagtaaattgtagaattaaaatatttccattgttccccactatactacctgtacaagctcctgatgcatttggtttttagtgtctcaagcgtagtaggctcataagaaaattcacctccccagttcaccctttgcaggtttcctttgtaagtcatgaaacaaaagagctagaagagacattgttcatttagtataatttatcattttaaagaagacaaaaccggcactcagagatgctaggctcacactgtgagtgatttacagagtcaagatgaggagaatccagttctgctgattcgctgcagtgcaaggtcctgcccatgattcacttgttcttggggcattgtcgtgattccttgtttctatcttagaagtcaaggaggtgtcctataaaagctttcctattcttagttcactcttctgaatatataatgtaaacaactaacaatgaacaaagcagaaaagacaaagagaacataagagagtccaggtaatccagggtctgtacaaacaactctttcatacaatcaggaactggtcatggtggcataagtaataactggcataaatgtaaaatgaataaagaccatatgtttgcccttcttcatgttggcagaacatatgtatgttaccagaatttcctatgctttagagttttcctctaaaaccctctgaaacttaactaagctcaatggaaaaatgaagccttttaacagttgttttgtaagaaaatttttatttctgtatatttctgtgtgcatgaaaaaaccacacctgtattaatttgttaaaacttctgtaataaataaccatgatctgagtggcttcaacacaaaaatgtattgtttcacatttctgaggactggaggtccaagataaaggtatcagcagggttggtttcttctgaaagctgttagggagaatcattcccaggcctctcccctagcttctggtgtttgctggcaatctttggtgttccgtggcttacggaagcatcttccaacctctgcctttatattcacgtgccattcttcctgtgtctttgtccaagtgtccttttcttataaggccaccagtcatattgatttaggggcctgctcaactccaggatgacctcatcttaactaattacatctgcaatgaccctatttccaaacaaggtcatatcctgaggtactgggaattgaaactttgacctataagttttggggggcacagttcaacccacagcaacacccttcactgagatattgcaaaaaataagataactattttgttcgctgtagagtttcatatagacacttcttgagctgaaaaatttttgttaacagtacatgtgtttggacactgaagggcagtataacactacaaataatttcaaaaagaagtttatggcttgattgcttcagaaattacattgttatggtgattttgtttaaatgcatcaataactatggctatcatgtatgacgattttaaccttatttatgtctgattacacttaatattaaagtcagacttaaaacttgtggataacacgttgaaatttgtctaaatcagaaacaaggagagaactttaattttgagatttgcgttgaataactatgccttttttgtggttttaaacctttaaattgctgttgattgtggtagttcatgcttagatctcatttcctttagcatcaaggaagttatgattggcgtggacaaatgtttcagccttgagggaattttcaatcatctacttgtcaggtacttgaaaagaatattatttcaggggatgcaaggggaaagttcatcttaatttagttattgcactgtattcttcacatgtaaaagaaaaatggataatatacagaaggaaagaaaatacaattttcatgcactttggtcaatgttgattgcagtttgaatgccttatggttgtctgaatctaacagctgttagaccagaataattttcaatgtaaaaccagtacaaggaaaggacaaactggaaaccactgatttattttgctctctcttccatggtagttgactctgagagtaatcttggaagtttatgtttcaccaacattaacttaagggctatactgctattatttgcttttctctgaacacttgcattgggcctgacatgtccatgcattatctcatcaaattctttcaatcatcctgggaggtagatgcaatattatcctccttctctctgtgaaggaatgtgttgagtaggtgactcaagtctcccattcatggaattgagttttaaacttaagtttctctgactccagagcctatactcaaaacctctattatatgctgttctatattgctgcattgtttaaagtgaattggaatagaaaaatatgtaaacatgagcacgttctcatccaaacaacaaaagcatcttcctgtgctaggtagatgttctgtacataaatggactggaccactagggacattcagagccaatcatgacatcgtaagagaaggccatcagtaatatgagacaagtttgtagaagaaaaaaagaatcatgtcaactcattcctgatttgtgagaaacccaataaataaaaatcaaccattagaaattatttgtggaaagctctgatttttttttggccaggcatggtggcttatgcctgtaatcccagcactttgagaggctgaggcaggaggactggcttgagtctaggggttcaagaccagcctgggcaacatagtgagaccccatgtctacaaattttaaaaattagccagctgtagtggtgaatgcctgtagtcccagctcctggggaggctgaggcagaggatcacttgaacccaggaggttgaggcagtccagcctgggcaacagagaccccatctttaaaataaagtaaacaaacaaatgaataaataaaacaataaataatctgatttttatcctttcactctgatgtcctaaaccccttttccccagattgctgagttttatttactctgcttccttccaactaaagctaacatttctaatagttttaaatggccctggtggttttttaacatttgggcagagaagatgtggccagaaggaaaattactgcacatggtggatttttatttttagagagagagtattcatttttaaggtgaagttggtagcttttgaaaccatgatttgcccttgcagccagaggatggattaaggggggagaaagggaagtagaaggagcttcttggctttattggaggggtttagttttacctctgctgagctggtaacatttgctctgaaatttcctgttatagattctccactttttttctctcctcctctctccaggaaaaggaaagggatagtcatgatgatcaagcattggggaagagaggaaggacacagaaaacaatctgttgactaacacaaccctttcccaggacaggaatgtaagcacatgtagatgcactcatgtacatgtgcacataaacatgcacacacaggtgcacacacacacacacacacacacacacacacacacacacgacttgctgtattggttttttcatgagctctaatttctaggagtggtgggtcttgattgtgccctaccctgcctttggaaattacaggagctgaagtgtccggaagctggtagtctcccctgagatcatagaaacagccaagagtactggctctgcacatgttaaccatggctgctggaattctcccctggagactacaaactgcctgcccacgggttgaatccaggacatggacatgtctcatttggaatacacaatgttttttataaaacacgattttatcaccaactttttaaaaatcaggggctttcaaatgaaaatctgatttcactctctcacagaaaattaatcaatctggcctactttcctgcatgacaagtgttgagctgccccatttataggtgggggggtgttccaggtcagtgcagtccccatcaatttcctactgtctgcctgtgttaatggccagtgatcgccctgtttgcatggtgttttattatgcctggcccacttcactgtgtatgttacctgccaggtctctgtaggtgtttgaagtcatgatgctttatgccttagttcatgctttgtggggagatggaaaccagccccatgttactcactcaactctagatttaaatagaaaagaattaattgtagatgctctaatatacatagtatacaatgaagacaaagaggaaatattgacctaaggtgttttcatcaccatatataatttttaagaggccattaagaatcaagtttgtattcgtagttgtgtacccacatcagaatttatttgtaaaaacgtaatgtcttgaaaccaagctttcattttgaactgtacttttttttatcttactattgccatctctctcaaccttttattagctgtgtttagatcttaatacaattatgcaaaaacagtattattattcaaacaattccagagaatgtttccatttataattttaagagctcacttgctctcaaatatatttttggaagaacaagcatctttctccaatattttggaagccatgtaaatgtctttagtagctgcatttaagtatgggtgaaaaaagtaaatttattnnnnnnnnnnnnnnnnnnnnaaatgtcagctttgtgggattgttgttgtttgaaaaacatcatttacttaagaagactaatttgcactgtataaaaaatgccttttaatctcaagttatatatgcagagaagtagattcaaacaagaaataaaaatatttaaagcaacagactcaatactttaacgttaagtgacctttacaaatgttcctggcaaaagcatacttccatggctttgggaatattattttacacaatctcaggcagcaagccagtgcacaagaacataccaggcaaagtgatttatctttatgtttttagctctcaaatatatgccaatacttttgatacttataattttcttgcaaaactttttaataatctgattttaccaaagagtccttgtgagaaattgatgtaacgtcatgtgtcaagtctctcttagggcctcacacatcataggtctcagcactcatcccaggctccttctaaaaaacatcaagagggaaagtcatagcaccagaatgcatttgtgtgcatgttgagtaagagtcaacaaaattataagagaacaatgagttgctttaaacacatttttaaatcctgactctatctgaggatgttgcctgacacagattttatgggttgggtttggttctctgggtttgaagcctgacttttgtaactttatctgcatgccaagattcctgtaaagcaccttacactagctgattagtgactctttccctttgctccaagtttattttgccccaaacctattctattaatggtgttttgtaggcttataaacacttagtaggagaatctcagagcatcatttctttgttcttcatcttgacttttcaaaatagtgaccaccctaacaaagaacatacaataaactgatacaagaataaacatttgaaaatcttttttgaaggtatagttatttgcaaagttttatatgaatgcttttgaatggactgaatccaggccagaggagcattttgtatgggtttacgtagtaccacagattttattttttaattggaaatgttaaatttacaacaattcttcctattaaaattttttagagaaagtaatgtgggagcagagtgcctgatgctgcttgctttggacagggcatttatgatccagtttgccactgatgatgttttttttgttttgttttgtttttccccagccttcgctcatccatattccctacctatccctggttggtcctgtgtttatgactcctgctatgaacacctcttggcattggtgatgagaacttgaagtgtttctcagaatgacttgaagatagcgttatgtccaatatcactccccaggcattaagcagagaaccagccatatgttcagtgccacattttaccccttaaggatctccaaaatattctgtattatgtggcttcatgtttctcttcatagttttatttcttctttttccaattatcacagtaagatgtttctgcctaattagaaaccatgccacaatgttaactacctacttgcatgaatcttttgtgcaatagaatataagtttgcctctcagcaatagaatataagtttgatcttttcctatccctgaaaataatgagttcaatcagatggctcagataagccaatttcctgggcttggtcacccttaatcttgaacactcatcttaaggtaattgatttaggttagcttctgggttcagaccagagtttatttgtatcctctccagagaaactactgtgtcacagtttttattttcttggactatcctttaattccttaagtgaaagaggggcaagtaggtgagctattctaaaaaggaggtagacaacagtaaaggatgtcttaatgagagaaaccagaggaataggactgatgtggtattaacttggcaaaagaccaggattggaaaccttctaagtaaactctattcttcatacctctctttcccagatatttaagtttagtattctattcttaaataatagccccaaatcactcagacagatggtcactcagagacctacctactatgccttactagtatcagcactgacagcagtagctgctcatccctggtgttctctgtaagccaggcatggaactgattactctacatacattatctcatcgaacctgcatgaaaccctacagggtaagcattggtaggtccattttacatatgaggaaactgaggcttgaagatgttaaatagttgtccaaagtcacacatctattaggtggccaagccaaggcacctggtcaatatttgttactagggtgtcattttacactttgctctagtctgaacgtttgtatccccccaaattcctatgttgacatcctaacctccaaggcgatagtattaggaggcgggcctttgggaggtgattaggccattaggttacaagggcatcatcctcatgaatagaatcagggctattattagaggccccagagaggtcccttgtcccttctacctcgtgaggctaaagtgagaaagcaggccctcaccagacaccagatcatctggtgcctcgatcttgaacttccagcctccgggctgtgagacacaaatgcctgctgtttacaagccacccagtctaggatatttttgttatagcagcctgaatggactaagagacacatttttaaaaagagaatgaaatgttagcattaaaaaaaaaacaggatagataataaaggatgaatcatttagaataggttgcagtctgcttaggtgtgtctgagtccatgaaagatggtgatccatgcataaagggtgcattcctgggtcagagggtatgttcaacagaaggctgcaatagctgatgtccatgtcaactacagcagctgagaacacatccaaggaaggaatacactttcaattccataattgactttttctgattgacccagcgaatcaaattgctaccatttcaaaggagaacttttcctttttctatttctttaagcatcagcctgttagtttgagtgttatctcctagcctattctgaatttcaacagtattatccattttttttaaaaaaaagtcttagagcttcatgttttaaacttgtaaagagtactttgaggatctttattttcttctttctgttaattattattatttaactaatttattttttattcacatattttcctctggccaagatccagagattctttaaagaattttttattagaagcttctagccataagaactagagtaaaataaattatcactttcataaatttatcatcaaagaatgaaaacaaaaatgtaaagaagggatggagaatgtgttttatgacaataacgtaacacgcttctaatatttggctataaaactgattgtaaacatattttagaaccagaaacatatggaattacatgattataggacagaaaaattcacagtggttgacttataatatcatgtggcataaaaatgttcattgctaagaatggagagaagaagccaagtatggaatgaaattggaagaggaacctcctctcaatttagttttggcaggacgaggagccccatatgtgccaagttttaactgaaagctaattataatggtcacattacgaattgtgcagaaagaggaaggttgttgacttggcaccttagatacataggtaactagatttttttttaaaaaaaaagcagtgtaagcattcctttttggtaaagagcatctcattaaactgttagctacagaacgtttaagcctgccatctttaactggtattaagaagtttaagaaattacaaatgaagtattttaaagaaaaagaaagttaaaacagaaataatgtgccatactcgataattgcaatagatggaatgaatttattcgtttttacttctgtgatggtttattctcttgcttaaaatatattatttaaatggatgacagcaaaatattttggtgtctctgatacaatggaaaacacctgataaagacacaatgacttctgtggcttcaaatgcatccagggctgcagagatatcccctgtttcgtttgaagagggcgctcttgtaaagaaaatatccttgcctaggccctgctgagaaactggcccagctccctgaagtcagcgtcaccatggagatcttattccagtgagggggaatggattccacggtcctgctttggaaatgtgtaaacagcagatgcttttattgcctttgtttgaatctctgcccttgcagagcaacacaggccggaagctcagaggagaggaagtccatatttgtctgtagcgttttgtttcctcgtaagcagcttagtctcttgggacgactgtgcgtaatgacaagttaatggaaaagatatgaattcagatttcacataaagagagtcagaaaaaggaatatgtcttccttgagccaaaggaataattcgaacttccttcttttaaaaaggggggtttattagacaccgtttttattatatactattaatatacaatatatgtggtaactattgatcataatgattttatcagctgaaatttataatatgcaaatgtgagggtgcatgatagactcattttcctacagcttggtagttaacagcctgcatttgggttctaagtgacctccgttcaaattcctactgattttctgtttaacctggctggatttttcatctgtaaaatggggatactaataccaataaattattgtcaaatagagtttgtctctttcagagttgaaaggattcagtgttatcatgtatattgaagatgaaatgtagtaatgtatacagaactattcctgttggtacatcacaccaaaaagagtattttcatatttattttatctttatcatataattactgtgataaagcatattagaaccaatgcagtaactgataagcaagagaatttaagtcactcatccaagttcatgcaacagttataggccaatatgggctcagaacccaggtatcctgaccctcgttcaaggacttttcccagcacatctggcaattataatcacccatgttttttgaggtattgtgggtatggcataatgctaagcaccatcacatagagtctcatgcaataaatggactgtttttcattggagttaaaaaaaattcaacattggagttagatttccgtataataaccaaagcactaagtaaaaactgaaaattagtcaacagaatattaagtgtcatgtactataaacagattacctggcttatgaattgcatatattacacatacagtatcttttgcagtggagatatttcaacagagagcagttttctcagaggaataaaaatctctggttgtcacgaaactagaagttggtgacagatctcaagaggccctgagttaagacagtggtccttagcacatttgttatatcaggtgaatatgcttacaaatgacttttcgcagcatcattctgtggaagcctaatggaagtcagtggtataaaccgtgtcccacctttgtgttagcagcttctaccagctttccacccattctctgatgctaattcaaagtgtgtctttctttcatcaaagtaatgatactgatagaatccttattcccaaagcaagaataggcacgcgtttgctacattttcttcaaatcaacttagaaaagaagcatgttggtataaaacttaggaggtacatactgtgtgtttgcttttttaaacattttttccatttatattacgtatgcactcgatttatacttatttagaagtaaaaatacatttgggctaataaaaaaagctaaactttattgaggacttattctctttggattcatcgtcttaactcatcttgaaacaactgatatgataaaccgagacacaaagagattaacatccaagtggaagtgctgggttaactcagaagctgggctctgttgatagtgctgtgctcttagggaacagcttaagcagacatctccatggtgccaaaagaaatggcacctaacgcgagacactgcctttgctctgactgaagctaggatctacagaaacaggactcatttcaagatagctgatggaggtttcctgatttgcgcaagtcagtgatggtggcagagcaagagctggagtgatatcacctgtctccagcttttgacaaaaccactagaaggtaatgtaagtcactctcggctgaattactgatttgcaacaggaattatttggatcataagtctgtaaacatatactagaaaagaagaggtgatggataagggcagccatattctcaagacctagcccagtgactggcaaataatgggcactcagtaaacacgtattgatcaatgggtagaggttcagagcagggatgagtcactttggattagagtggatagagaaggtagggcttgaatctgcaactgagcaataggctataggagggattcgaacaggcaaagagtaagaaaggatactagatagaaaaaacaaacacataggaaagaacaagccctttttcaagaaaaacaggtaaagcagataaattgaaacatttttcaggttaggacatagttcttccatccgtccatctatccatatcatccatccatccatccatccatccatccatccatccatccatgcatccatccattaatccatccatcgtccatccatccaacaaatgcttatttaagtatcaggcaccatgtcccaactaaaaaaaccggaagcttgaaaggtaggttggggtcagattttgaggcatctggaatgccaagctcagaaagatgaactttaacttgaggatagtaagccatggatggctttctgagccatggagagagatattgaaaatttgtgaaggaagagtagactgacagaattaaacaggatggattaaacagaaaggcggtagggctgagaaaatccactagagtaaaatgccagggtccacaagcaggaggacgagccctggactgacttggtgctgggagtaaaggagaggagggtgggagaaaggcctgggtttgaaagttattgcaggggcagaatctctgaccgtagtgaaaccacagagaagagcaggctctgacaacatcaactctcctgggaggtacaggagcatggaggtggaacagaaaagcttggaaaggtgcttctccacaggttggacatctctcttttctcaaacttgatacttctgcctttgcgtctgccctgtatctaatcatgatgaatgcttctaacatctgacacctactgagcaatgaattcatggcagagaggccaattgtcactatccctttgtaacaagaagcatgtttttcatccataaaacgaatcttttaaaaaactggtaactacactgaatctttaggacaccaggtttcaaaaggagtaacactgcatagataaataaaatcagattattgtgcgaaacactggttttcaattcctccacctttttataattccttaatatcagaatgtacagtaatgcctcaaggaaaattctcaatgtacatttgtctaaagaagagggttataaatctccctctgttattctttcttgttagttggaatacattacagctacctctgtatcaatgataatgcatgagcgcgtggataattgaagtgcattgaagtgcacagattatcctaaattcatctttattataaccttgtgtttaagtctcctttgctatcaactctttaagaagacttctagcaaggagcggttttataaagttgaatgtgatctactgaccatacctaccttttccaatgggaagttgtgagcaggaaagtggttacatgatttcgaacagaaagcacggaaaacatcagagtttctgttagttcaacaaattctctcatttcaatcactgaaaagtgagaggtaaatgaatgcatgttgcttggcactgaggtgacttgcccctgcctttttgtgctgggtgatgacagttacttttctctaacaatcattgcattccttttatattcttggagtctcagtgttggaaagaacatcaaaatttcatcacgtttcatttcccgcttgccaaaaaaaaaaaaaaactgcccaagatggatcattgtttgttctgttctttaagtctcagacttggagaatggtcatcagtaaactgatggaagagcattggctagcaacctgcttaaaacctgttgtagttttgatgatggttatttttccacatagaagtggcgtgaaatatgcacacaccgatgagtaggatgtggttagcaatcagatgttctcaaatgcaaatggtgggagtgggaatgtgtttcctttaaaaatcaatatttttcatctatcggagatacatcatcagaatgtttgatgtagagtaggcccatcataaatgtctgagtgagtaaattagttggcagtgaaatatttatcagctgcagaagcatggccgcctaggagcagagtggataactgttctgtctttcctgtgctcccagagatcttttcacctatggctgtcagcccacttccaaagggcactctgaggaacagtatctgtctgcatgatgctgtgtgagaaaaaagttctggaatcaaataagtttgggaaatactggatttttctatctcttctttgacatcatggtgtacattagaacattaagggttttgagaatttggaaacaaatattttccaaatctgtttggctttagaactctcttttgcacaaaacgtattaatcatccacactttaggagatactcctcttttgggttaattgttcacatttgggtggagatcatgacttcttcatttctgccagatgctgattggaacgtggtaggcattcagtaaatactttctgtaaatgaaatgtaaaatgaaaatggccatagggggttgattgagatgatgctagaagaagctatggtgtcatgaaggtaaagatgaacaggattgggttggagtcagagagaggagtgaaatggagggtgggttctgaattcaaatggtctgcttttaaaccaagtagaatatcagagcttctgacatctctcttgaagcccttcagtttatcttcctcagtgattacagcctccctcttaaatcccctgtgtttttaagctttcatgggcagactaaacactgacaaccgtggatagtacctcattcgtgcttaatgttgattatcaaactcttatagaaattccattttaaaaacttcggccaagtgattatttagaaatgagacattatttggaaagacagtctaaagcccacacatcattgcatttggggactctaaataatgctgcgttctctcaacttactattccatgtcttacagcacatgtaatgtgtccgagtagcattcccagggactaacaaaaaagcagaactccagaggtgcccacagaggaaactgcagacaagtcagagaggagcgcattacaaacacagggccaaacaatcgagcactccagagaggcttgtctctggtcctcaaatatccaggagaaaatgctattacaacatctatttcatacagctctgaatgggtgcctgcaactggccatcttatgattcgtccaagtggtcaaaggaaattgaaaatagttaaaaatcagcagtgttcctagtgttggtattacacataatgtgaacaaaatattacatagtctatccaaagacagagagcaagatgcttgaaaattattcattttgatcacatttacttgcaaaaatgacatttagctttcttaaagttctcattggagagtaagtcgagtaaatatcaaaaggttgccttaaaacttgccttttgcatggcaagaagaagttgggtggcctgggagttttagagtttggcagagcttgggtggtgggcatacacttaccataatctctctaagcctaagcaatagcttaatttatttattattatttttaaaagagtttcatttttctttcaactagaggtagaatgggtttaaaggaggtgatgttcatatcatgagagaagtatttttctttggtgattatcgtgtgtatatgacagcatcaattactaaacatatttgttgttaaaaccatatgctgacttgtgttgctatcaaagagtattacattccgaagaggaaaggggcactgcacctcctctattatggaaacaaagggctcttacctcagagcctgttgatatatcaagtaataaatgtgacagttactggttctattttccttatcctgttttcctgcagaactgaaatggaacatgtttcttactagtaacagatgctcgaacccctcttttgaaattcctctgtggaagctgccctgttgattccattaggtgggaaggggctttatgcagatgtctgctcgtggggttgcattgttgtaattgctgttctaccacccttgctgagtgccatgcttttctcttgtaggtgatgtgccttcaggacttttttggtgatgatgacatttttattgcatgtggaccggagaagttccgttaccaggatgatttcttgctagatgaaagtggtaaggaaaaaaaaagttcaaaaccaggggaaatttgaggcagctttcgaaaatgagctgcaccaggccaagattatgtcaactccaaagctaccaaatcagtttcagatcctcacccagcgtgtcttttccatatcttggatttctttgattttttttttaaatatggaaaacagatgaaatgagaattggaaaagttaaatcatttagaagaataagtaactaatgtctaatttataaccacttaataattaaattgatgttatgtagaaaatgatggtgtggaattctacatttttaatttttttttcacggtttttagctgagggatttgtcatcataaaataatttaggatgtttctaggctcagctttcaggtggcttcctttaattcctaaccaggcaagtggtttgctttccctttttcctttaaatactgtagaattcatgtggcattagcatctgtgaggtatcagaaaagagaagttagcttccttccattaacaaactaaatgtgctactctgtaatagataaagaggggatggttataaagagggaaatacatgtcttaggaaatgaatgtgaaatgttgtggctttaagaatgatatttttgatactattaatcatctgagaatcttagcactatcacaggtaagattattctaccaaacaaagattattgtagcccttctttgataatgttactctaatttaattatgggagtattgcatatttactgacaacccaaattctgcgtagttggaaatgctttttgaaatgataatgaattttttgcttagatgaatgcagaaaaacaaatcagtgagcttttgaaatagtggctgagcaacacttgagcattaacaataatgggaaaagtgatgtggtcacttgacttgacttgactttcacctgttctacacaggagtggtctcactccaacactgcagatgtgtgttaatgcatagcatctatattatacacatatatacatattatcagttgtatgcatttaggaactacaattctttcatttaaaaatgacttagaggatgggcatggtggctcacacctgtaaccccagcactttgggaggccaaggtgggcagaccatttgagcttaggagtttgagactagcctgggcaacatggcgaaaccctgtttctacaaaaattagctgggcatggtggtgcacgcctgcagtcctagctgttcaggaggctgagatagacagatcatctaagcccagggaagtcaagggtgcagtgagccctgattgtgccactgtacttggtctgggcgatagagcaagaccctgtcccccaaaaaaatgacttagagtgtgtagggagggataagaatttttaaaattgcccctttctcatgaaaacttcagatgcccaataagaatataaatagatgtgtcatgtgaagagatttattttggttcaaggaccataactagacaagtggtttggcatccctttttctctaaataagttgactcaaatacattccatctttatttctgacctacgtgccctttgaggcacagatttttgtaaatatatcacaagtatagtgtcctcagggaaggtcccccccacgccaccattttaagaacagctttgccattgtgtagaacaggtgaaagtcaagagtcagacagaagagttgacagcacggttttgagaaaaataaactgccctaactttccatttaaagaaaatagctgcttgtgatagaatggtttggcagaccagatgcattctgaaatgaaagtctgtttgttgctttgatatagaaaacagcctgtcaaactcgacctggaatacatgtctttttcaaaccagcaagcagagttggccacagcttccaaactctggggtctctatctaggccccagatggacttggggccccttctccctgctggccaggctgggtgagctcacacagctgggcttcccctccgcaacagccaatgcgctctccacccaggatgccgcagctactcctgtgcacctgctatgaccagcaggtagactttctgagaagtacaacaggaaaatgccagaaattccataatagagtaggtgcactgcccctttcctcttgctatttcccccttagaattatttctcaatgcccacaggctgggtgcagtggctcacgcctgtaaacccaggactttgggaggccaaggcgggcagatcacctgaggttgggagttcgagaccagcctgaccaacatggagaaaccccgtctctactaaaaatacaaaattagccaggcatggtggtgcatgcctgtaatcccagctactcaggaggcttaggcaggagaatggttgagcctgggaggcggaggttgcggtgaaccgagatcgcaccattgcactccagcctgggtaacaagagcaaaactctgtctcaaataaataaataaataaaagaataaaaaagaatgcacacagattatatacggagatatgcacacaagggctcacatgcaaacacacacacacacaccccaggacaccttctccatcttttgtggtttggccttctgaaggaccacttcaaactacttagctgagaacttcacatcccttccctggatgaataataccctaaccctttcttggtgtgaaatacatttgctgagtaacgatgtcctcccccattccaaaagaaacacatggatatggaaggaaaggggctcaaatagaaaaacgatctaaattgagattttacttccttggatgaacttaccccaagactaaattcacacattgacaactgcaattttcctgttgcttgtacagcatgttctagcgctaatgtattaacatttgaatctttttttaagtgctccgagcatgatttagcccagcttatctgtacttgctaagtggtatttgcacatcgatgcttcatttggccttttccatagtagcttccttaaaggggtgtcagcggtgggtacagacatcttcagaattactactcttgccctgcgcagggctgtgcttcatttaaggtgccaagaagtggccttttgccacaaggcggcacttttattttaactttccaaattaacctggctcccagtgagttcaggatttagcaataatacatccctctaattactgctaggaaatctcctaaggatgtctcttaaggtccatccttggagaagatttgccattgtagatgagtatttcatggggccacattggagccagattaatatcggaaactgccagggagactccttcctcccctaagtttgcacattcggaaaataacaccttccttgttctagttcagaatgtaaccattttagcgatatcgtcatcagtcagtagaatcttagcaccttggagatggtggctagtgcactatagatagagacaagcagagaggccagcagatccttcccttgctgtctaatttagaatgatgaaacagaggcagggaaaatgtcacattggagacaggaagctcaacatggttttgcttctatgttgatgacaaatggacgaatttgtaatccgtagccatttaaaagtgatagggttttgttgagaaaggatcaccccatgcttgggagggacagtgaactccttggggatgagcctgatgctggatatcaattcttgtccaacctgctggcctcaaagccagtacccccactctgcttggcttgttccttcacccattcattccactgccatccggagcctcaccttggccaggcctgctgcgtgctcgggagtccagatacctgtcatcctctctttcatcttttctcagattattctgtttttttatcaactagttcctaactgctcttgattctgatgttaataggcgttaccttcaatgtctattgttttgcttagatgctgaatgaatttcctagggctgctataacaaagtaccacaaactgggtgacttaaaacaacagaaatgtgttggctcacagttctgaaggcaagaagtccaaaatcaaggtactggcagggctgtgctccctctgaaggctctagggaagaatccgtcctcatctcttccaagtttctgatggctgccagcaatccttggcttgtggcagcatcatcactccaatctccacctccatcttcatgtaaccttctcccctgtatgtcagtagaatttccctcttctcataaggacaccagttattggattaggacccactcacattcagtatgacctcatcttagtttggtgacatctacaaagactctatctccaaataagattcattcaaaggtaccaggattcggactggaacatatctttttggggaacaaaattcaacctaaaaaagacattggtgggagctgttcaaattttatttgaacttggattacaagtaaactaatgtttatttatttgtttggatctgtccttagatacttaccgttatagcattatatttgttagtagaatacatcaacaacagagctgtggctgcccctcatctgacccttcacacttagggtttctcacctcatggatcagaggaatgctgtcagacagtctgagaatttcaacagtgcatttgacagagcccctcttgaagtcccttggactaagatgaaaatatatagtaaatggtataggtggctgtatttttaattgatttatcttctctgtccaaaaggtactgatttataggctgatgtcaaatgtgccggaggagatctctattaggattgtcccatcaggcccctgaaggaagggattgtgtttgtttgctgagagtgaacaggtttcacaccacaaggttctgctttggacttgatatggtttagcatagttagaagtgtccttttgaggccaggcgcagtggctcatgcctgtaatcccagcactttgggaggccaaggcgggtggatcacgaggtcagaagaatcacgaagtcaggagatcaagaccatcctggctaacacagtgaaaccccatctctactaaaaatacaaaaaattagctgggtgtggtggcatgcacctgtagtcccagctactcgggaggctgaggcaggagaatcacttgaacccgggaggcggaggttgcagtgagccaagatcacaccactgcactccagcctaggcaacagatcaagactccgtctcaaaaaacaaaaaaaaaatgtcctttagaaaacattaaagccgtgtggattcgaaccatcagggaggagagctgatgtggtcaaaggtagaatgaggatccgaaaaggttctaacagggtggattgtatctaacaagataaactttaattcatataaacaaaaagaagagctctagggtgtgaaagaaagatagaaagaaaaaagccagccttgcaagcttacttaggagcaatgtcgttttcacagcagcacgtgtgaaatttacttttacttgactgcaggcttagtatgagatgttatgtgatatgggtcatttgtgtgtggattgtaggggtatcatatttttatactggaaaatgtttttgcccctctgattgaagatggtaaatatgaactgaaacaaaacattaaaatttaaaaatgtgttatttaatattcataaaactaagtaactgtagaaaaaatgtaaacaagctttcagatttttgtatgtttgctgtgtttataattctgaagtcattaaagctcaaaactgcaggaagacttttgagacgcagcgtgcgtgtgcgtgtgtgtgtgcgtgtgtgtatgcccgtgcacgtgtatgtgtgcctgtgcacgtgtgtgcatgtgtagtgcccgatctccaggaaataccagttctgcttctccctgcaccagacagacgtgcctgtagtccagtgttgttcttcctgggtatgtgattctagaatggacatttcctcagcttctcttatggatcaccatggtgttgggtacccaagatctgcttggtaaatatttctagaaatattctattctaaccattttcctgggactcatgtcccaaataagacagaagctgtatcaggtaccattcaccatggggttctgatcactttccctaattctgggtgataagaaaatagggctagaacctattaggttgctgcaaaagtaatcacggcttctgccattaaaagtaatggcaaaaaaaagtgattacttttgcaccaacctaatggaatagtaggaacagtattggaatagtgggattgtgttgagaagacacagtctcatccaggctctatgtcctactttctgtgtggtctctacatctccaagcctgcttcctattccctgaaacacatttttttcctgagttgtaacggacctcaaatgagacaataaatgtcaaagcacattcgaaactgtgttccttattacccagtgaacgatgctggggaatgacacctcagctgaaatatacctcctagtggattgcagctggactcagccatgtagcttcatttgtggggcttaattggaggcagatgacatcaagatctgcttttggtgctctttggaaccagaaagcgattactactgctttcttccactcttaacttttgttgctgtggtggaggtgagagggaattaaggctcctttgaagatatccactcttctctggagggaatctctagaagattaaactaaaccacctgtagaagaaccaatcagacttctaaaagtgacagtgttcaggagtcccagcccttggtaaatgcttccctctctccgtgcccatgttgatttgggttaaagagacctgatggccctgctgctttgtcctgaggctggtgatgctaggaaaccagaaggttaatggaaacactggaagatgctcacagtcaggacaaagaccacacctcctcacaaactagtttttgagctactgctaacaaaatccatccattctttcactcatgcagtcatttattcaataagctaacttactatgtaccaggcagtgtgctaagctcaagtacctgcagacagtaacacttaggtcagatgtgacccttcatactaacttatttttttttttttttgagacggactcttgctgtgtcacccaggctggagatgtgacccttcatactaactttttttttttttttttgagacagactcttgctgtgtcacccaggctggagtgcagtggcgtgatctcggctcactgcaacctccacctcccaggttcaagcgattctcctgcctcatcctcccgagtagctgggactacaggcacatgccaccatgcccggctagtttttatatttttagtagagacgggttattgccctgttggccaggctatccatacagacgtttaatattgtttatgtgtaaagatgtcaggggatcttaggtgctgaactttgacccagaatattaaatattgcatattattctagtggcttttatctcttacgaaacatactgtggtaaaatgactagtgatttgcaatagacagacaactctttgtaaatctaaattttaattggattataaggcctgtttacattgcatctgtgggcagatttctttgagatggatggtatgtgttggtgctggcatattttatcgtttcaatagatgttaattctaggaatatacagtttttattttaaagaaacagtatagggccgggcatggtggctcatgcctgtgatcccaacagtttgggagctgaggcaggtggatcacttgagcacaggagtttaagaccaacctgggcaacatggtgaaaccccatctctacaaaaaattaactgggcatggtggagcacacctgtagttccagctacttggcaggctgaggtgggaggatcgcttgagccccagaggttgaggctgcagtgagcagagattgcgccactcctgcctgggcaaaagagcgagactttgtctcaaaaaacaaataaacaaaagccaaacaactgaaaaactaatatagctatcttgttgaataattctaagtttttgtggctcttcattgtcttatgagaaaaggatataaaatctggtatgatcattcccgattgcattgatttgtagaattcagcctgatgtctgaaatagagggtttgggagcttttgtctgttttgtgttccgaatacagggcacattggctaacgtgctttgctctcgtcagctagttcccatttgcctccaagcagtggaaaggccacaagggtttctggagacgttcccgatcatagctaccttttagctcatgcataaatatgaaatgtcccggaacatagtgatagttccaatttaatcaacagccaaactatggatacatatagagtactgcaccttggagacagactctaactcaagctccagctagttccttcgctacaaatagataattttctacttagaaaatcaaggcattgtataacatctgcaatcttttctttacattttctcttccggtcctcacaggccttcctttttattgtattcagtaacagtgacatgaatttttgatgtggaaaaccctacaaaatatagaattataggtgaatcctggacactaaaggtcttggaggtcatcagcttcccctcccctttgatgcagaaaccctctccacagcatccaacagttgcttctccatccccaactggaaccctttgttgatgatggggtgtaaatttagaaaaaggccaattccactgtccgctagggctttttttttttgagacagagtctcactctgtcaccaaggctggagtgcagtggcgcgatcttggctcactgaaacctctgcctcccgggttcaagtgattctcctgcctcagcctcccgagtagctgggactacaggcacgtgccatcatgcctggttaattttttgaatttttagtagagatggggtttcaccgtgttagccaggatggtctccatctcctgacctcgtgatccacccgctttggcctcccaaagtgctgggattacaggtgtgagccactgcacctggcctagtgctcatttttgacaagttattgagcccaaattaatgtctccccagcttgcacatagtcctcctagttctggtctccagagtaacaaataccacccactgccctcattctaaggggagcttccctcctaccccttccctatggtcaaagtcactcactgtaaactccgttatttcttttccttctagaccaaaatgacgtatatctttcctcatcttctctcctgttttcctcaactttccaaaaaatgaagtctcctttcttttctaaaaatcaatgatagtcccttgtctttgtcttctctttctctttgtgaccttgcctcgtcagtgttctgttcctactgtttcgtggattttttgttttaccctatctatagtctctcttctttcagcccacagccaggcccaggttcctcctatcctaaaagagcctccagtcatctctgtcatctcaccaaaccacattgcctttctttctctgccaaattgctaaaaaataataataaataatgactgtccttgaagcctccacttcttcaacctgatcatttgttataccattgggtaactggtacatggaacacacaagaattatggggttttatcagtttttttagaaaaattgtcttcccccatcctttgaggtttatgtaaggctggaagttcctttcttggcactggatggcacctcagcaatcccaagatttttctggtccctcctaagatagtaaaaaagtctgtggactcttctagataaaaattgccatcatcatatctagtcctacataatagtcattcaaaatgggagttccatttccacacctagctagatcccaatgtagcatgtggtgagtcccctactctgcaggacaaggggagggttgatgacttctctcctgctcactccctcctccccgctgttttgatccctccaagattggaatggggatgaggtgggtggggcaggatgatgagaaaggagaggtggaaagtccttccttgactattctgttatagggtggcttcaaactctctcggccaagaactgtgattttaaagctaactttctgggaccgggtgcggtggctcacgcctgcaatcccagcactttgggaggctgaggcgggcggatcatgaggtcaggagatcgagaccattctggccagcacaatgaaaccccgtatctactaaaaatacaaaaaaaaaaaatagccggacatggtggcgggtgcctgtagtcccagctacttgggaggctgaggcaggagaatggcgtgaacctgggaggcagagcttacagtgagtggagatcgcgccactgcattccagcctgggcaacagagagagactccgtctcaaaaaaaaaaaaaaaaaaaaaaaaagctaacttttcttttggatgttttaatgggttcttcagggactctcactgggaacattctgctcttctttattaatgtggttgattcagtttcttccagctttggctgagtctctctcagtccctgttttccaaagccctccctattggcctcagatgctcctcttgggaagaatttaaattagttccacgccaccttgtgccctcaaatccatcagaacactcatgcaacctttacctccaacaacaggccatccagtacagccaagcctccttcagttttctgccagaggctctcgggtgaaagtcaaacacataaataccagtctgttatttgcctctgtccacagaggacactgatcaagcacttacaatcttccagtgaaacccctattgaggtgaaggggagcatcgcccctcttttggaatgatggaattcacagcaaggctctctcttaaagaatccttctcatagatctgctttctgtctagtaacttaagccttttatgtcctcaaagtgagtaagaagactaaggtctagaactgtttatatctgctttgacatttctggaataggatctgtctcacaattcactttggtatctgatacacatctccttggagtctgggtgaaatgttcattttcaatcctattgcatttgcaactggcttctatgcctaacatatgtagtagttccactaagcaaggataatcttcaaagcactatattcagtgttctatatttttcttttcttctttatccttcttgacttcttggtagcatttgacatttttgatgattccctccttgaaattctctccccttgacccttcatagtgtcttgctgtcttggtcttttgcctgtccccctttgaatactcttaagctcctttcaggtttgcttttctgtcatatatcccttaataattgttccctaagattcattcatgtttttaaacttaattactctctattcctagccaagttcatctactttaatggctttagcaatgatggttctggtagacagtgatggtgacaaatggcaaccagatggtatgcaataagcaaagcctttgaaggatgtataattttcccaaatttacaattaaggaaattaaggcttggagatgataaataatttgttcaaggccacacagatagtattaaaggcagaggtcaaatccaagtttgtctttgtttgacaatatatccttaatctttaaatgtaccccctttgaggtatacatctctaaccctgactcctctcaggagctccagaaccacatttccaactttctcttatgaacttccctatgactattccacagccacctgaaattcaacacatcccacaactgaactcatcatctacctggtcagcttcatttcttgttctgtgtttcctggatgagctcatggcatcagcattctcaacaccaaggttgcaaaacatggagtcgtcttttactcacccctcacttttactccccatagcccatctgtccccctcctttccaatgctactgccattatcttaggtcagttcctcatcatctcccatttagactcatgaagatgcttgaactttccatccttgttgcagtttttcatctctccacaccatgtttgaacccgattaatcctcctgaattgacttacctagccctccactgcctacagactccttggcatgctattctagggcagttgtagtctgactgggttatatctttctagctgttctcaccctttattcctcctctgccctccaaccacagtattatttgttggtctcccaaaagctatttatttttgaaatatctgcttttgctcatattgcctcattcatgtggaatgctctttttcctcttctccttcctcacccaccaaactccatcttgtcctttgaggttcaagtcaaacatcaccatccttgtaaagcctttctccatctacttggtttcaatcagttactgatttctcattctttttccagctctttgctctttattataccattgttgttcattctgctgtgtgttctgggatttttttttaaaatgcatctagcttgtgaataataatcacgtttaattatcaggaaacctctgcagtgttgctttacaataatgaaagcgatgttaggagaagttgagaaactgcccaaggtcgctgtattaatcaggattctcaacagaaacagaaccaataggatacacaaacacagacacacacacagacatactgatatggtttggttctgtgtccccacccaaatctcatcttgaattgcactcccataattcccacatgttgtgggagggacccagtgagagataattgaatcgtgggtgcagtttccccaatactgctctcatggcaatgaataagtctcataagatctgatggttttaccaggggtttctgcttttgcgtcttcttcactctctctttgcctgctgccttccatgtaagacattacttgctcctccttgccttctgccatgattgtgaggcttccccagcgatgtggaactgtaagtccaattaaacctctttcttttgtaaattgcccagtctcgggtatatcttcatcagcacatgaaaacagactaatacagtaaattggtaccagtagagtggggtgctgctaagaagatacccaaaaatgtggaagcagctttgaaattgggtaacaggcagaggttggaacagtttggagagctcagaagacaggaaaatgtgggaaagtttggtgatagcgatatggacaataacgtccaggctgaggtggtctcagatgtagatgaggaactttttatgaactggagcaaaggtaatcttgttatgttttagcagagactgacagcattttccccctgacctagagatttacagagctttgaacttgagagagatgatttagggtatctggcagaagaaatttctaagcatcaaagcattcaagaggtgactcaggggctgttaaaagcacttaaaagggaaacagagcataaaagtttgaaaaatttgcagcttgacaatgtgatagaaaaggaactatcattttctgaggagaaattcaagccagctgcagaaatttgcataagtaacgagcagccaaattttcattcccaagacaatggggaaaatgtctccagggcatgtcagaggtctttacagcagcccctcccatcacaagcctggaggcctaggaggaaaaaggggttttgtggcctgggcccagggtccctgagctgtgtgcagcctagggacttggtgccctgtgtcccagccactctagccatggctaaaaggggtaatgtagagctcaggctgtggcttcagatggtgcaagccccaagtcttggcagcttccacatggtgttgagcctgcgggtgcacataagtcaagaattggggtttgggaacttctgccgagatgtcagagggtgtatggaaatgcctggatgcccaggcacaagtttactgcaggagcagggctctcatggagaacctctgctagggcaatgcagaagggaaatgtggggtcagagccctcacacagagtccttactgtggcactgcttagtggagctgtgagaagagggccaccgtcctccaggccccagaatggtggtagatctgccgacagcttgcaccatgcacctggaaaagccgcagacactcaatgccagtctgtgaaagcagctgggagggaagctgtaccttgcaaagccacagggccagagctgccgaaaaccatgggaacccacctcttgcatcagcatggcctggatgtgagacatgaagtcaaaggagatcattttggagctttaagatttgactgtcccactggattttggacttgcataggccctcttgcccctctgttttggccaatttctcccatttggaattgttgtatttacccagtgcccgtacccccattgtatctaggaagtaactaacttacttttgattttacaggctcataggtagaagggacttgccttgtctcagatgagactttggactgtggacttttgagttaaggctgaaatgagttaagactttgggggactgttgggaaggcatgattggttttgaaatgtgaggacatgagatttggcaggggccaagtgcagaaagatagggtttggccctgtgtccccacccaaatctcatcttcaattgtactcccataattcctacatgttgtgggagggacctgctggttggtagttgagtcatgggggagttttcccacatactgttctcatggtagtgaataagttgcatgagatctgatgcttttgttggggatttccacttttgcatcttcctcactctctctttgcctgctgccatccatataagacgttacttgctcctccttgccttctgccatgattgtgaggcttccccagccatgtggaactgtaaagtccaattaaacctctttcttttgtaaattgcccagtctcacgtatatctttatcaacagtgtgaacatggactaatacacatacacacacagaaatagacgaaagatatacttataaggaaatggcttgtgttattatggaggctgagaagtcccacaacctgtggtttataagctggtgacccaggaaagccagtgttacagttcagtctgagaataaggacctgagacctggaggagccaatgatgaaagtcccagtccaaggtcaggagaagatgaaatcagatgttccagctcaagcagtgagacagaaggaaaaaggtaaatttctccttcatctaccttttgttctgttcaggctttcgtggattggatgaggcctacctacgttggagagggtagtctaccttatggagtccactgattctaatgctaatttcacccagaagcatcctcacagacacaccccaaaataatgtttaatctgggcaccctgtggcgcattcaatttgacacataaaattaaccatcacagttacatacccagtgggtaacagagttggaattaaaactgaggatcctggacactttgtactttatcttactttattgtaagtgccttgagattggtcctgtgtatcattaaaacatatatcccacagtacatatcagggtaccatgaatgtagtaacagctcaggaaatattagctgaattattagatgcagaaggaatctactccatctgtcaatcatcagatgctgaggactatagcctggtacttcccaaaagcttcttttccagacaaagtttcctcagctgtttcttttaagactaccccactatcctggttgcacttctcttgatatccaatactagatattgatcagcaatatcctccctaaaatggcacctagaacagaacatagtattccttgggggcttcaaagagcattgagaatataaacttatttgatagaggcaacaaacttgtccaaatacagcctaagcatgattaaggtttcttttaacaattgccaaaccatgcaggctcatggttagcttttggccagctgaactctctggggctttctgacgtgatgtcaagccagcttctacttgtttaattgaatatttgaacctccttgtagtgctttaattgtattcatgccagatagcatcttattaattttagtcattaattctggccatttaagaactttaagcatccaaattctgcttgaggataaataatagcagagagttgaaaagaggtctgatttccaggcccttgtttttcccaactgagttacgctgctagaggcctgcctagccaaagaccaacagcatagctgcctggaaactctgataaaatgaaaacaaatgaaaaggtatgctaacactcacatttccttgtgggaaacaacgtaagggagcctcagattcaatgcctagctttgtctgggtgattgtctgcagctggttaacaaacagttaaaagataaacgtaaacacattaaaatgttaaagagtttatttaaacagacagcaattcatgaattgggcagcaccaaaccaaaagctctttggcctccaacagagtgacatgagaagaggcttttataaggtgaacattgactcaaggcaaagaaaatgtttgactcattgaagtggagcagtatccttatttaggttattctagtggaaagtccctggttaaagattggttagcagtttctgatgggttatgcttaagtttcattttacctttcacactgagttgtatttcagcttgcttatgtaggaagccaagatgctggaatcatctcagtctaatggggtcccaattaatttcttttgtttttgctttgttttttttgtttttgtttgtttttgtttgtttgtttgtttgagatggagtcttgctctatcacccaggctggagtgcagtgacatgatctcagctcactgcaacctcctctcctgggttcaaacgattcttctgcctcagtctcttgagtagctgggactaccagtgtgcaccaccatgcctggctaatccaattaatttctttttaacaagtcctacagaggaagacaacagattgttttgtcccttacactgacccacacatacccctgagtacaggagggaacttcaggactttcctttcagtgtgggtccacagggcataggaacttatgtttttgttcctatttgaaatatgcccatttgttttcccacaccaaacatgtactagttaagagcctactgcatgtcaagtattcttgggtttaaacaaaaacgttctggaaagttaaatatctacttcagggtttaaacaaaaatgttctggaaagttaaatatctacttcaggaaagcagatgaagtgaaaatccctgtggaaaatagtatatgtgatgtgaaggtgattttaaaatctagcttcaaaattgggtaataatttgatacatgtgtatataggctgtctttatagctttttatttttgtaagtgttctaaatgactaaaatataataagatactgatactctatggctcttcactacctgaagctaagtttttctctcttaacacctctggaaaataaacacatagataagcttttagtaaaaaaaaaaaaaagaaaaaaaatgattgtgtgggtgacatcttcatttttcaataggctgaatcactgtgaaatcatgagtctcacttttcctgaagacctaaaacagatatgaaaggaagtgtggttctctaagttcatatcactcctagtcaaataatcagaggacacagctgaagaaaagtggcagtgctgtcaggaagtgccagcaaatggacaagaagaatccatacatgtttgcttagagtaggggaatgaggaaaggcaaatctttgccagcagagcaggatgaaactagcatcatcttgctcaaagataaaaatcagcctctatgtttagttatgaaagcactccagggccaactgagccagtgattgccttttgtccactaaaggacagcctaacaatatggcagtggggacatcccacaaatctgaccacagagctccctgcccaactattgagaaccgaggttataaagcttttgaatttattagctctggagaaagaaaaatctgcttttatagatttgcccctcaactttaaagttaacatagccaaatttatgttttcatacctttttttatttgtttgtttcacacttgacagcctttcaacagaattttcctgagaataccattagaagttagaagattagtataagctttttaaaaagtgtttagaactttgggaggccgaggcaggtggatcacggggtcaggagatcaagaccatcctggttaacatggtgaaaccccatctctactaaaaatacaagaaattagccaggcgtggtggtgggcgcctgtagtcccagctacttgggaggctgaggcaggagaatggcatgaacctgggaggcggagcttgcagtgagctgagatcatgccactgcactccagtctgggtgacagagtgagactctgtctcaaaaaataaagtgtatagaaaagtgagctgcttcttgctcaagtgagatataaaatgtcaccatatgctatggggttcccaaatatgaaaattagcatagctcaatatactacccacaagggcttatagacaattaacatgaattcaatttattatattgcaggagcctgatcttatatgtgtatacatgcatagaggtatagatttggcaagattcaactaatagtgagtgaatatctacaatgggcaggcactgctcttagcactaggcatatcacagtgaactaaagagagaaaaattcttgcccacatagagcttacatcttatcagaggaatgcatttaacatacaaaatctcatatgcaaattacttagtgtatcggaaggtaagtgccatgaagaagaatgaaatagggaagggagaaagggagtaaatggagagtgggtggtgtggggaggctgcagggggcaagacttcaggaagcagtgacatttgagcaaagacttgaggggtaatggagccagccatgcaggacccagaagcaagaatcatccccgggcagagggagcagttagtgcagagggcctgaggtgagagggtgcctgacctgtcctcatgcacagctcagtagtggcaggcaggccgcagtgctgagggcagttccaacaccaactaccaggagtcggcccagacttcataggttaagggcaccatccccaccaaggctgcccacgcttcaggaccagccatagatttaggagtccccaggccacccacacttctgaccaactggctacaaattcagggattcccacagctccctcgaattcaatagtttgctagaacaacttacagaacccaggaaagcactatctttatgattacagtttcattacaaagcctacagactagggctagccagttgaagcgacagacaggggtaaggtctgggagaggcccataagtggagcttgcaggtcctctccttgtgggatcaggacacgtcaccctctcagcacactgatgtgttcatcaagcaggaggctcactcagctgctagcgtccagagtctttaccagggtttggttatgtaggcatgggtgattacgtcataggccctgtgattggaactgagtctccagaggtcaggctgatatcacatgagtcaaagccctaaccctctaatcacatggttgacctttctggtgtgattggcccccatcctgagtcatctcattagcataaacttggtgtcatccaaaggacccaacatagtgttatcacttgggaatttccaagggtttagaagctccctgccaggaacctgggaagaaaaccagacacatgttttattatacagcatggaagctgtcaagatctgggggaggatatccacgctaattctgtaatgagaataatgctgaacacttataataaggagaaatcaaacggtgtaacaaaaacaatgaacttatcagagactttggatctttgcaaacagagaaaggcaaaatgactagctcccagctcaggacagggaggctgatcactcccttctcaagagtctgatttctgcataaaggtcatagaaatgttttgacaactgtgtacacagccagcttttagttaattagctcttagccattgagaaggatggacttatggcatgattcatctaaaaatatgtataatgcaaaatctctttcatttgcttgtagagtagactttatatttcacacaatgtattatttccttcagacagataatttggaaactggattacttttgctccataaaattcctaattgttggagttgaaagaaccttaaggaatttctagttcagttctttcatttcacaatatgaggaagccaaagcccagagggattacgtgagggcccaaagtcaactagcaggttagtgtcacagctgaggcctgaagcatctgacttccaaaagctgctgacttccagtctagggctcattccattatgtgaagttgcaccattcagtcagtacatcagcatcagcctaaaatgtgcccttggaagagcaccagctctggagatgggggtcatgggtcccaccaactcctgcccttctcacctgtgtgaccctggacaaattacttaacctctctgagttaaggtccacagtaaaagagagacaaaagtagtaccaatcacaaaagattgtcatgaggatcaaaagagatgatgtaggtgaaaaccatgttgcaaggctgtaatataatggacaaatattactacttggtgatattatttttcagttctaagaaactgtcatctcttgattaaaatggagcaaatttgagatctttagtgtgaactatttaacaaacatttatctgaacaatatgctagtgaatgtgggggatgctagcttgtggtgaaactcccaggaagaggccatccacagtcagcagcaatgcttagcaaactcagattggaaaatggtacaagggctgcttgacaatccaaagcagaaagcttagaaattccagcatgtggcgcactgttgagtggaataagactcctgagaggtccctgacaataagactacatttgcagctgggcacggtggcttacgcctgtaatcccagcactttgggaggcctaagagggcggatcacttgaggtcaggagtttgagaccagcctggccaacatggcgaaacccatctctactaaacatgcaaaaattagccgggcatggtggcacatgcctgtagtcccagttgcccaggaggctgaggcaggagaatcgcttgaacctgggcggcagacattgcagtgagccaagatcgtgccactgcactccagcctgggcgacaaagtgagactctgtctcaggaaaaaaaaaaaaaaagattacatttgcaaatatttcttcccttctggccaagagactgttaatatgtgtaactctcacccctagctctggacacctagttttgtatacaaactgcaaactacgggtttaagtaaagcatataggtcttgagatttcaagcatgggaaacactaacagaattacactgcatatcttggatgtgtagtcatattttctgtggtatctccttgctttgttctctgcagagtgaatgaagagtatgcacgtgtataattagagtccgtatatgtaaactgatcagccagcaaataggtcagaatggtgagatctatccaaaataagaataaaaataaaaacaacaaccaaacacacaaaaggtagttcttgactcaaagataataaaattaacataatatgctgtttatcaaaaaatgcactgaaaatggacatgagtaacttaaaacacattaaaatggaataagactttttgttaacctattttgtagcccaagaaaggcattctatcaaactgattgatatcattatttttaaaatgctcttaagagatttttctgtatttcgactgatcctaggctagctaatatatggcatcgtttctgcagctttgccttcacgtggtgagaacattagcatattttatatcgtcttttaaatgtgctgctgctaattatataatttctcatgtttggtttgtagccagcatcaaaactctgaattatttagagtgatgacaattctcttgcctgactacctcttctctagcagtttgcaaaggagtcttgacccaagatgcccgtagcaggtagacttggaagaattctaactagcttctcctttggccgctcctctgcccaataggtttccaaagacgacaggccaatctgtagtagatgtctataagtttgcaaatgtatcagagccaggaaacttttattctaaaatcatttgctcacctttgaattttggtggtgaattattagccagtaagtgctcttgtagtggatggtactaaaaagagcttgtctaaatttaaggtcagcagcctttttctggaaaaagcaagatagtgcatattttagccttcttgggccatatggtctctgttgcaactactcagctctactattctcatgtgaaagcagccatagatgataggtaaacatgtacaggtagctgtattcttataaagcattattcataagaacaggcaatgggccaggtttggctttcaggctatagttagctgaaccttggtcagagccactgatttttagttttctggtgaatatgctccttcatgggaatttaatgagaggtatggaccctactccagaaaaataaatattcatgtgcagaatactaagaatactaagccttccatttcttttttatttttattttttaagacagggtcttgctctgtcacccaggctggagtgcagtggcacgatctcggctcactacaaccttcaccttgggttcaagcgattctcctgcctcagcctcctgagtagctgggactacaggtgtgtgccaccatgcccagctaattgttttgtatttttagtagagacagggtttcaccatgttggacagactgatctcaaacccctgacttcaggcgatctgcctgcctcagcctccgaaagtgctgggattacaggcatgatccactgtgcccggcctaagccttccatttcaagactcatccatggatccaggacttggtcttgacggtgacaagaaagcctttgtaacggtctgctggatgctctgagacagccatttaaaaaaaaaaaagatttgcccccacttatctcacatcagaaactctggactttaatcagactcagcagttcatagagacatagaggtcttgaaccagatgaggcagctgcacacatcaaggggctttaaagggaagaagtcatggacaggttggaaaggtcagggagaagtatactttggggagcactggggagagatgggagtcaaaggcagttcggctgtgatacttgagtaaatggtgggtgacgtggtaattggaaacacagctgaaatacccagatccttatgatccctcgaactattctggtccttaatgacctctccttttgctagaagggggtctagtttagcatgtgcatttgttctgcttcttactgtcttgtgagcatcaaaattccctgaatttattgtcctattcttgacagcaagggctaacagacccccagggtttcttctgtccttcaagggcattcttcacaaaattgtcacccttctcggacaggtgtgtggcttatgtctaacacgttaatgcttagtaatacaggaactgcagcatatagaaatagatagcagggaaatatttttccctgagttgtattctgaaatacaactcagggccatactttctgctcacagacagtgactcactggtgaatcaggggctgagccagcgtgtgtcctttatgtttagtgccaccagattatcatttgtcccatagcctctctaccccccactgctccctcctaagcctcctgacacccacagaattggttgtctcctccttaacaatgttccctaggcccagggcagcccaccaagccctggccgtgttcccagtgactcagatgcccttcaacagctcaggggaaaggtggtaaaaaaaaaaaagaaagtgaagctagtggcatcttggactgtgctccagagccgggttggaagtcaagctctcctccaaaccaaactggagtgtgaccttgtcaagcaggtcccttagcatctcacctgagtcctgagacccccgtctctaaagtccccatcagttgctttcatctggtcacaatcctttatttcagtgcacaaccctgggagatccacccaggggtctttcccgctggagttcctgcattcttttcctgggtagtttactggctggtcgacctgttcactttacttaagttcccaattgattcatagcagttactccaattctttaaagttctgatagagaagccaagtcactttcaggaacaaggaaaggtaaccaggattggatcttcatttctggtgcatcgttcccatgaggcagctctccgggcctctgcttcttcagatctaaagcagatgggtgcgctgagacaggcttccaggtgcccagggatggcagggggcttagaagtcaaacatctgttttaacaccacttgggccacttgaagctgtgtgactttgggaaagtgtccaatagcttggagcccatttcttcacaggtttattgtgaggattgaaaacaataacacatgccaggtgtgtggcttagtcttcaaccaggatttatgcccaatacataacaatgcctttctatctccatctccatccgttcccttccagtgctaaaattccaagctgtattaataataatggcaagtgtgaggttttgtgttcttgcagtttgcgcagtgctttttttgtgtgctattgcctacaatcctcacaatattcttgttcagagatagaggttttcagttacattgtacagtcaaagaaatagattcagaacctgggtctgactgtccgccaatgctctatgctgtatctaataggcaatcaagacatatttattgatcatctgctgcatgcgtagctctgaacttgatgccgtgtgcagggcatgggtgatatgtggtccttctccccaaggaattcatgagtaatggggaaagggaaggtaataggtagaagataattgaaacaagctaccatcacccccaagaaatgtttattgggtacaaactgtgtgcaaagctgtgaaattatagtacctattatttacattaaaaaatttgatttattttttcagtcactttctcataatgatcttaagagaaatagcagagattgaaagtgagccctgattcaactcaagtgatgattttaaaaagtaaacaaaaaccgccctacctatatgtttcaaggtcaggacagggtttctagccttggtaaggtttttgttggatagaacttatcttcatcaatgaggctgtatggagcacttaaggtagtaggcactatgtttctctatttatttttacttctacccaacatatgaaattccaaaactcagtttctagtccagacatccagctgtgtcattgacaccatttcctcccagctcctggggtggcaactttatctctgccctgtcacctggtcttttccccaccttacctgccccttcccacagtcatcagccccataatatatcttgccaaatgtcaccaggtccttctttcattctctgagttactgtgggagattctttagcgctcttcattcctctcttcattcagtcaacaaattttcatttgtttcactttggccagacacctttctgggtgctgctgccatttacataagacagacatggtctttgcctcatggaaccttaaggtctcatgtgagatagggacaggaccttaaaggaataattataggaatgatgtgtactatgaaaaaggacatacaaggggctgtgagaccatgcattgtggatctaaggtttgggttttaggaaagtcttctctgaggaagtcgaatttctgctgaaacctgaaggagtgatagatgttagctggtgcccgaggtggggtctgatgctccatgggtatgtaggggtgagagtggggtgttgtggccgggcaggtgggatgagagaagaatgctttcaggtacagggaacacacacttgaataccagccagctgaggaactgggaaatccaggtggctagagtagaaggagggagagaaaaagtggtaggaaacagggttggggccaggctgtggtaaaccttctaaagccattttacggatttgggatatcctgggaataataggatgtggtcccagcagggtatgacgtgatctgacttgcattttcaaaagatctctttgaaagcagctgagaatggattggagggacccaggggtaaatgcagggcaaccagttaggtcgcttcaaaatagtcattgtggaggtgttggtggcctgctgtgggctgttggccgtggggggcagggagcagtggacagaattaggaaacatggaatggcaggaatgagtggccacggtgacttactgaatgcagggagtgaggagaggaataggtgagggaccacgggcaatttccttgctgggggccacatcgggtggtgacagggagaagcaattgggaaggagatacacgcagctgtgtatgtatgggggatgctgcttagagatgaccccagagcaggtgtccctcctcccggcacctcccaccccggttccttctgcacccagcctgcagattcatggccctcaatctccggtttagaaaactttcgatgaaccagtgtgtgtaggaccaagaacacccttcttgtcctccatggtctcaaccttgtctctcattggccccatccgtaacactcattggtttcctccacaacccccgtgcattttccttcacttggctcatattcccttcaattcctgcttcaagcctaactccttgagaatacacttaccaactgccctagcctgttcaagcttttggttttgctattcattttacacttgaaacacactactgagctttctcgttatcttctccctttatagactctgcctcactgatttacttagaaaacccaattaggatattgtcatacacttcacagctagtcccttccgtgatgctatgtgcattgctatgctccatacgtgtcaaggcaaggacacgtgaagggcaggtctgtggagtggaaggtgagacagatgaatgaggctggaaagtctcatggaaggttgaagatgtggacatagttgcagatacgagtagagagatgtccatatacatttatatcaggagaaggaatttatcatttatttggtatataatagtggaggaagaacattgtgaagtttgaaacacgaggatcacacatggaatgtagtaatttaagaaaattaatctggcagtggcataaaggtggacttgaaggggaaaattgctactgattaatgtatttattttatttgccggctgtgtcgtaagcactttacatgggtgaatttatataattctcacaacccccccacccccccgcaagagtgctactatcattatcctcattgtacagaggaagaagatgaggtctaaagaaggtaaacatttttttcttttttttaatgaaaaaaaattttttttgagaggggtggggtctcactgtgttgcccaggctaatctcaaactcctggcctcaagcaatcctcctgcctcagcctcctaaagtgctggaattataggcatgagccaccgctcccagccaaggtaaacttttaattgttgaaaccaggttgcaaatccagcctgcctaaccattatgctgtagtgtcttctggaaaaagagaggagtctgggagagggctatggtcaaactgttcagcgttctctggggttccaagaagatcctcagagtttgcagccaaaataaaaaccctctccttcagccggagcagccccactggcatctgtgtaaacatttgggctctgcataagatttaagaaacaatcccctgtttaaaatgtttgaaaccactggatgcaagggtttgtgtggtttggtttgttgaagatgctatagaattcacaccacacactgccttagacgctacaagcctgaagaagtcttcctgaggcaaaggaatagatatttgttcttcccaaagatgggaatctgctagctccagaatgaaaaaaaaatgcacttttaaaaaacttaattagtaccaaaacttgttttaaaactcttgggggccgagtgtggtggctgatggctgtaatcccagcactttgggaggctgaggcaggcggatcacttgaggtcaggagttcgagaccagcctggccaaccttgtctctactaaaagtacaaaagttagccaagcatggtggcgcatgcctgtaaccacagctacccagaaggctgaggcaggagaattgcttgaactgggaagcagaggttgcagtgagctgggagattgcaccactgcactccagcctgggcagcagacagagtgagtgagactccgtttccaaaaaaaaaaaaaaaaacacactcagaaggaagatttctttttggcctttaacaaattataagacaattaattaaataggagcacttgtgttgttatagacattccccattttcaggatgctttcataaatccctttatttgagctgtgcaactatctgtgaggtagatacggccagtcatgattagtgcccatttttctttgccaataatgggcttaggaaggctaggcaatttcttgggggttcactgctctgtcttcagtacctcgcacccagtagttgctcaacaaatgtttgttgaacagttgaatgatcgaacaaagaccataagagttggaatctaagccctttaaaatcagggctggttttatgatcccactctgtcttcaatgtggtgagagagtccagtccatggaagctactatgcaataagtgtcatatgacattggaatcagttaacttttagtgattaatgtttggaacactctccatggtcacataagctgaaacactctaccccacataactccccactcctccacgtttcgggtttgaatccacacaacctcacagatgatctgtctgccgggtattacctattgcaaccacctctgacaaacatatgttccttttattacaaactttgatgcaatttatagaacatattgtatcgggatttggtgggaagagtacatttattccaaatttactctctaatgcattttagaaagaaaaataaaaatttgtgtatgccttatgagtcatatgaggatacgtagaaaggattcattctttttgcttgtcacttgaaatgatcacatcttagtatgcctgttaagaataagcattgccatttgactgtaacagtgtttagagaagagaatagcagattaatggtggggtttggacatggtctctatttgttttctcttctgtctggctttcaggggcatgagctggcggctctctgcccttgcccgtggctgcctgaacctctggaattctccccaaattctgaaatgtgtgtcaggccaattgtgcagtctccagcccagctagagaacgcctctccactggaggcccccccgccctgccccccgccacaggaaatgctctgctgagctctgcctaaaatattcccagggtaactaatgattttgaaaatgccacgttaccatggtacctgaggcatggtaggtggggggcatgcagctgggtttcgaattcagtaggtatccagtttataagctttcattttctttttgttttcagttgttgtttaatttataacatgccgagaagaaaactggatcacacaaggcttggcatgctttctctttttcttttcttcctccttgaggctttgtcctccacctcctaagtccctaccaggtgttctgtgtttagaggtaggacgggattgcttgaaagctcccacctttggagagccgggtgtgccacaacctggcaacccccgaagcatcactgaccacaggaaatgctatttgagggcccgacaatagcaaacaaaaccgaacaaaaccctgcctccatccagcgttattgttttagttatatgcaattataggggaggaaaaatacctcttcctctccaattgtagattcatggctgaggcccctataacaagagacagattaacaagagaaaaacatacaaatttatttaatatgagcttcgtgtgacacgagagttttcataaggaaacaacgacccatagaaacagttcaacctgtgtgtttttgtgctagatttgatgaagggtggacagtcatggagaaatgtgatagggcaaaaagggtatgagttaagtgtcatgaactggggggttaagcaaggcctgtttgttcagattcttctctgtggccctgtgtcttcagcgataatgatgctattttcctcgaggtagaagaaggccacctgttgagtgagggagggtcttatgatcagcttcactggaaggtcagaaaatcctttctaggttttatgacctgctgcaggagagaagggaggtggaaggtctgagaggccttcctgcacatgctgcctcctgaatgccctcaccttccaaggtgccgtagttaggacagcatgtcctgaaccttgtcacaatcccatgagcattttttaaagatagggatagatagatattcaccatcacatatgtaatatgtatgcatgcatgtgtatctgtgtgtgtgtattaaagtttcatgttttgacctgctaaggaaagggtatctacagagacatagagggagagaaaaaggaaggaggagaaagagagagggaaatataagtgaagaaaagaaagagataaaaagaacaaaggagaagggcaggatcagaagatggaagtttaaaatgtgttgcgcctctgctgtatgttcctgttgaaggcagggctgggcttcttacatgggggaaggaaaccaaggctaattgtaaggaagatggagagggcagaggagggagaggcagagggggaagagagctgcctagagggtcagagggactgcctggaagtcccagatggtgctaatccactttgtgtttctataatgtacagggctctgggttgcagttactggtcaccagatccctttcaaatgctcatttgctatttctgtcctgaatatagctgatcagtttctgtgttcaaatgcaaacgttatttatggtgcttatttgttatgggtgttttggtttcttttgcccatgggattcttagggttttgctccctggcatcttggaaatctagtgtaagcctatgctaacagggacctgaagatcctttttgcagaaggtaagtgcctcatcacgcagagcctgaaggttagatttagggtaaggattgcattgacctgagactcacctttgactcccatccttaaaatcaaatttccttgatttgtttaattgttttaaaatacttactcttattcttctttgcaaacggatgtgtcaggcttgaacatttgaatgagctttgaaagaaagctgcctcactttttatttggtggcagcctacacaggttagtgatcaatcaaaacataagtaaagtagtaactcaacatttctttgaatgtttagattacttacctttgcatagctcttagccttttaaaaaaaattattattcagactgaaaattcagctctgtgtttttgttggtttgtttgtttttgaggtggggtctcagggtcacccaggctggagtgcagtggtgtgatcacagctcactgcagcctcaacttctggactcaagttattctcccacctcagcctccttagtagctgggactacaggaacccaccactacacatagctagttttttgtttttcttttagtagagaagagatcttgctatgttgcccaggctggtctccaactcctgagctcaagcgatcctcctgccttggtctcccaaagtgctgggattacaggtgtgtgccaccacacccagcctaaaactcatctttgaataggtaactccaggagtcaaaagtagggaatatagtttggggatacacagcctttgcggctggtaacatcagggtgctatgatttaaagggaccccctccgtgttacaacacttactacccaagttattctcttcagcatggttcatagtattgacctagaactattgagtttctgtgactctgaaaaaacataattttttatttcttcaatctgcaaaatagtgatatgttctaaggattaacaaattgcttcaaatgcctgctatgatagcattatacttgagcttaacttatttttatgtttcagaattctctgaatagcagttaactttctcatgggaaatttggatacatttagtagatttcaaagcataatgcaacaataaatgtttcttttcagtatttatttgccccttattgcctcataaaacaattcctaaaatcattggctctctccagtgatcttttactcatcttcaagtcatctccttcctctttatatttgattgaattatgagattttactgtttgccaggccttcaactaattgccagggatagaatgatgaataagctatgatctttgccttcaaaaaaacttctgtcttttcgtgagatggttcataaacagcccagaatttggcagcctcagaaaatattaggttagtttctttttttttttttttgagatagaatctcactctgccacccaggctggagtgcagtggtgtgatcacagctcactgcagccctgacctctccagctcaagggatcattgtgtctcagcctcctgagcagatgggactataggctgtgccaccatacctggctaatttttgtatttttagtagagacagggtcttgccattttgcccaggcttgtcttgaactcctggcctcaagtgatctacccacgttggccttccaaagtgctgagattccaggcatgagccactgtgtctggccttggttagtttcagttctcttttcaattagcaataattttgcttatatatatatatatatatatacatatatatatatatatatgtatatatatatatatattttttttttttctgagataaggtctcccctctgttgcccaggctggagtgcagtggcacaatctcagctcactgcagcctcgacctctccagctcaagtgatcctcccacctcagcctctcgagtagctgggactataggcacatgccaccatacacagctaatatttgtattttttgtagagacgcgtgtctcactatgttgcccagggtggtctctaacttctgggctcaagagatcctcctgtttcggcctcccaaagtgctgggactacaggcatgagccatcgtgcccagccctaatatatctttttatttcctaaaaattcgtacctctttcctatactaactgacataaccaaattggaattaaaataatgcaggctagaatttaagaaaaaataatcatctttcctggacagtgccctgctcaggtagacagcacttggttacctaccctttgcaagtttagttttaaactgccaagttctagtcattgaattttttttatatattatgcttccgtaacttctgttttgtctagaagcatgagccttagtttcttttcaacatttctgaaacacttacacacccagtatcagactttttgctgggaaaaaacacttaggaacaatgaataacaagaattcggtttattctgtttctgcctaacattgtgaggagtctgcatagtcagagttttaagaaaaaaaatgtaatttagtgggaaaattaaaactttgatagccaagggtatatgcagatagccttttctgtgtatttccattaaaaataatttatttgagaaagtggttaggaagaaagacatgtaccaaaaaatttaaattctttaccaaaggcataatggaagtgccaaatgttaaagaattgcatttgagcatttgtggttggacatggtttcaggaaagtattcattaagaagtgaagtcaagagcactgggtatgaatattgtatgctaaggggaaaatgtattttaggtaggtgctggtgaaagaatataccattatcttccttatcttttaagtatccaggccagtatcatgggaccctgcattaatagtgctttgggactgcacttgggtaatattttcagctgaaactgaactaacacaaggccctttgggcagacgatcatcaaagtcacgtggctgtattccaggaccgtttcacatcaagctgcatggtacaagacactgccctggaataagtcacatatctttgaagctccttgtgatgcaggaattttctcaccccttgtcagacttgcgacggaggtgccccatttctttggcccaccatgctcaaccttttgcaggaaggagcatatgagtgagcaagggcaggatccggccagctactctgggcgccagcaggagcagactctctgtaggcccctcagccagaccaggtggggctctctgcaacccccaagaccccagagggtgtgttacaatgctatcttagctctgctgtccgtggacagtggtgtgttatcagctcagtggacttgcctcatagtgtgggacagctgccctctgccagtgagggcaaagggccactgtgatagctttttttgggtacttgcactcagtgggtcctgaactcttgtctggtgtccaagaagaattagttacacagatacttgaaggatggtggaggtagaaaattttacttagtgatagaagttgctctcagcagagaggggagctggagaggggtcaggttgggcaggtaatcttccctgaagtccggttgtcactagctggctcttccctgaagttaagccgtctgtcctccaaagtctagctgtcccactgaagtcgaatcatctttctccagtcaagctgcttctctcttctgccagctgagtctggggtctttataggcacaggactgggggtggggtgggccataggtagttttgaaaaagacaacattcgattggtaaaaagacattattcagaaagaactaattgggagacagtgggcaaacaggaatagaagttctcattttgtgctgtggctttttggctcaaacatgggattttgccacggacctacccctgtctgcctacaatttctgtgcctcctgccactatcacttggagttggccaagcattgcctgagagccccctgcatgccaaactctatgctgaggaccatgaggaggatgcaaagaattcaaggaaggattcagaaagggagggccgtgattgattgattgagctttactgtggggcaggcgctgtatgaaacatattccatttaattctcacagccaccccgaaggaaggtacagtggtccttatttgctcacttgggaagcatggttggagagatgagctacctctccagggtcccacagctatgatggaagggccaagggtcctggccacaggactcctagtatgtgcccttactatgacaccctgctctctaaacaacaaaacaatcagcccactgctggggccagatgctgttttatccaatcagctctctggatctctgtataagttaaagggtgtatatggcctctttgcgatgactgaccactaaagtcctaaaccatttactgtctggttatcctcagtaaccagaacaagaaattgttcagatccacatcctagtagcagctgtacttcaaaacacaaagggcagcttaaattgagaaattgtaatgttctgggtggcagaggcaatactagtcctagaggtccgcctcctcctatttaaggcataaatactacaacagcagagacatcctagggtctagaccagagtgatgtggccccacatgtctagctgagctccagcactaaaggaaacctcacagaaatcccaccaccttctctctaacaggagatctgccactgtggccccgtgggtgtcctgtggtggtggacagacaaatatccctggagaggtggggccattgcttggagcagcaatggtacaagtgtttatctctgaaaaggtcgttgttggtggtaaaatttaacagttcttttttttttttttttgacggaatctcgctctgtcacccaggctggagtgcagtggcgcaacctctgctcactgcaagctctgcctccggggttcacgccattctcctgcctcaacctcccaagtagcttggactacaggcatccaccatcatgcctggctagttttttttttttttttttgtatttttagtagagatggggtttcaccgtgttagccaggatggtctcgatctcctgatcttgtgatccgcccacctctgcctcccaaagtgctgggattacaggcatcagccgccatgcctggccaaaatttaacagttatttagacctgtgttctaagatttgaaaccactgatgacttttcacgaagtaagatttgaaaaaatctctctagtgtcacatccctcaatcggccaattatgcatcattgtcttttgctagtttctaaaatgattaattgcacaaagaatagagatagcaggtttgtgtgaaggatgctcttcttttttgccacctcaaattccccgcttcctgcctccagcaatttctggcctgttctctggatgtcagttcattaccacattagtgtgttcattgtatgttctgttgccaggaaggtgctgccacagcggcccctgggaagtcaggatgctgctagttttcactgtaggtctatcaaagagaaacctgtgggattgggaagggatttggtcatcccagacatgttcggttttaaggaactctatgttctaagaaatatgttgacatcaacctttttatttccagcataggaaggaaaaggaaaaaagggaaagaaatattcaaattatcttggagctgtcctctcatttctattaggcacaaaatccatagttccttttcaaatggttattgacccaacaaaagattggatgtactggggctgagtattatctctgttattatcacattcttttgtcttctatgcactttcattcatctcctgtagaggcagatcacagattgattttaaaagatgtaacaatgtctcctcaatcgctgcagagtacattttgtcattgtgttgactgttcgtgcatttcagtttattattgctggtttcaaaagcatgtaatttttatcggaaagtaggttacaattaagggagttgcaggtagtgatcctgggtcctgttttgtctccttgataaatacaacttagaggagctggagaacacgtgtctggatttgtagctctcctgttccctcctgagtaacctcaggatatagcacctgggggaagacaaaggagaagcaaagcggatggatgcgggtgtctttagcaaaatgacaggtgaggcagggcgagaacagaggacggaggtgctggctgctagaagcttttcaagatggagctgtagaagcaagcctgtttttggtgagagaggcaaagtctcatgcccaggggagatttttggtttcttttaaggagtaataaagtctagggtggtctgtgtcatttcaccctttctagtaaaaaggattagctctcgttgaaaatgcctccttgtcccctgaatctgtcaatactccacctttgtcctcacccttgactttaaaaaccctgccacatgacttcctatgaatgcataaattaagcactttttttcctttgtagaaaaaaaaaatacacacacacacacacacacacacacacatatgcacacagcaattaataaccagagtttattgagggtttacagtgttccggccatttctcattgcatacaaaatctcataaatcccacccaaaaaccatgaggtgagtatcatcccacctagcagatgaggaagtcttagagaggcaaagtaagttgcttaatgtcatacagtggagagccaggattgccagcaagcctgcctggcaccaggacccatatttttaatgtttgcgtgtgtcacatgtacagcgtcttccattttatgtgcaaatattcatttctcacaccctctttggagaaagacaaggtggagaggaggaagttgtaagtgttgaaatgggagcactcacacatgtgagtatccaggagcccccaggaggctcagcagccatgtggccccacctacagccacctcatttctttttctgcaacataaaatgccgctcccgggtgctattgaaaatacatgttgtgtggtgctgacacagtccaaacatacctactgagcgtgctcagatctaattaggagcctgtctctgcttcctgagatatgaaagcgtctggaaacatgttttctttttcttcttgctttgtagagatacatctttttaaaaaattgcagaaagctttttggtttcttgttcaaaaaagtatgaatcggccagatgtggtggctcacacctgtaatcctaacactttgggagaccgaggtgggtggatcacttgaggtcaggagttcaagaccagcctggccaacatggtgaaaccccatctctactaaaaatacaaaaatttgctgggcatgatggtgggcgccagtagttccagctactcaggaggctgaggcaggagaatcgcttgaacccaggagtcagaggttgcagtgagccaagatcacgccattgcactgaagcctgggcgacaagagcaaagttccattgggacaaagttgtatgacaaactacctttctgcctgaaatccataataggagctgggtgatagactgagaccctgtttcaaataaataaagtaaaatgaataaaagaaatgttacatactgttttggaagaaagctcactggcactagagaagcttttcggagctaaatcatgccccaacaaaggatagcacaagaaaggctggaggagcctctatcatcaactagttcagaattagcataatgcaggtctttttgtttgtccttaacccagcattttctcctacttaatttgaataactgaatggcctgcctctttggatgatgagaaagcttttatcttctattgagaaatgatgaatagtattggctgagacttgtttcctaatatctatgccttattcaaaatgtcatagatcttttatactaatacattttagtatactaaaagtttagttccttctataatttatctgttctgaattttccatctccaactaattcaaacctcatcaggagaaaggagaaacaaattgtaccccaaccattgttccttcttgagttgtattatgtcagcacagtcctattttaagatcctaaactctaaagctcatttttaagggtatgaatacgtctagactaaaatcgcaaagccaccccagaacaaggaggaaaaaaaattaaatgttcttagaactgttatttttaaacttaaagataatttatataataataattacatttattctgaaagctcctacttgtaaattgttatactctatactttggtttttaggctcttttttttttttttttaaagttttttcatagatgtaaaattgaagatggtggtgagggtctgaggatagttcacaagactgtttaacccatgcttagcttgaacctctgagccatagtgtcccctaatccctggcttgggctctgctgacaccaactgtaatgcagagaaatggggtggctttggggcctgggatggcctctgcaggctgtcctatcctgcctttccccatacgctcctgttgcaatcaaaagaaaacatagaaacaaatctctaaattaaatgttttatttgggaatcacagaatagcaatttggggcatacacacagactgaggtgggctttggtatgtctgaaaaagggaagcttgggagttttattataaagagaaatgtgggccagggacagtggcttaggcctgtaatcctagcgctttggaaggctaaggtgagaggatcacttgaggccaggagttcgagaccagcctggacaacatagcaagaacctgtctctacaaaaaaaatttaaattagccaggtgtggcagagcacacctgttgtcccagctgcttcagaggctgaggtgggaggctcacttgagtccgagaggtcaagtgagcagtgagccatgattgcagcactgcattccagcctgggtgatagactgagaccctgtctcaaataaataaaggaaaatgaataaaagaaatgttacatattgttgtggaagaaagctcactggcactagagaaacttctgggagctggcaagttctgattagtgggtgtcagtgatggtggtaggaaaaaccagtcttggagtcatggcgggtcatttcagcagctactaggtgacactgtttttaaggttacagcttgccattttagcagctgggcttgcagaaaagtcaattcttggagcagatgctgtgtcctgagtgcttaccacctgactccgggccctcgactctggcttagttgggtatgataagaatgactcaatttgcataatcaagtttcacactctgtatcccaatttaggtctctgtgacttctggaccatgcttcaggccactgccaaaccaaggtgtcctacaactcaccctggccatgtcattgtattgctaataactcttcagtgatttcccctgagccagttgacttgagggtttcagagttctccaagtctgctctcaaactgcatttccagactttatctgtaacttcttcccccaaccaacacatctcctgtgttcatgtctaactgggccactcctagtttcctggacataatttaaggtttcattccctcctttcatctctgttgcctgttgctctttaccatccatcaaaatctagcacaaatgcaatttctgtgaaatctttctaacccttcacaccagaagtaaccattctctcctcagaaatctcatagctctttaaatttatttcttattaattgttctcattctattttctattcatttaacagacattgttaggctttgctatagttctgttttcctttatttaaaaaaaaaaaaaaagaaaatacttggccaaccataaagtgaaaattagaaagcatctacttcctaaatttaggaaactttttaaaacttttttctgttcttgagagtctcccatataaagatgaggcaggaagctggaagctgtgtggttgcaatgctgtttctatctgttttgctgtctggattattccagtaatttggaacaggatagagtggtcctggaagctagcaatgtgggtggctgagggaggaaaagaacaatgctattccacatccatttcaaaaacattctaacaatgaaacacaaattcggatcagtttgtttccatttttaagtaaaaatactgtccacaagagataaatctcattaagatcatgcttattctgttaattaaatgaaagtttgccgagatatataatgggcgactgggacttcagatgggatgagtatcaattaggaaatcctcgccctggcagtctttttttttttgagacggagcccacagtcccacaccaccacacctggctactttttttggatttttagtagaggcagggtttcaccatgttggccagactggtctcgaactcctgatctcaagtgatccacccgccttggcctcccaatgcgctgggaatacaggcgtgagccaccacacctggcctggctctggcagtcttaaaaggaagagaacaaattaactcatctaagtggaaaattcagaggtggccctcggggttgatttgagccagaggattttgaagtctcagagttgtggcttgctgtctttgaaaatctcttgactttgtcatcttctgtgtgtgagctttgacctcatgggctttgaccttgtggaagtgaggtggccactgagagcccccagggctgtgcgcctcctggctcctgggatagggtgggatcttctctttcctcaaccattgaacaaaattctgagcatttctctgaatagacaaagttcaaagtatatcacatgtctacctctacactgtgccagaagaaaactgtgattggcttagctcaaccaaggcccacctctggagctgggggtggaaaacacaatgtttatccaatggcaatggctggctggagggtaagactgatgggggtctttgactaaccacaaggcaacataaggccacagtaacataagttgaggacaggaggccaggcgcaagcaagggttcgtttatcttttgacaccctctcattgaggccaactctgtgccaggcattagtagtctaggtgctggtgatgagaggtgaacagcacaggccaggctcctgccctggtggaaatgacaatctattagggtaggaaacaataagaaaacagacaattaagtgcacagatagtttcaggttgtgacaactgtcatggaggaaataacagaatgagttgcagagatggggaagagggtaccttagaaaaggtgactagatttcagaaatcacagtagaagggcaaaaagccaaaatgcccctttgcaattttgcagattgctgcctactgtacatgctgtccgtgcccgagcaaagcattgagactaatttgggaaaccaaaaagcttcccactttgcttggtcttcactgtaccagctagcccagataaatctttctggctctcccaaggactctccatcgttgtccagcccttctttcctaaaggcaaaagggaaggaggtggacatagacaaggagctatatgccatccagcacccaccactttccccatctcccttctttcttatcagagcagcaagtgcaatgtttgataaagtccccagttaaagagtctttagaagatttttctattaggccaggcacagtggcttatgcctgtaatctcagcactttgggaggttggggcgagcagatcacctgtggtgaggagttcgagaccagcctggccaacacggtgaaaccccgtctctactaaaaatacaaaaattagccgggcatggtggcacccggctgaggcacgagaatagcttgaacccaggaggcggagattgcagtgggccaagatcgagccactgcactccagcctgggcaacaaagtcagactctgtctcaaaaacaaaaaagtttttctattaaaaatattgctgctgagtgaaatttccttactactgaaaatgttgtatgatactttgagctgcttgaaatgctgttttaatatttggtttagaatatccatagctctttgtactaccccctctgcacataacacacagctttaaactttaaaaaaaaaaaagtaattggaatcttttccatggatttgtacctatccataaacatataagaccctgtttgatgtttgcttcactggaaacaaaactaaccagatgaagaattcctaagatcgaaatattctttcatgtatataattcactgaagtgtagagaaaaattgatattgttaggtcaatcaatgaacttaagggctttttttgcattttgttatgcttttggcatatggatcacaagtgactttatgcttctaaagaaattatgttggtctgtggtttttagtagtttgttgtaaagcatatttgaattttttttttattttgttagggcatatatcaaagcttgactttggagggggtggatagtcttgttgtagaacattcgtgtgtgtgtgtgtgtgtatgtatagccttcaacattttttagcttgaaattagttttgagggcattaaatatgatatcctgttccttagaaaatattaaaggctctctggttgacattagccatatgggaccaaatagaatctgtataatgttataactttataatttgatcaagacatttataaagtagatggcaatgaaataggaagaaacaagctaaaggtaaaaagaaatgagagagagagaggaagcatattaaatgctaaataatagaaagcacgtctgttctgaggttagaaaactgttcaattagttgtctagcaaggtttctgtaagcagtgcctctgcctcctcttatggccagacactttctgtagcattctgtttaatttgccatgtgtgcctgacataatgaagtttaaagaacatcatggggatgatagaagcctttgcatttctaatcttatgctgaagggcaattgatagaagcaactcatcaaagctttctttcaatcaaaacatcttgttttgattaagcacttcaggtttggtgcttcatttagggtgtgaagttttacagaaattgtttataattgtcactgagaaggctgctgaagagccattttctttccctgccccattcttcccactgaaatgaaacctggtgtatgaaaattttaattttaattatttatatttaattattttaattattatttaattgtttgaatgataaaagaattttcttgctttgcaaaaagattcctagcagtgtcttgaaaagcaggactttgagacctccttatttcatcttttctgaaatgtttggccagcatcttttggacatatgcctttaggatccacagttgtcactgtttcgggggctgaaattgctagaagtgttaggaggccctgcctgtgtctttccataagcagcagccttcacctgtcattgtcacagcaccccccaccgccttaagaactggacaacacctcaagaccacattcaccatgttacagctctgcttctgttccagttccattattctgttaattagtgtcaccatccccctcatcccccaggcttacatccttcatcattcctgatgcctacccttttctctttctcacaatctacgcccacagctgccaagtgataatgcttctgcccgcaaatcacctctaccattttccttcctttatcttggagagagagcatgctatcctgccaggatacagaaaagttgatttgaggtgggtctctggagccctgtgtttggaaggattctgaggccatatccaagcttgcgtaggaaatcgattagcaatgtctgtggtggcaaagaaatagaatcaccatatatgccacagatttgtggcaactggtgtcatgattgaagccttggattttgaattaaggagacctgggtttcacccttggctccaaaactttccaaccctttaactgtgggcaagtcagttaaccttactcggctttagtttccttatgagttcaatagggctcattggttaacttaaaatgcattgaatcaaattaaacctaactaatattaaatacttcctgtgcataaagcaaatctagatttgttgttgactatgataaagaacaaataacatacattacccttcaaagtgtggtaccaaacataaaccgttctattatgttcaatttcttctgccattgctctgacttaggctctcatcacttagttcccttcctcactattctccacacaaatgctccctcaaaaaaaaaaaatttgctctgcataataaagcaaggctttgatcatgccattccccaattcccaagctttctgtggaagtcgtggttggcagtgagtgagtcccctccttggtgttcagtatcttctggcagcatcctcaggacttccctgaagagaatgctgtagcaagcagcagctggtggggcctgaggagaaggatggaggacagcctggtggaggaggctgggccagggtctaagagaggaggcctgtaagagaacacgcaaagggagtgccaggagaatccccacttttaactaccaaacctctggctctgtcttctaaagttctaccctatttcctccccgcaaggccaccccacctccacatcctcatagtctgtctttttttttttttttttttttttttttgagacagagtctctcactctgtcacctaggctggagtgcagtggcacaatcccagctcgctgcaacctccatctcctgggttcaagcaattctcctgtctctgcctcccaagtaactgggactacaggcacctgccaccatacccagctaattttttttgtatttttagtagagattggatttcaccatgttggccaggctggtcttgaactcctgacctcaagtgatccacctgcattggcctcccaaagtgctgggattacaggcgtaagccaccatgcctggccaagtctgtcattttctacttatgtctcctctgttttatctttcagtttttatctccctatttgaatcataatatagaactgaagcatatttttgtaatctactgtttactgaattaattttatttcctctgttcttaattttataagtgagagagaacatttccttatttcttgtttctttctcactgtctcaacacctgccttaagaaaaaaaaatactttgttgagtctttcctttcgctgagtttaatttctccctgtggcataatagttctcatcataaagttccctgttcttattgagaatagtgacctctgcaagtgcccttcagttatgactccatgcacggaatttttatttccacattctataatccggcccttctcaacagaggggattttgtcccccaaggtacatttggcagtgtgtggagacatttttggttatcacagccgagggtgggaggtgatgctactggcatctggtggatagaggccagggaagccggggaaaaacatccttcaatgcacagctccccgaaacaaagaattatctagcccaatagtgcaaaggttgagaaacactgctgtaaagtagtgtaagcttgcgcaatgctcagacagagcacttggtgagtagtttttataaaatgtttatttaggcccagcatggtggctcatgcctgtacaaatcccaacacttttggaggctgaggctggcgaatcacttgaggccagaagttcaagatcagcctggccaacatagtgaaaccctatctctactaaaaatacaaaaaattagctgggtgtggtggtgcacgcctgtaatcccggctacttggaaggctgaggcacaagaattgcttgaacctgggaggcagaggttgcagtgagccaagatggtgccactgcactccagcctgggcaacagagcgagactctgtctcaaaaaaaaaaaaaaaagtttatttagttgaacctaaacctcttaaagctaaagaaatcagctttatactctctccctgattacatttgttttttggccatatgttgtattacccaaattatcaaggtatttctattacctatattcaataattccttctttctcatttattttaacttgacttaattcctgtaacatattcttctacagtttctgtgctaattaatgaagaaaatacttagtaaatatatttaataagataggtatgattttagagaaagctgtacatagatttggtttctttaatttatattgttaaatatatgttcattttttaacccatgaatacatctaaagtaaatttaatttagaaacagcgtgtattatagaatagcaagccatatcttttaccaatagcgttctttttgtcttcatttatatgtgccattttttcaaaattattattactctaaatatgcatttaattcccttcccaccttgtcatttcttataagcttccaaagttgtaagttatgggccaatgaccatagtttatgagtgataaattatgaagatagatttaacactgtacagtgttgtagtaaaaatgtgcacaagttaatctaacacttttttaatgatttacatattcatcactgtgctgcattgtaattagacatatggatagggtaagcagtcctgagaaattaccatgattagtattctttccacatggccaaatcacatttttataaggctttttttcttgcttgcttagttagttctctagttcttgtaatcagtgtcatggctgatagcctcccttgtatagtacaatgtacactttatgtacacttaattgtcttctttctctctctctctctctctcacacacacacacacacacacacacacacacttgtatttctcgttgacacatacttaaaatgaaaaacatgcaagctgctctctctctcatattattatcctggggcttgggaacattaagaataaggagatgattgggatcaatgacgctagcatctcacatttttatcttcattttgataatatggaattgaaatcattgttcttgtttgggaaaagatagggcataaactggaacccagaggtatccctcagtgtcagtcattgcatgctgtccccctataagcagagcatcattttctgcttatcacttaaggaatcaaaacacatgctaagggtggtggctcacgcctgtaattccagcactttgggaggctgaagagggcagatcacttgagcccgggagtttgagaccagcctgggcaacatagtgagactctgtctccacaagaaatacaaagttagctgggcatggtggcacctgcctatagttccagttacttgggaggctgaggtaggaggatcgcttgagcccaggaggcaaaggttgctgtgagccgagatcgtgccactgcactccatcctgggcgacagagcaggaccctgtctcaaaaagaaaaaaaaaagaaaaaacccaccatgttcaagagcacacaaacttaaagttgtaaccagactgtgacacataaaatggcagccatggtcacaccaaccaagagctgccatatgctttttactcattcatgcctgggtgaattttaaagtgataattcacaatttcctttaaatcaaccaggtggtactgaatttttttccttcaatgttgttgcaaatatgcctaaatggtgagatcgtagccaattttgattctcattatttacaaatgaaatctttatagtataagaaatgtttactgctgatgtttcctctcattcattagtaaaagcaagtttttcagacatttccatttaaatgcatacttgcaagacttcattaaatatctttccaagaacttggggtaatgagaagtatgtttggtttctttcctgtagcttttccgggaagactgggctaggacacttaagtgtttagctggcaattgaagagaagtcttactgcttactcttctaggataagacattcattgacattttttagttccaggaaataatcttgtacctgtaattgggacttatttagactttcttaggctttaagtgtgtgtttaaagtagactcttggaagcagtaatgggagggaatcaaagaaaaccaaactcaaaagaaagggattaacctaatcagccacatatgccctctgctattttagatcatatattttaaatccagataatttaatgttttcatatatgtttgaagacctacaatattaataatttatcctgttgctgatggagatggcctcttaattccaagtgaaatttaatttttataaacgcagagtttaagatgaaaaattaaaatgtttaagatacagcaaccctctaagtacgactatcaagtacagttttatcagtgacactctcctttatcaggtgtgtttgcttccattggattacctgaatcaagtttgctgttgttttcagttgcttttgtttttataagtggatgatttaaaatgtttatgctttgcttacatgagaaggtagacttgacctctacccaaccatcactaccaacaaaatcccccaactaatcataaaagtcaaatgatgtgctactttagaaatatgtctgtttctcatttttcttcctatggtttgataaacagcctttaatgggaaaagttctccaagaatatggcttatcatgactccacttgccatagcccaagcaacgttgtccaagaattccttctacatattggtttcttcaccccttggctatttatggagctcctaaaaagtcagatctctctgatccagccagtcttacctcacacctggttcccgccttccattcttgctatcatggctaggtccaggcactcctcacttccctagcacagcacaggcccctgtctggtttccttgcctgcaaccttgcactcctcagctccatcctccacattgcctcccagtgttctctctaaaaggcaaatcgttttagatcaagtcttacttattcttttaaaatattttgttgagtaaggagcctccttaccacccttctcccatcctctttaaatggtcccaaataccctacatcatctggtccttatctgccactccagaatcctcttgattcatcttctgttctaattcaatggcccgataatgaagaatggctggcagttctccttcccacactctctgttctgccttagacctctcctgccctggaccatgctgtcctgtagcctggggcacctgctcttctcttcacctagtttatctctgcacattctctaaggtgcaccgcaagtgttccctgtgctatgagcctccacactcacaaccctcaagatgggttaaatgtccgttttctgagcatctagagccccctccacacacctctgtcttctaccccagcatacttagcaccttatgttggaatgatctgagggtggagttgtctctccctcccctctaaaggtttacctgaggtagggactgcgtcctcttcatcttatcctgccaaggccgagtgcagaagagacacgagggaatgatttctctgtggagctttactggatgcctcaataagacgaactttgctgttttctttcaaagaaaaaaaaatctttacttttttttttctatatatcaagttctaacagcatattttaactttttttttttttttttttttgaggtggaattttgcttttgttgccccggctggggtgcaatggcgcaatctttgctcactgcgacctccggcttccgagttcaagcgattctcctgcttcagcctcccaagtagctgggattacaggcgcatgcaccatacccgtctaatttttgtatttttagtagtaacaggatttcaccatgttggtcaggctggtctcgaactcctgacctcaggtgatccaccctccttggcctcccaaagtgctaagattacaagtgtgagccactacgcctggcctaacagcatattttagagacctcacttacttttacttttctttgttgttctatatactgtctaagcaaagtctctctgaaaattgtgtgttctaacagcaaatcttaccaattttcttccttgtttgaaaataaatattcaaaatattactttccttttggggcatatatacgtttaacatctcatccttgaagttttcctgaataatgatgtcaaaacaaagcgccttacttgtattattctaagaatgtttggaggagaaaaatagcaatttttgttagagagagttttaggtttatgtgaactacaaaaaaaaaatcataaaaaaatcaatctggcgtttgtagaattttttaaaaatttgatattgttggtagtagatgtaatagttttttctattaaaaatttattcattttactttcactgaaaaatatattcattatactaaaagagcgtttactctcaactgtatagagtataggcaattactgttttgttttgtttttttttgctatagtatatgaacactgagttataaagaagatgactgtaaaatggttagtttttttataaaataggtgctttatttgtgttcctctctaaaatcttgtcataaaataatttatagagatagctacccacatgccataaatgcaaagacataattagccacttctgatatcacttacagaagacaatttactcagtccaagaagtgggaataagattagcgtgtgcatcatgtcatattgcactttaaaatagatacaatgtagaaaaatatacctacatgtaatttaaatgggaccagtctaaaactaaatgctgcccccaagaaccatgaagcatccagctactggtattcaattgttcatatttctaaaggtataataagaataattctgaatgaccaaaggaaactttaaaatccatccagtgaattttcatctaatttttttttttttttacctttcctgttagaaaaatacatattcagtgaccaggtgtggcggctcatgcctataatcccagcactttggcctctcccagcactttaagaggccaaggtgggagaatcgcttgagatcgttcgagactagcctgaacaacatggcaacattccacctctacaaaaaaattttgaaacttagctggatgtggtgctgcacacctatagtcacagctactggggaggctagaggattacttgagtcaaggagtttgaggttgcagtgagccatgatcacacaactgcattccagcctgggcaacagagctagaccctgtctcaaaaagaaaaaggaaagtgtgcatcaaagtctacttgaatatgattatctttgtaatcatgccccagtttggagtcagtcttttgttaatcatcattacagcagccaaatatttgaaaatagaggtcatggtcagtgagagtttggagatgaaatgctgccagaatctgagctcttgttcatcttctcttggtcctctctgctcctcgtgcctacacattaatggcgggctcaggagggaagaagactctcaacaaggaagagctgaagtgtctgtgtagcatggcacactgggctgttcactcccacccctccgctgagcaccttctggcgttgtcttccctgggcacctctgtgccttgtgtctttccacatgctgcttcctctttttcttgaggacactcttacacccctgcctctaggcactgctcaaagataagattgtgtagcagagcgaggtgcccagtgcatattagctttcctcccacctgttcccaggctggagtaatctccctcctctccactgcgagagcccttcctaggtagggtgccagttacaccctgggaatacacgcttgggctctggcgtcagactgcaccaagttcaagttctggcgcagatgccgtgtagctgtgtgcccctggataaattccttgccgtgctaagccttaagttcatctttaaaatggggctgcatttgcgcttagctcttagcattaaatagtaaggtcatgcatgttggggaagtacacgttgagtatccctgtccaaaatgcttggggccagaagtatttcagataccagggtttggttgttttttttttgtttgtttgtttgattttggaatatttgcatatacatgagatatcttagcgatgggacccaagtctaaatattaaattcatttatgtttcatgtacgctttatacatataagcttgaaggtgattttatattatttttatagtaattgtatgcatgatacaaagttcatgtatgttgtaccatcagaaagcaaaggtgtcactatctcagccaccccagtggatgatctgtggtgatttggcatcaccatcattactgactctgaatttataggctaccaataagcaatcattttcctgcacttattcacacataagtacttaacagtaaaaaatatgatacaccattaatacaggaaaaaaataatgtgtgcagattaactaagcagcacagcagcatcacagaatacctggatcagctgttaaacagcagcaacaacagacagtgcaggctttagtctccacttaccatgctgtgttttgattaaaaggtaggacactgtgcagtgactctcttggagacgctgaataacctgtgcaatgtacctgcattttgactgtgacctgtcacaggaggtcaggtgcagaatctttcacttgtggcatcatgtcagcactcaaaaagttttggattttgaagcatttcagattttggattttcaggtcagggatgctcaaccagtagtaagtgactggcacacaggaagtgctcaataaatggtagctattgatgactttgtcaaagttgttaatatggcttgcctttcttctttaaggatagaaacggcgttttattcttttttgtatgtcacacagtggatgttcaaaaaatatttgccaaggggataagttaatgaataaacttagaatggtgttgtgagccaacagcaggaatatttcaaatctttctgggaaagctgcttgccccttcacctctgctggactccttgccccgaacccagtacttcagaaccttaaaggaaactactcagatagggtagatgtctttggttttgtctcatttcttcattcaccgttcattgaacaattactacagggctccgcctatgtgtccaggcaccactgactatctgaaagcaaggtgccaaagtgtaaaaaacactgctgaaaacaaatcgatttgtgtttgtgtgctgtcatgtggagagcagagcccatcttttggtatatttcagcgatgcctctttcttcctctgggataccaagggctttccatttatgcttgcagccaagaaaagttttccagaatcatccaaggctatttaccttatgctgaaatatacaagtgaacaggtaaagatccagaggtgtttaacaggaggggctaccagacaatgttacatatagggaacagggaagtgagacctggttgaaggggaaacagcctgtgttaggtgactgtccctttatcatgggagagtgcaaggcgtggactaaaatcctttgctgactgtgaacttcttgagggattaaactatatactggaccatttctgagatcctctaaaatactcaatatattttgtttaattatctgatcactttctactggaaactaacatctaattcgcattttcctaagtctaaagtagagaaacacctcacaaatgtattagtaaattggatagaaaacattgacagtgtttcctgagttatgtgtgttaaagatgattccactaaattaaattacagacttttgctcatcagtgactcatttcggatttgtggaaagagaaaggcgacttaccttgactttgactcatacagtgggggttaataatgtagtgattaaggtaacagtcatcaaaagctgttgggaataatgcaataatgcctatacttttattctttgtgttatattttagtgaaagctcttaaatgattaaaatgtatgaagcaagcaaagtctaccaaggaataatcagtgcaggtgttcaaggagagagggtgaaacagactctctaagaaatagtgattgcataacacggtgtgtcacattcccctcagcaaggtgaggacacacaagagcataaaactgccctatgatatgactcagctggtacccaccaagataaatgccttgaatcattcaagactatttaccatatgctaaaatccacactgtagcatgttatgttatatagcatctgcattgcggtaagattatataatcccaggaatcagaagaatgacaaaaacatagaagggaaggggaaaacccccctccatctgccctgatctctaccctaaaggagagagtgaaagaatttgagaagggaaagaggacagctgagaataaacaaagagggaagggggcctcagacgatgaatccactgaaaaccaaatgtttctagagttccctaatgaagccgtttcctagccggtgcagacgatgctatgacagtgtggtgacaaagcacagcactttactttgcacatcactctactcaaaacacaccacaatttattttttatagcagctctattgagatatgattcacataccatacaattcacccacttaaagtgtacgattcgatggtttttagtacattcgcagaattgtgcagtcgtcaccacaatcaattttagaacattttcatcaccccagaaataaactccatatccattagcagtcctataattcatttttatccaaagagaaaaagaaacatcctatatttataaacctagacttacaatatagtcattttgttttacaaaagtaatgttataattggggataaaacatctatgacttgttataactcttacaaggaaatagtaacttgaaaggttgaaagtgttttaaaaattatagataatccagcttggctctctgtcaactgttttttttaaaaaaattataaaattcaacatttatgccattccttgagactagacttcactatacagtctacctaagtcatctgccttattggtcattttcaggacccataatgccacctacctaatgagaacattcattgaaaatactttgtgaccttttgtttaaatatcatattggatagtctccttacagtaattaatacccagagcatataaaagaacagattggccaatcagaatataaaacaattctatatgacaaaacactataaaaattaaaattaggagacaaagggaaagtgctgtttgtacaaaatgtgtcctacaaaagactacatttcataatatattgattggaatatttgctaatcaataaaggtgaaaaaaaaaaacagaaaaaaaagcagagggatattaacaggcaatttacaagagagaaagtccaaatggcttattaaatatatagaaaaagttttcaatttactaagtagtaaagaaaagtaaactaatacaacagggaaatcccatttttttctcaaacaggtaaggaaagtgttgtcaaagcgtggagaagctcagtctcataccaagttgatgagaaagaatagtgccagacagcatccatctgtcaaaattttaaagacacgtcagtctgccctcattgatccagcaactctgtctctagaaattttgtgcacaaatataccaaagtattttataaggtttactgcagtttatttgtaatcacaaaaatctagagggaaaaaagtaaaaactatcagtagagatctggctaagtaaattactatatatccatttaatggaatactatgctgtcattaataagaattaggccaacctaaataggccaatattgtaaattgtcaaatatagattgttaagtgcaaaaataaaatcaaagttatcaatattatgttttgtatcccatttttataccggaaaacacatacacacatatacatactggtatgcatatttttataatgcttatatattctctgaccttttaggacagaccagccaagaaattgttatctatagcgtattgaactaagagtgagaggaagtgggggagagagagtttttactttatcctcttatatattatttaaattaattctaagatattcaaatgttttaaaatgcaagaacatttttacatttaaaaaacaacacatatattatagaaaattggaaatgcaaaaaaagtaaaagcaatgccttgatctaagggaaacaaacactgttaaaatctgttcggatatcctttaaaaatgtttctttgcatacaatgtgcacactatactgttttataatctacattttttcactcataaacattccacatcactatatgttcttttacaatacatttcaagtaaatatgtcactgttaattacatggctatgatagtctgttagtgcattttctcttcatttcccttcataaataaattggaaggaaaatatttgggagaaagcagtaatcaaggtaataggagaggtttgtcaaaataaatgtcataaatgaggattgggcggtgactcagagacccaaaagctaagttcattctttaaaaataagatgtatcaccaaatcttaaggggggaaagaaaacgatgatggaatgaatcagaattacagaatgtcttctacatttctaacaaagttaacaaatagtcatttaaagaattaaaacaaaaatgaaaaaacaattaagaaatcattagctgactccaaacaaagacagagaaacaagtctgggtcctacactttaaaaagtggttgtccaggaaagacacagaagactgctgtgtgacacagcagggagagcccctaactcctaatttagggtgatttattgcttccttcttttaatatttttgcacattttgaatttttataatggcatataacgtatttacaaaaataataaatccattacaaaccctttctgatagattatttttaaagaaaaagagggaaattatgcatgaagggttgatattttctgtgtatgaacatgattttctcagtgaggcccagcagacctcaggagaatcctgctgttgctaagagaccatagtgttcaatagcttctctcttagctaaacgatgttttaggtttctgtaatttttatcaggtacagaatattccagagagaaagaagagaacaagattatctgttttctaaacacaaaagcatatatttttaaaattatataaatacatctctgctaatatttttggaaaggaaaaaaattctgccatgtgagattgagtgtctttaaacagggcttgacactttactctttgttttggaaataaaagggccaagtttgtcatagaaatacaagtttaccttgcagtttacataccattgcaattaatggggtaaatatttgaagatgataagtctagccaccaacagcaagttatctactgaaataattttgtgaattacttagccaacgataactgccttgtggattgcagtaatgactgatttgtttgatggctgagggccaaatgcaaatagagtatcatctgatttcaggcgtcttggccacaagtcaactgtaatgtctcccttctaaccagatccttttcattgaaagaccacaatccctccaaaagcctatatgctgtcatattagatggctgccttcgtataactacaatatttattagccttgaaatgctataacccagggacttacataagtactgcatggggaattcatttcaagccacatttgaccccttgttgtaaaggtgatcttcaaataggtttaagggaaataaatcaagttttcaacccaaagtctgctttctcctaataaaaaagaaaagagggtttagatgtttctaaccttttcttcttttcttcactttggaattgaagattaatcacatgtacccagagatgtaatttaatgtctgtcatttggaataggagggaaaatagataaattgttcatgaagagggtgctttaaaattaaacaatacaaccaaggattttattagacagttggtgggaaggatacttctcattaaaaggaaagtcaagtaattagagaacatgagaaacaggataataaatactagactttttggcaaaagtggggaaaaggaaatctgaagttttcagagtaggacacatagaattatccttgataattaactcactcttaaaaaatgtctgccttactttggatgaatgtgaaagaatataaaaataagaaattgtttagaaattgttggaatccaggagaactttttcattcgtaaattttcattgcatatgtatgtgtgaacatgctctccactgaagcctttttttttttttttttttttttttttttttttgagacaagatcttactatgctgtccaagcttgaattcctgggcacaagagatcctcccacctcagtctcctgagtagctgagactataggcgcatgccacagtgtctggcttgaaagcttctatttttattggtataactctgtccttaagaaaacaatctagctacatgacataggtgattaaattatgctcacaagatcagttcctagataattgtttgcctttggtttttcacagaataggaaactagaagttttgtttttgaaatgatacgaatggccatagaatttcccaaattcccgtttcttcatcagtctttcccacccagtctcttccttgaaagcaacttcctctaaggcagatgacaggagagggctgagcagcaagtgcagcctcccttgggaattgtgagcaaccagatcacgcagccagaaatccagagaacaggacagcaggtcacttatatgatggcagatatgttggctggttgtgaacggctttaaggggttccaccttgtacttaaagacccactggagctgcttaaatatgcaagtccagcctaacactgagatgttcaccaagagtgtccatttctacttgattcagacattttcaggtgttctaacctcacctccctgcccactcaaacaggtcacctgtggcacttagatcacctgtaatttccccaagcaatttactaacatgtagcatcgttagcaagtatatcacttacgtgactgacaactgtaggtagctggatttatctatgaagacagagtctcattttgccaaaaatagaagcaacgcagaactatttcgtctttccagttggattccaagctaacatttagggcagttgggattcagctaaaaacacagttgctttctcagcagagtagagaatgactgaaagaggagtggccatggggaagcttagaatctactgaagctcctagcaagtgtagtttctagaaatttaccttttagtcatattgaacctgtgagatttttgtctccaggttttctaaatgttttatcctatttaatctttaagtgaaataacctaactttctgttttctctggagcagtgaaaatgtcaggaaaacgactgacagactccacaaaagctgtcctaacatgtgggtgttgtctggttcatgtactgagttatgataaaaaggaaagaatttattttatccctgtttcctgagttctctcatgctgctttcttcaacgagcagcctagaaacccataggcataactgagtcaccagaaactaattcatatgcagcacttaattgaatttctccggtggatctcacatgtggcactcttccgaacacttttagaaaagtggcattgcttgtgcaacatcggggggagctttttctaacatcctttgcttctttagggtagatatttctgcaatctcccaagaagtcattaattctaaagcctgccaatatttagagcagtatctaaaccattgcccagaaacacgattggctgccgtatttttaagtagccccttggaaagaaatgaaagttttcttaagaacctattcgccgggcatggtgtcttactcttataatcccagcactttgggaggctgaggcgggcagatcacgaggtcaggagatcaagaccattctggctaacacagtgaaaccccgtctctactaaaaatacaaaaaattagccaggcatggtggcatgtgcctgtagtcccagctactcaggaggctgaggcaggagaatcgcttgaacccgggaggcagaggttgcagtgagccgagattgcaccactgcactccagcctgggtgacagagcgagactccgtctcaaaaaaaaaaaaaaaaaaaaaaggaacctattcagcctttatctagcagctttccctgctgtctaagagaacttctgctactataattttacatctctcctctaggcagtactattattttaggtacagaacatcaccatcactatagtaatcatttattattgaaaagcaatcaaaagtattcccaaagttttatttcttcagaccacacaatcattattttatcattacttttgcatggtaaggccctgatcattttcatttttagatgacaaatcagcaacctgagttatatataaaaatatgaatttgaaggttttagggtatgcctaatttaatgcctgatttttgtgtgtgttctgccaaacacacatttgtgctacccatcaattccctgaaacagctaagtttcctggcctctgtgattgtgcttatttcttgaaagtaaaacctcttgattaaattctatcccagtgagactttgctcaggagtatgtttacatcactcttcttcagtattacttgatcccctttcaaataagcacagagcttcagcctgtcatttattatgacattctgattactttgtttacacaacaatctgaatgttttgttcccggccttacagttagagtttttgttcttggtttcccacttgaatttttatttgtttatttatttatttttgttctagtatagtctgaagggagaattttttttttgttgtccctaagatgacagtgcaggctctgagatgattttgattggagaaataatcttcccaagtcttgtcttacctcatttacccaaagtggattcaggttggaggtctttctcaggaaaaggcttggctgacttctagccaaacacagatacctcattcctggtggacaatctctgttcccgatcaagcttgatgcccacctcacagaacacctggacaagggtatgtgcctttctggaagcttcctttatataggagcccctccttctaccaagagcctggtcctgttttcgctgacctggtgatgacctgaacaaggcaggctcatcttgcaaggtgctagagaatgtccctagccaaagtgacccaaggtattgggcagcacagaggctgtggctttgttttaatggaataagaatggaccctattataatctaaactatgacgaatcatcatccaaaacagtacccttaccttctgtgaatgacacacctggagttcttgactatcatctctgtgtggtccccagaaactccaaccatttccactttctcagggagccgcctccagaccacttgacctcaacccactggggcatgtgctagagtaggttgagtattggaccaccaaaccgaaatgcatgcttatccttgcttttctgcatgactgggataaagtcaggcttaaaggagccgtacccaaggagacagtgatcaaattttatttcagttcacattgttatgctctttttattgttgttagttccttttgttcccttttcttttctcttggaggaattcttattcattttctagctctccattcttgagtaatttatctatttcttgtttcttatctagctttcagatcctccccgtcttgtagctaattaaagccaggtggtcatgagctgacaatatatatgaactcttgttccactttcaaagtctgctttcaactgggtctcaggataatagttggttgtttttgcaaatttgagttgggataaaaactgaaggaggacagatatttgctgtttttttcaagaccagtttgtcttgctaatttatctcctcatgcttttagtttagtcttttttttttccaagtggcacattgcacaattacttcaaaccctgaacctctggatttcccttggtaattttcttatcaatccacaggagaatggcaagagctgtctggtctgtggatccacaccattgggatcacatgggtttttaatttttttaagtgccccaggttctacctccaatgagtctaatatagtaggttcagggaagggcagggaatctgcatttttaaagagctgggaagtctgtcctttatcctagaggaagactgtaggcctttctagactcttggtctctcctgcactttggcacatgaagccactgcactgtgcaaggctgtcagcaggactcactcgtcagtacatacacaaggagcatatgagctgggattgcatgtctacctgcccctatgcaatccatcctcaagctttgcgaactctatctcctcatcatctccaagtcattgttttctatccgtttctatcacctccatcctaggccatgccaccatcctttctcacccagaataaccactttgcaatgtttcctctacacgccagccagagttcccttttagactcacaaatcagaccataccactgctgtcttagtccatttatgttgctataaaggaatacttgaggctgggtaatttataaagaaaaaagtttacttggatcacagttctgcagactacacaagaagcatgacaccagcatttgcatctgctgagggcctcaagctacttccactcatggtggaaggggaaggggagctggtatgtgcagagatcacatggagagaggaggcaagggagaagggaaggtgccaggctctttttaacaactagatgttgggagaactcttgctggaactaacagagcgagaacacactcattacctcatggatggcaccaagacattctcgagggatccattcccatgacccagtcacctcccattaggccccgcctcccacatgggggatcagatttcaacatgaggtttggaggtcaaatatctaaactacaacaactgcccttgcttaaacccctcctaacttctcatcttgcttagagtaaaacccaagcccctcacttggttgtttcaatcttgacttaatctggtgcctgctttcctctgtttccttcagtgtatccacggctgacttcttcctgtgttcagagctcagcttcaacgtcatcaacaccaagagaccttctctgaccaccaatatagagaaaccactcactcagccactcgctgtcacatcacccttttaattcttggcaaagttcttataaactcagctcttgttcttgtttttgtttgtttaaggctcatttcctccgctggagtataaattccacaaaagcagagaccctgtcaactgatacactacagtatcccggcacgtaaaacagcagagactcagtaaatatttgcaaaatgtatgaatttaagttgagtgtggaggtatgaacagaacgttaaccaggcaaggtggcagtattggggaattgttccttttgcagggaaataaatattccaatgcccagaggcaggaggttacttagtgcagttaagaaactaaaataatgcacccaaagaaaagggagacagaaagctgaagtagggaggggccttacaggctactctaaggatattctcgaagagcaacaaagagtcctagaagggttctaagcagtggagcaacaatagatttcctgataaaaatgctcaagagaggctggtatcaaagtgatgtcatacatattgtagcaggctaaatagtagtcactgaaaggtttcaatgtgtaaatgtgaccttatttggaaaaaggtctctacaggtttaattaagttaagggtcttgagatgaggggattatcttgggttattctggtgggaaccaaaatcctatcacaaatgtccacctaagaaagaggtcaaggaaataacacagacacacagagaagtccatgtaaagatggaggcagagatttgagtaatgtggccacaagctaaggaatgcctggagtcaccagaaactataagcgacaaggaacggattccattctagagcttttggagagactccagacctgccaacaccttgatttcagacttctggcctctagaattgtgagcaaatatattttggtcattttaagccatgaagtttgttgtaatttgttatggcaactaaagcatacactttggaaaaaagataaagagaaatcaaaattcagatgtgcaccattatgcacatgagtccatccaatgagtgtaggcccagcgttagcatgagattggagatgttcacctgctgtttccacagtcaaccttctttcccttgtgaactgttatcatgattctagaagataaaggtgggcctatttcacacgacatgcccctcaactgaagttagctgctttgttttatggtcagctcaagaaatggtgtctatccaagtgccagaggacagactggcagggagacagggtggcactctccaaggtgtcacaaggaataaatgtggccacaaggaactggatgtatgagtaacagaaagagaaatgtaccgagccatagtgccaagtgctgcagtcagctaagggagagccatgtgtgctgtgcaaatcagtgaagaccaaccaaatgagaacaaactaaggctatttattcagagcttgctatagcaaggagtcagccaacatcatctgcattttggcagggactcaaaggcaggcagaggagtaggagtgctttagagaagaaaaaaagggaaggctttccctgcaccctgatggaagcagttggtatggggaagatgtaggcaagctaaccagaagtggggcactctacgggattggttagaggcgcacatttcaccctttctagttggtgctaagttggaagtgcaaacaaaaattagggatgctgtcacttattaagtcctggctaatttaaggtcaattgttacaagggttattgtttggcttcctggaatgttactagagctagaccattgtaatttgttattgatttttctgcaagtctgacttagagtgtgctaccttctggtaggctgtcatagaaagggggtttttccccggcatgttgctgcaggtcgtgagccagagttgtgttttgttatatggtctggccattgttcatctgtatattcagtctctcaaggtgatcagacatcagtaaagactaagagggcattgtatttcggctgaacaatgtggaacatatgacatgtgggagaacaggcccttggcatctttgatttattcaaatctctcactgaagacacatgggttttttatgagaagaagctcagagccagccaaagtggagcttctcaattttaataactgctttactttcaaaaaggtcaagatttggtgaagcttcactggccaatgaaaaggcagcagaccctgagcaaagcccagctgggaacccatggcagagaaaaaacagatgccttctgggacacgttttaatgccaatgaggttgggttcttatggggaaagcaaatgtaccaactacacttgcatttaggattcagaaagataagaccccaactgcaaatcagcaaaaggggtacatgtttgtgtttttgaggcaatactgccaggcttaatgactaaggttgaaaatccccacatctcaataggtaagaaaagcataatctcttgcatcgtacttgcattcaatccaaaatagtgaggaacaccattttggagttgtttccaaagggtcattgtaggggtcaagtggtacctggaagggaaagaaccttacctagagggcagcctgatcacgggccatgcttgtggcccttctgcaacactcgggttcgcacacagcaatgtggaagtctctttctctaacctctgccccatgacattctttatcctccagactctcagctaagaaaccaagaccccatgttcccatattctcaggatggttaagcaatgggtactaatccaattttaacagactattggaagaccttcagcattgtcagttgcatcaactacactacagtgtaaagcccgaaactcagtttatgtctgccagacctgcagaaagagtatacgaatgcattgtttagagactcaagcaggtggttggtgacggtttcattaacagcgtggaggaagaatgtaagagttaattgagggcccctctgggaaacattgcctaatgaagacattggcagtggttctctaccaggggtaatatgccctcagaggacatttgggaatgtgtggggacgtttttggtcacataactagggaagctactggcatctagtggcactggcatctagtgggtgaggccaaggacaccactagcaactggcacaaaaaagtgcaaatgacatgtgggaaaaaggaaagatcagtattcatttcaggaaattaagttctggtagaacaaggaacagatcagcttttcatgcccggtgtctgcaaaccttcctctttttctgctttcccccggggttgaaactcagacaaggcaacataaaccaactgggacccttgtggatgagaacactcaggtttgacagagataagatagtaggaacttgggttaccaagcaatctcccggagctaaaccgcctatccctcaggacacctgcagacctctgcactgttatgtaggaaaagatgaacttttctcttatgtgactgttagggaaaaggaaagggtttggaaaggagaatcattcatactatcagaacagtagatctgagctgtgactcttgagatgttaatacagaaaatcccagtgccataaagccttctgcagatgttacataaggtttctgctcccagcagtgcctctagagccccgtgcaggtggaggaacacgtgggcgccatctggagcactgagctgggtgttctggaagttgtggtggaccagtggaagtgctggtttaaacatacctccctgtatttttagaaggtacttttaaaatcttagtttccgggactttactctccagttaagttactccagctgatgcctttgtctccaattcagtctgtcccatgccttctttttcacttttgtgttttatatattttttaatttttggcccggtgtggtggccatgcctataatcccagcactttgggaggccaaggtgggcagatcacctaaggtcaggagttcgagcccagcctggccaacatggtgaaaccccatctctactaataatacaaaaatcagctgggcatggcagtgtgtgcctgtaatcccagaggctcaggaggctgaggcaggagaatcacctgaacctgggaggcagaggttgcagtgagccaagattgtgccactgtactctggcctgggcgacagaacaagactatctcaaaaaaaaaaatgtaatttttatggttacatagtaagtgtatgtatttatggagtacatgagatattttgatacaggcatataatgcataataatcacatcagggtaaatggggtatccatcacctcaaacatttattccaattatactctattagttatttttaagtatacaattaaattattcttcattgtagtcaccctgttgtgctatcaaatactagatcttattcattttttctaattattttttgtacccattaaccatccccatttcccccccactgcaatgctttgtttttaaaagctgtattttagagtgttttgatcttgattgcttttattccagacgtgctgcgtgtggagcttggggaagcagcagttatttcaaaccccacaggcagtaggatgggagtcttaccatggtgtcagggttcactcagaaaacgggtggagtagaagaaaccagatgggcctcagttcttactagatgcaggcccatcctttcctcaagaagcctacatgtggattttcctgtaatgctgctgcgaagtatgaaaatcataacatttctatagaaagtaaattttagttgtccattataccaggatggctttgttcagctcaaccaggcagacaagctggagactgaggatggagactgagattcaaaaccatgaggcaggaggtggtgaatctcccaggcactgggggtgctcagaaggaagctggaccaccacttagttggaatggagacaggaggagagaatattcctgagttaaggagagagttgactcattaaccattgacagccttgatattctaggagggcgcctcccaaggggagggaagtgaacatgtaggggcaacttactggagaattggagaatcagaattgcaagttctttttgtcattgactttgtgccatttttataaaatgcctctggaactgaatgtgcttcctcactctcttttgcatatagcaacagagaggaatattattccttttacaggctttgtacctttgccaaattaagaggaagcttgcctttgtaatcagggtatggtagaaagcacaaagcatctactgcttatgatggtttcttctagatgaacttgtccatttcctgaacaattcagaaaactgaatttagagttgagatatattaagaggcctctgcctaagagtgcttttatgctggttggtttcaaaaaagagactagaaaagtaaaaccatttcttgttcaaagagtattccctagccaacatgcagcatgtcaccaaggctgtctagacactcaagggacttcacctatgccttgttcaagattctccagaaggtctaagtaggcccctttgaatgcatgatcactatgtgagctcaggtgagccactggtgtctttggtggaattctgcaaccgtttctattcttcagcaccttctataacacttcagcctacctaccaactgtttctgagtggggggaggatctttctaagtggaggttctcctgccaccgggaatgtggccaaagaatatgttccacctcctccttatacatcaccatctgggctgtctctctaaatctgtccatcaaagaatgcccatttcaggagttcatgtcctgggtgaaggtgagaaacatttaacttctataaatccccaaaacatttgtatagatcgtgtggggaatgatacttttcacctcagatgaatgtagggactaaatagagcagagatttaattcaatgttgcttacttgcttgcctgctgtgggaggttcagtcatcagagaaccagttcatgagtttggtctgatttcctgtcctttgggtaggctgcaatctttaggagcaagagaaattaccatctgttagcttccttcaagtggcttacctacagtccttcggtgtcatctttcttaaggagagtctgggtcatccagtttctccaccaccaaaggaaatacagtcctcttagagaattggtcagtgaaatataggggtgccaagaaacatcagagtaaagaagtgatggcccccaaaggcaaatgcccccatgtgagagggggaatggaaggcactgctttcttccttgcctgaggctatgaaaatgtcctttgtgtcaacaaaaaggttttctacattactggccatttaggtcatattattcacaatgtttcaaaattgtggttatcagctgatgtagattttggcattctctctgaagccatgcagcatttgttcctcactgcattttcaccattataaaatacaattcctatttaaattaattaaaacatggaaaatctaaactttatttggaaagatggttggagtttttgtttttgttttttataatttacggcttggcactgcaatattcttcagctggatttatgttgacccattttagaaaacgtagttactataaatctgttgttgttgtttctgtttttgttattcaacccaagcctttggaattattctaatccacaatatgactcatgaagtatcactcttatccttaaggcaagtggtccaagagttgaaatatttgtaattatctttcagactccatgatcctccaagctattacttcattataactccatttctgaaagacagtttgtttctctttttttctgatatactaaacatttgatagacaggtagctttcatatcttgaatttcttatttaatgttgatatgagaacagttgcttgcagttcttcccctgatgcaccatcacccatttgtctgcccctgaccatggacaccgatagacatttcccaggctttcgtcaccatggaacagcttgcttaggccacagcatcagatactgggggtagtgaggaagccaccaacccaagagagttgggttctgatgcaagtcatttcatctctctgagactcagttttcttgggtgtacaatgagagtttgggttagttcagtgaataccaagagttcacacaagtagtaacaggatcagcagcaatttgggccgatatttatcgagcagctacttcatgctttttaatatggcagggactagttagtatccaatggagtatgggagtggggagacggactaataaatgaataattctgactgattaataatatggtgagaactcagttcaggagaagcaagggaagctttggaagcatgataagaggccacaagtttttccaatatttcaaaaacttaatgaaatacctacatttcttctgataagaagagctgcctcacagaaataccaagtttctttttggtacttggaaaagtgtcaactgagtgtggtaagattggttctattatggtgtcctggattgctggttggtagttatagccacagctagcaactctggcacctgtgccaaacagcatgccatgaaccctaaaaccaacttttaaattcacattgtggatcacagatggatattatgaacaatgtgtaccatctgttagctttctatcttaactattcattcttgctaactagatgctgagcttttaaaatcattgttttaaatttatgtgacctctgaatgttcataacctgggacaaaaagttctggtcatctgccctcatgatcatcttgatttttatttaaaatgagaaaattgaatgttacttaacaacaatgtgttgcataaactaacatttttcaaacatgaggtccatgaaataaaaattagcaaaaagaggcctcactggtgaaaagactctatgcaccattaccagatggtaaaggttttgagttccaaaactttgtattgttctccatcatgcctgcagctctcgatgcttggcacgtagtggccacgtgataaaaatgtacgaggaagcatgccaatgggccggcgacattgtggcattccagtttggttgctagtgtacttccaaaaggctaggcagaggccaaagctaggacaaactccaggatgtgttgtcagttgcatggtcagagccatgagctaatctgagatctccttggcacgttccaaagctctgttttgcgaatcaaaatctccacggacaccttgggcgttattgtcccatgggaacggtcctggttttcctattgtattttctgacgttgttaatgttgtttcttggttactcctatcttttaatttttgtcaatattcctgtatgtatagatttttttcttttttttaaaaaacagaaatatcttgcagggtcactgggcaggccagaacagtgacagtggcccaagtaactgttggggaagactgggcaggctctgtaatgccttgattcatttctctttgctttgggctatgaaaacaagtggaggaagaagaaatatcacaaggcagaatttgcttcctcttcttttttaatattccctcttcttttcccccatttcaattcatgagactctctaggacacactctcctccatgacttatctcctgtttgtagtcttataacatctgtatttcatataaactcacatcttttcttactaaacaatttaaactactttgttagtttagatgttagaaaaaaataggaaacgatgtttatataaagcaattcagaatatataagagagagaaacatgttttgaatttagaaaattagaaattgcgtggatagggaagaaaaattttgaagtcaggcatcagaatgagatctggaatgattatgagttctttgttactaaagcgtaaaatgggatttaaaatatataatggaaaagttaaagtagtttaatttaaaactactatactaaaaaggttcaccacatttgaaaagctaacatatttcaacaactacctacaatgataaatatttataacatgatagactaagtgttaaactttcatatagaatgcactcttacaaaccaataagagaaagtaggacataaataagtaattgcaaaagaagaaatccaaatggctaatatgcgtgtgggaaaaatgtacaactttactggcaatcaaaccaattcagatttcaagaaaggaaatccaatatttgtttagaaattggcaaagattttttgaaaatgtaatacctaacctcagtgagggacccagcaaatgaccactcattgtctataaaagtacaatttgaggccgggcatggtggctcacacctgtaatcccagcactttgggaggctgaggtgggtggatcatttgaggtcaggagtttgaaaccagcctggccaacatgatgaaaccccacctctactaaaaatacaaaaattagccaggcatggtggtgggcaccctgtagtcccagctacttgggaggctgaggcaggagaatctcttgaactcgggaggtggaggttgcagtgacccgagatcacgccactgcactccagcctgggcaacaagagcgagactctgtcttgaggggaaaaaaaaaagtacaatttgttggactttctggagggcatcattcagagcttttaagaagttctctttgaactcaccaaatccactttgttcagcaaattttttaattttaatttttttatttttatttatttatgtttttgggatcttggctcactgcagcctctgccttccagattcaagtgattctcctgccttagcctcccgagtagctgggattactggcgcccaccaccatacccggctaatttttgtatttttagtagaggcagggtttcaccatgttggcccggcttgtctctaaaattttttatttaagttggaaaatataaagaagaaattagaatataaggagtgacctgactttctatcaataggggaatgattgaataagttgtgatataaacatattacaaaatatgatgcagggtttagaaaaacagttttgattgctatgggttgaccaagaaagatgattataatatataagtatggaaaatgtataaaatatgtcgctatcttgccatttttataaaaagcaaacaaaaacctggctatgtatatatgtgtttatataagcttagaaaagctatggtaaggtccttacactattaaaaatgttagtgatattgaaggggaaagaacaatatcacaaaggtagtgatattgaaggggaaagaacaaatagctattgctattttttaaattttgaatttataattttttaaaaagaaaagggtcggtaaatatttttgagcacccacagtgtgcccttggtttctggctactagaaactaaatgtcaagtgccagggactaaatctgtcctaagggagtgataggataactgcacactcatttacaaaggtgtcattgagtaattatttataacagtgaaatactgaaagcaagttagatattcaatagttggaattcggttaagtaaattatggtattccatgcagtcagatgctcaacagccattaaataacagagtgaaaatgctcacaagatactgtattgtgaaaagggttggtaacagatcaacacatatgaacaaatcctaatgctgaaatatataaatgcatagacaaaaattctagaagtttctatacccccctccaaaaataaagtatcatttgatcatgggttattgggggtgttttaaaatatgccttatatttttccatctacagtgaacattgattatccttacaagcatatatttttttgttaattattagaagcagtttcttaagaacaagatatgtgggtttgtacagcatcataattggtcaagggagctcactaagagagaaatagaaaactctctgccatttaagatgttcagcattgaatataatggacatgaacactgagaatttaaatctaatgaaagtgaagttgtttcttatcctcaagccacaaaccatttcacagacacagtataaaatctgtggcagcttcatgtggtggcacaggctggcaggatgcccttgcagcagggaaataccacctcttcaccagttttacctcttccaagcaaatgctgtcatctcccacatatcataaagacccacaactatctccgtgaggacccatggcaataaacttggtcctgttgtggtgggcggaatcttccaccaccacatttcttggtttatgaggttgacctttcttctaacattttccttggaagcaacaacagtttatcccaagagacccacatatacagataactcaaggagtgagtagagagaaacccaacaaaacacctctttattagcctatatcactcccaatctagccaaaatattattgtaaggagtgtaacctagggggattgaagtattatttacttccatgtctaagaagcccaccctgtccttcctctttgttttcttggtttcattgacatagacaagaacccagctggtgggaagtagatgtgactgaggatggtcatatatttctacttccaggtttattgtgcattttgagttggtgtgtgtgtgccattaccccataatgatgtgtggtttttgttctttccccagaatgtcgagtggtaaagtccacttcttacaccaaaatagcttcatcatcccgcaggagcaccaccaagagcccaggaccgtccaggcgtagcaagtcccctgcctccaccagctcaggtaaagcagcagaggggattttgaagaaattgccttgttcctgacacaggatgagcagagggtgtgtgaagcctagagtgtgaggtttttaagcgagtgtaggttccggtttataattttagaacatcttagagcggttgaacagatttgctggagtctagcatattggctgcaagaaaaagcattgagcttcaaaaaatgtacttagtgaggactcaggaaacccagatttgcccacaaatagaagaacgttatcatcttgtatcctttctaccaccaaagttaatctttcagattctggaagtctctgttaaagcatttattctacctgagactggcctatgaagagtttcccatttgtattcgctgaacctttattaaacacacttttggctctggcctcagtttcctttcatggctctggagctaaaggtagtgagattgagagggtggagcagggattgctgcagtgaccttggcctgagcctgtctctcagtggattctagtgctggtgttggagaggctgtgtatgcacaagatgagcacctcaaccctaccttctcctttttggtcttaaaactgacatgaagtcagttagaaagtgtcttctttgtttgtctcaggtgaagggtctctattgttattaaagggaattatttattaaatgacacaaattgtattgggaattattaaacgatgcaaatgtcaaagtgattgttacctgatttcatgaagacaagaagctcttataaataagaataaagacctctggggcctacttgggggccttcttttactcaacagcatgggctagggggagtgtgaaaagagctctcggctgaggctgcctaagaaggaactctcaatagggtggatcattataggtcaggggccagctagaccacccagccctccttgattctctaagagtctccttccccttggagttttaccaattactgctattctctagacagatctccaaagaccaccttcccctctgactctcaacctagggtggcatcaatgggctgccaatgcctccttcccacagcatggcctgcatcatagccagtcaggaaatacgtttcagagcatcgctggcacttgagatgcatcttgtttgcctctgtagtttaaaggtgagctgagaactcctcccttagtatgacactgctcatgtagataggatagagccctaaaatgaggcattgctaaaggatgagacagtagactcaaagcttagagctcatgagagtcacttgggaacttggcaaagtttgtcatcctgaacccccacaccctgagattctgactaaggacctaaacctgtgtttcagcaagtactccaggtgattaggatcgggtagtctgtggtccacattttgagaaacagtaggtgagggcagtggttctcaaactagcagcatcaccatcacctgagcacttgttagaactacaaagccctgagctccctctccagaaccactgaatcagaaactctggagctagagcccagcaaattggaatttcccaagccctccagctgattccaatgcacactttgagaagcagggggttttggaaaacagaaaggaagtaaatgcagaaaacatttgactctggataatctggagggaaagatatgacttgttcatcttcatttactggcatgacagagatgacttcctttctacctccctgtttgcctccaagtagcaatgtccatcagtgtccttgcaatccaagagcagaccttttagataccttgatgtgtagaccaaaagagcaatgaacaaaggagagtaccagatgccaacttccttttctccctccttgcaatgacctggcctcagagagtcagtcacctgggagaaaagagaatttctttctgaagatgatcccttccccaggatgtcagggaaagtctctcccttcaagggagataccacccacacacagagaagaggacctccacagaatgacagagtgatcctggaattgctgcatggaaaactcccctggaagaactgagcttgtccagctgacaggttaatattgagctctgtggaggatgttcagtcttaactaaaaaacatttctcactttctctgattaaatctgggctataggcccgggcctggtggctcatacctgtaatcccagaactttgggaggttgatgggggtggatcacttgaggtcaggagtttgagaccagcctggccaatgtagtgaaaccccatctctactaaaaatacaaaaattagccaggcatggtggtgggtgcctgtaatcctagctactcaggaggctgaggcaggagaatcgcttgaaccttgaggggcagaggttgcagtgagcagaaatcacgccactgcactccagcctggatgacagagcaagacactgtctcaaaacaaataataaagaaataaataaatctgggctatagggtgaactcccatggagcaataaaggagaacaaagtcataagcctagccagcttattgcccctaaaattttggctacttaatgcaatcacagaaggatgtgaaagagaatgagagcctatattaatgaaaccgtatcaattagtatattaatgaattaatgaatagtatcaatactattaaaaatcatcaatattaaaaaacaaaattagttctccatccaaaccaactttgacttaaattttacttaacctttcctatcttcttcctctcagtatataagatgaataaaaaaacaagtgtggggcagatgcatctaataatgggtaattagccaaattcttatgtgttttatattacagatattccaagaaaatcaatatgcactgcagcttttaactttttattgtcattgtttttagcagttttgttgttaagagctgtaggttgggccaggtgcggtggctcacgcctgtaatcccagcactttgggaggctgaggcaggcggatcatgaggtcaggagatcgagaccatcctggctaacacagtgaaacctgtctctactaaaaatacaaaaaattagccgggcgtggtggcaggcgcctgtagtcccagctactcgggaggctgaggcaggagaatggcgtgaacccgggaggtggagcttgcagtgagcggagatggtgccactgcactccagcctgggcaacagagcaagactccatctcaaaaaaaaaaaaaaaaaagagctgtaggttgttagatactctagatactccagggtttagggtctttctttttctctttctttctttctttctttctttctttctttctttctttctttctttctttctttttctttctttctctctttctctctctctctccctctctctttctttctttctttctttcttctccctttaagtcaataaagatggggaatggatcagattcttgcgtacatgttaaagaatggactgatgagtctaatcttaaaaatataattatgcatataggcaataatttcattttataattaactggtaatgtaatcactattcagcattgtaagaatttatattcatttctgaaaagtaattttggaaactcaagaagataggcgaatatattaaatgtacttgtatgtcactgccaacatttgtaattattccttttagaagtttaaaatgggtaggacacattgcctcaaaatcaacaggttgctccaaacaagcatttccacattctattttttccttgaagtccttttcaactctagttgaaacctggttgaattgaccagcactaacttggaatttgtgataggtaagtcataccaagtagtatcattttcataaagaaagtagagtccaaattcattctaaaattaatatgttcttgaaaaattagcactttaacttctaggtcaaagttaattatataacactgatcatattttgtttaatgtgagctttttgtgtatataaaattttcaacttgctgcattttgacctggaagagataacatgcaatcattttctgattatataagagattactatatgcactgactatctcttgattctgacttgctaccaaaagtgacttgttaccactttcctttggatggtaccaatttagagagtttcacagggcagtcaactcccagtcacaaatgtgtggattgtgccagtgacctcaggaccacctcctttccctggaaccgggcccagaggttaaggaattcggcagtgttgccagttctcctagaggcaagtgtagctgctggatgtcagggaaacccctctctcagggcccctccactgctctggcccaggtctcctgtccctactcaactatagctcttggaactagtggaaaggcacgttgaattgtctctatatggattacatcacattttcttaaaatagcctgtttagtgtttttcattaatcatatggactcaaacatgaattttacttaaatactccataaacattggtattgccccaaacccaactaccacctgattttttaatgttaaagcatctttagactgggtgtggtggctcatgcctgtaatcccagcactttgggaggccaaggcaggctggtgaaacctggtctctaaaaaaaaaaaaaaaaatacaaaaattagcctggaatgatggttgctttgtttcctgtggtcccagctatacaggatggcttgacactgggaggcagaggttgcagtgagtcgagattgcacaactgcactccagcctggatgactgagtgagaccctgtctcaaaaaaaaaaaaaaaagagtctttgttttcccccaaaacattaacccaaagtttataatgatttctacttcagtgtttaaatttctacttccagtattcagtttcctatattatacagaaattggagcgtattataaagttaagatctgcacaattttcgggctatgctgctatgaatataacatggttaacttatatttacctgaaacattatagtttacatacggcttttatttcttcaatcttttttgatcctcctattaatttcctaacagcaggcaagtaaggcaagttattattatctctgtttgtagaaataaggacacagaggcagggctgggataactgctttgctctgagtcccagagttcagaatggcaactcggggctggcaccggggacttctggtactctagacacacaaggctggcagtccttgatacctatttcttcacctccacttactagagttttgatctccaggaaacaattaatctagtgcctaatttgagattgcaattcacagcatcacagcaccttgcaacataagcctaagtattagtcccttggcaccagcgttccaggaggtgaatgatttaccccaacttcctgatgtatagtattgctggacagaaacctcccttgtaagtcagcattagaacaagaatgggaatcctctgtaagtcttccctttgtcccttacccatttctcttcatagcactaaaagaggttcaaagtgatttattaatgttaggtgttcatttacactttcagaactatcagttacagaccaactagtgtcaggcatttgctaggcactaatgatgcagagatgaaagaaagcccctattctcaagaagcataggagtcaaggcctcacagataacatgattcacatacctgttgaattatgattagtctccataacagaaaaggctgaaagaaggcaaacagagctagcaaagagaaaccagaagccttaataacacatgaaaagagtaaagagcctccagacaaattgcgtgctgagacactggaggatgaatcactaagaaattggaaaatgacttctagctgcttcttaaagaaatgagaatctgtaagagcatcataaggaataaggagtttcatatgggtttgattcttcatacatgtgtatatatttggaacacagatctagtaaaatgtataagttaaaagtaaaattcattaattttatttttgagacagggtctcactctgtcacccaagttggagtgcagtggcaaaagtaaaattcttttaagcaattttttttatctacacagggaaattataataaaataactctaaaaataggaataaaatatgcatcactttggttttaataaagactgataaaatttcagttggctttatattgttttcttaatcttacaagaaaactgtgtttatcttgaagtttcacagctgcagtcctccttaaaacttacaaacttcaaaattttgatcttttcttggatttgggaaagctctggggccaggcatggtggcttatacctttaatcccaacactttgggaggcctaggcaggaggactggttgagctcaggagtttgagaccaacctaggcaacataccaagacctgtgtctacaagaaatttaaaaactagctgggtgtaatggtgcacacctgtggtcccagctacttgggaggctgaggtgacatgaagtcttgagcctaggagtttgaggctaaagtcagccatgatcacaccactgcactccagcttggatgccagagtgagaccccattccaaaaaaaaaaaaaaaagagagaagaaaaatggagtttttttgtttgttttacagtttttatttccatttagatagccaacttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagatagccaactttttatcatagaatgataccctgtatttagaatctctgtctgtggaacccttagcagacataactgaggcccaatgagtgcctcacacctttcaattccaatatgagataatgtactttcctgcccttcagaagcttatagagtagaaacattcatggcaacaaccattcattcattcagtatgcattgagaatctatagtggaccggcaacgttgggtgctggagatgcaagggcaaacatttgaaagaaggaaaacccaaatggctcagttaatgagcatctaccatgacgaagcaccattctgaacacccagccttaaaacttacttctatgttactccagaaatcctgaagtctttttattcatgctatttaaattttacttttttacagttctataaaaatattttatgcaacatatgcagataagaatcaaagctgaggaagtgaagagaattctaatcagctcactactagtccagtttgtcaaattcttttgatttatatcaaacaccttcaaaggcagattgccagctattaattttgagttcagtcttttcctttagtgtagagaattcagccttatacagtctatggagaatcttttttgctttggagctccaaggaaattgttgagaacaaaatgcatcaagaaaatcgagaggttggtgattcatcccttgtgtctttggaatttctggctgcatgtaaggctcatccctccttccatttctcctttctctgcacccaccaattcttcctagtgttcaccccagcagaacctccaaagatactcttcaaagcctttaaccattatcttgacttactgtctacttgggggcagcaacctacatcaactgcttgtataaatttctcacagttaatgccccaggttaattaaatatttcctgagtatctactgtgttccagacatgcattaggtcccaagggtgcaaagatgattaaaccacagtccttgccttcaagttgcttatattatagtagggagagaaacatatacagccatgtgttgcttgatgatggggatgtgttccaagaaatgtgttattaggcaattttgccattgtgtgaacatcctagagtgtacatacacaaacctagatggtatagcctgctacacacatggctatgtggtatggcctattgctcctaggctataaacctatacagtatgttattgtactgaatatcctagcaattgtaagcaatgataagcatttgcacatctcaacaggtgtaaacatagaaaaggtgcagtgaaaatacagaattgtaatcttgtgggaccaccatcggatatatggtcccttgttgaccaaaacattgttttgtggtacttgactgtatgcatgtaactataatagtgtaataagtgctgtgatgacctagaggaaacaggttagatctcattaatagggtcagaaagctcttccaagagaaaaggatttataaatttggatgtaaaaaagggccaggaggacattccctcccagtgtgagctaaggcacaaagacattaaactatatggcatagttagggaatagttgcttgttcaataaaaatgcaggatagaattctaagaaagagttggaaagatggtggtagccccgttggttgtggtcaaattgcacagggtcgtggaagtatgtttgtgctgtagattgtaggtattatgaagtgaaaggggatttttcacagtgccatgaaagatcgcagttgagttttggaaacagtggcatggcggtggaaaaaattgctacacatgaaaggccaagggccaggaaggctctatgaggccattgtagtcatcctggaatgaaattgtcaagacagaaccgaaagagctgggggagacctcaaagggaaatgaaaccagaaatttaactggatgtgaggctagaagaagagagagggatcagagataggaagcaggtttgttggatgaggagaggtaaggaatgagtttcgttttagacatgtggagtgtgaggcgatttggaaatgtctgtaagcaattggaaataaataactgttctaagtcaggagatctgcgctaacaatatatatttgggagaccctggtatattgtagtgatttgaataatagaaacataaggtacctccccgctgcctcaacaagagatttgtaaagatgaaaatggaaccatgcatgggggagggaagtctgcatttcttttttttttttttttttttttttgagacggagtctcgctctgtcacccaggctggagtgcggtgggcgcaatctccgctcactgctagctccgcctcctgggttcatgccattctcccgcctcagccttcgagtagctgggactacaggtgcccgccaccacgcctggctaattttttgtattttttttttttagtagagacggggtttcactatgttatccagggtggtctcgatcttctgacctcgtgatctacctgcctcggcctcccaaagtgctgggatttcaggcgtgagccactgtgcctggccagaagtctgcatttctaagagcaatcagcagaagcagggaagaacagtaagagtacagggacagaagtcaaaggggcagaaagttttgagatgaaggacggggcagaaatgcttgatgttgagatgtcaggtagcatgagaactgaatggggatcgtaggattcagcagtgaggacaccactgtggcctatgaaggaatgggcaataccagatggcagggggacctggtctgggagtgtgatttttggtggtcaccgtgggtcctttcccaggctggctccaggctttactctagcgggagctgtcctgcagcgattggttggtagggatcaaccccaggaccctcatccaccctgacccttggtgcttgtggtccccaattcccctatcatgaccatagcctgttcttggatcccagctgatagggatcagatccaaaaatttcctaattttacatcacaggactctagttggtctttttttattgtttaattaaattttttttcttgtaccccaaatcatcaccaactcttttctctccaccctgtccacactcagtgggtcaccattctccctatggtgatgccattgctggctggtgtcctcccactttatcttacatctgccctgggcaccaatgtccaacctgctgccatcacctgttgtgtgccaaataaagtctgaacttgttctcaagtgaaggacatcttcctttccactcatgtcccccatttcttctctggacccatgctccatcctagaaacaaatttaaattgtccccagcttgggcttttccacctcatccctttattcctctcacttggcctagctagaatgtcttcctctgtctcttcagctgtctaaagcccactcacccaatttggccctgcagacctctgccactttcccggatcacctcgctgtccagggtcttccccagccctgcagtactgcagcagctgattcacagatgacacgttgcaccaccttgctcagttgtaaagtctgagagcaggggttctttgtgcattctacagtgactgtgagttcatggtaactactgggtaaatgttgaccacatgaatgaattgagaaacactaggagctgttgcctaaatttcctgaggtttggagcctttgtaagtatttatttaaaaaattaattcacagagctgtgtccctgtctccctctcctctgttcctggggcccctccttcccattattctcagtagatggtttctttgaattggacccattgtctcagttcaagaagaggaaacagacatggagaaaatcagagctccacctcacctatgaggtgagcacccaagaagctaaaattagggaaaaagtacgtcttcttccctctgttaggtagttgtctcttttctcttggtctcaactgattccctatgcaccccccaccccctgcattttttttccttctcaataatgtggcaagcaaggaacaaaagctgagaaagagattttagggaatgaacagcctacaccatgattagggagtaaaggagagtctaaggcaggaagccagatctccctggcagcgtgcctgaatcgccacccccaaacccaaggacacacacatatatgcaaacacattctctccccaaatcttgacaagtgcagcaccagaaataaatgagcctccttaagtgctaaaagaagacagggaaacagtaaggtggatttcacgtccaaaaagttgcacatcttttaattagatagtctcgcttggagatttctctaacttcagaaccaatttgagacacttactaacattcagctttcacttggtgtctgagacttttaggaacgcgactgcaaaaagaagtgttaacctacatatgcgtggaaagtcatttaaaagggcaatgaatttgtaaattaagccaagtatttccaaattctagattttttaaagtaactttgatgtttaatcataagcatcttggggacagggagcaataagaatctagcatgtactaagtgtacactacgtgtgctgataggttgatatctagggccctggactcgtggctccagttagtgaagaagagttggttcacctgtctgaaatgatgaaggaaaaggtggatctgcacacttcctgaggagtattattcaacaatgcgctgtgaccggtatatgctgttggatccctgacaggcttaggtgacagctgagtcgaaataaaggagggtcatgtaccgtcgggagggatagaagtcagctctgcagtgagatttcttccacagctctttggtggccagtgatgttaattggtcatcatggtatcagtgaatgatccattttgaagttgagcacttctcattcaagggtaacaagcacagcaaaggatgacatttcctattttttaaaataagaaaatgtacctatacagataaaagcaaaggagaccagaactgggtaaaggcagcggttctaatgagttctttactaattcagagtttagtggattcagattgaaataattaattgttcagccctgcttggctgtttaacaacaaccgtgttagtttaattgttcccattcaagataaagaattgtgtaataagggcctctgaaaaaataatgccattttaagttgaattttaataagttctattaaataagtcacaaagccttgttatggcacttagaaacttctggcattacagagtaaaaaccaagtgtactcagtacatgtgtcaaacttatttatgaaagaaaattatttatcccagcagtgattcaacaagaaggtgtgtaatgctttctggatgtcaagaaccattttaagaagttgctaatgctcttctgtatggccaagaggaagagtctgaacagagctctgaccctaagagtacatgctgttcccaatgttcagacaagttgtgttccaaaagcatttgattgtaaatgacttgtctggcacttgagtttcatttttctagagatggcgatgcaaatagaagcactgagcccagtggttttattaggttggtgcaaaagtaattgcagtttttgctttacttttaatggcaaaaaccacaattaccattgcaataaccttgcctaaaggaggcagatccgagtgtcccggtggtagagagagaagcctaggcatcctcagccctgcagatgctaggagggttctggacatgccctgaggtgccaggaccagccactcatgggaaaagtgcaaagttttttgagtaagacctaaatgaaatccagctttaactctgccatcttccagctgtttgtctttggacaagttacctgactaaacatgtttcttcatctaaaacagaaaacattgcaccaacttacatggcagaactgatgttacctaaggtgcttccgttcaaagtgtccaaactctctgtccttgcaaacatgctcccttttggccttaatcttctacagccaatcaattaccaggttctatagtttttacctcttacatttctctggaacgtttccgtttacctccaccccatgacactaccctagatcagccacgtcagcatctctaccataggacccttaaatgtgccccactctctcctaccttgacattctccttgcacccagtattgtttccctctaatccattcttgacagggcaagagctggagagcattttcaaatgcaagcctgatcctgtggcgcctgcttaaaatctttgtttttgtttttgtttttcttctcattgccctttggataaaaaccaaactccctaacatgaattttaaagcactactcactatgcggcccctgcctccatctcattcctgacattcctccgcctccaaccccacatacttgctttacttagttatttaagtctcttcagtgtaccacactggcctcctttctcgtatccagccctgaaacaggagatccctgggctgaggacacttttccttcattgtgccccccttgcttcaccaggctaacttctgtatccactgccctctgtgaagggcgtaggccaactctcactgttggttattaggattccaattgcaacacccaatacttctgttaatggctgttgtgatacctcggttcttgtcttcttagtttaaaagaatttaaacaaaagacacacagcaaaggagatgcggcagagagtcattcactgcaaaaggaagagagtattttgaaagttagatgcagaatagacagtataccctgagagagagagttcagggtgggctgcttgcaagggtgaggcagtgttgattattgctagagaaaccccctttgtgggagtcttacatgataattcataaggagttgggaagaggtgttgctagtaagcatgttctgggtggtcctctgggtgcacatgcactgtagctgtatgtttgtgttcatatatcacatgtctcattagcatcttaaatctccacccaggggtgtgttttttactataaatgagcaaagggtcagtttgatgacaattaaaatcaaaatgcacatgccctagagaagggacagtccctcctgaagatagctttgcttaaatgagctcatttatgatgtgaatgccaaggcttattgtgttggctgtgaggtcaccaccaatgctgcatcccgagaacatggtcacttccttgactaactatcctgcctcacttcccctctcaaaatactttattgtaattctagcttagttctctggtttacctgtaggttaaagggctggcacagtaaggcaaggtagtagtaagactgcaggttttgaactgcctaggttagattttaggctctgctccatatttgcttgtgaaatgactcatcatctgtaagcctcaatttcctcacctgtaaaatgggtggaaatgatgctgccaatcttatagagttattctgtgagttaaatgatgtaatatatatacatactgatgcacacagatgcatatatgttcatatataaaaggtctaagtgcattgactggtgcataaaaatgccttcaataaaaataaatgtctttcaaaaaatgccttaaaaatacacatacaatggatacttactaaatacttacaggcttttattgttttgttttgctttttaaagcaaggtattcctgagactgttttcttgtgagccctttgtctctttttcttcattttccattagctggataagatcagagtctcaaagtgaaaagtgttaacactgtgtttgcttccctatttgctcattttttccctccaatctatgtagcctttacgtatgacataaagatgtgcagtagaatgcgggtgggtaaagaaaatattatattcacaaaatgtgttctccagccaaccagtaaggcatccctttcttactagttataggctctgcttctgcccttgtctttaatccttttctatttctgagccccttccttagaggctactggctgaggaagtctaatgtgatgaggtccgagcgtgaagttcactcagcaaagacaggatggtggcatgcaagcaaattaaagcattctcagctttccagttcactctctctgcaaacaaacaaacaaaaattcatagctttttaggtttctatttttaggagttgccaaatacatttcaaaagcaaaactacaaattaatgcagcatggggtatgtgacattttttaaggtctttggaggagatgacaaaacaaggagcttcccactttccagggttgtaagtttttgggaaaacatcaagtgcgaaaaatcaataaacatcctaccttgccactgaattgtgtgagggtttcctgattacctggtagtcaccaggctttagaagagttattgtcatttcgattttcagatgagtcactggatctcttgcccccagggccacttcattatgattcagtgcaaagtactgacagcactggggcttccggaagggagtggtgtcgggatgggggttgctgttggcaagaggcttaattgacacctttgatgtagcctaagacagaacctgcacctcccactgctgcttgggagacgtcagctttacgcagaaaaggcatctgctgatgaatcctgcatctcattcagcctgctctgggagcagccttagccatccttaaactcatccaaccgattcccatttccgcgggtgcttggcttagtgctgagacgggattccgccgttggtattcaggtccaacactaagactgtgtccatgttagaactcatagaaggtaagtgaaatgcattgctgctctcccttgtggaaagcatttattttgcaccctcaagaatctatgtgtctcctggttaattctacttcactgactgtggggctgtaatgccatttttacaggtaaaatagaggtgacctgatacatctttataaaaccatgtctttaagtgtttcatctgttgttagagatgatgttacttagagaaaagaatggcttacttgagttctgtggctttagttcagtttagtgaaaatgtgcataaaactcttgagaactgggtagaattccagtgatttgaacttgttagcagtttttcttttcaaaggcagcaaagagaaactgtgaggagtttctcagcgtctgtggccaatgactgtcctgttcaaggcaggtccatcacaatcagcctagggggatggacaagacacaggtggatgcaggacatttttctagaagtgagttattaattatacaaatacagtgatctatttatcaggtcactggaatgtcactggtgatctgtgcttatatttattcctgctgggtagtactaggtagctaaactgaagagttaaggattaatctcattgaaaatgtctcaggaccatacattcctaaagtccctgctggcacagttaaagacatcattaatacattcatcaggaaagttgtgaaaggtacatcttaaaaaataattctgtaacctgctgctctatgaaacacaggatttacaaaactgtgactctctgaaggttacttccccaaagctgttcctcagtgtacatatggaagggtgtctagagttctagtagatggctctctatataattgtttatttcttgcagaagatgatttgtcatgaaaattatttaacgtgccatttttctctgtgtgtgattctttgtatttctagttaatggaacccctggtagtcagctctctactccgcgctcaggcaagtcgccaagcccatcacccaccagcccaggaagcctgcggaagcagagggtaaggaaataagcaagctgcttgtttcagacctgtctcagccttggtgcagacaggtacaggtgccagcaaatcgtgctgctcgtctctaggcgatatctaagctagaacaggaggtgaccaatgaggggttgcttattgctttggtttagctagaactcagggcttttagcttctctgtaaccttgtccaaatcttaactctgagaagaatgcacctttgctacttcacttttacatactctcctctttctgttctgaatgcacaggctttattagcactagtttgtaagccttcttagttgtgatgagtttgattagatatcaccattaagggaaagaagaagtgctgtgaatggaggggagggccctggtggaaaattgcttatggtatggatggggccccagagcagcagagggtccatgaggtaggggatgggaacctatgacacgtgcttttgtggatgaaacccacattgagcaccttttcatcactacttgcatttatggagaatttggctgagcttggagaccacagtgaaaaagttactggaaactgttagcttctccaccctaaggaagagggtgagggttagtgcttctttcaggatggagagactactgttcttatcctgtcacaacctgtactgtttgtcttttccagtaataccaaggcaaaaataaaagtagtgggaagggggcaaagggggaggtacaatgccaaaaacggaaggccctttatggtcctgatttcagacgcaaggtggggggaatgtacgctcctaggaggtttcatgatggtgctcactgaacactttaataagcgagaactccttgcagtctactgcactcaaacacaagattcttgagtttagtttcttttattatgtgttttaaaacaaaacttctgagttccacaaaattacgtgtcatccaggatggaaggccctctcttcaagatttctgcacaggttgtgtctttaggctgccagacgtctaagagtgcggggcggggagattcagttggttcccatctcctttggagcctgttgcaccaaatatcaagtttggttatctttcttcactgattcacctggcatcaggtggaacttgttttgagcgtttgatgaagcctgggatttgacgccagcttgtccactaaatggccgtggtatcttagataagcctattatcttttctgggtctccattggaaacacaaaacaaaacaaggagcctctttccagatagaaagcccaataattccattctacctccatttgagtgttttcactatggtttcttcttggccacagtctaatttggaattttaaggtgttggaatcatttgtgaacaactccaagaattggccaaatttatttactctcctaaaggcctgtccttgagtgaaggaagagctggtcggtcattcttttcttgtgaacatcacccagtgaggcgtcaatctatagggaccgccattggatacagagcaggaagggccctctttctgagaacattctgtctcttagagtgtatgctttggagagtacacctagcatagaaatctgtctttattctttgagctaattaaactcagattaaagatttattggtgtcgtttatgcttagttgttgacattaagagtgattgggaattcccgctgcaaatgggagctcctctccttgcttatttattgaggagacctccagcttagggatgtaaagctgtgctcagatgtccctttcttggcagaatggggctagaattcgcttcttctgctttctgtatttccacttcagtatgattttgtccaactgaggcagaaaatttccattcagctctgtggctattggcttatataattaacatttccagcacttggggaatgattataagatatggctttcttatagattcttcattttaccatttaaacgatcagtgcaaacaccatacttgagagaaaaaaacaatcccatttgttttaggaggacaaagggtttataccatctgaaaacatttattgagcacatgttgtgaggcagggcactgggtatattctaagatggttccatttccaagcttttgaatttaggccataaatgaacctccccatccatgtgctgtgtcagtgcatgaaggcattcccagatgctttagccagaggagctttcatcttggcatataggcaactgcatcaaataatccctcccagttaaaatgggcctagaagatccctaaaaactgatcctgtttcaaatttggttaatggtcttctcaaatgattggctatactcctatgcaggaaatactgaaataagtgaaagatggcatgtgctaaaagaagacacttcaaagaataaattaactctttttactgcagattggaaaacagtagctacttctattttttccttctgtgttgcctagcaacatggccaagaaaatgagttgactgcccccaccccaacacacacacacacacacacacacacacacatatacacacacatgcacacacgcgcgccttgcccccattttaaaatacaggaacatgagctgttttctcaaaaggaaggttgagacatttgactggtttctttacaaataggaaaatctagtttttacttatattaattacaaaatttgatcagctttctttcttctgttaaaatcacatttttatgttacctcttttgacattttggaatactcttatacaatgaaaacctgcatgccagacatttctcttcataagcatattcgtggcaatgtaccaagtaacctatttttccgaagcagagttatttaagttgctgtctacaggcatttgactggtcacagaagcagagcctggagactcttttcccactcatgaactttttttggtcccatttcttaatccatcaggaagaaatgtgttgtgttatgtaggctgaatgaagctccccattatactcccacatcactgacttttgtagattatctgatcagtcagatgatgtgaggagtgggtggtacaaaaccggagaaaagccaactctagacgctctctgcagatctgagctggttgcctggctaccaaccgagatctagtagcaggaaggggaggtaggaaaggagagaggaggtgatgagtgagtggtcggttggagaacagggaaagaacattgggaagggatttggggtgaggtgggttaattttacacgctttctgtcatccaaacataatattttgagaaagcaatgctttcttgggttttatgccacatgcaactacaacatttgagttgctgctctgggaccagaatttgctgaacgccatttgggcctcctgataaattattttattgtgaggtaagcacgttccttttctaccaagaatgggaaggaaatggtcaaggaagaattgcctagtcacatagtagtggagttgacctttacagacctcaggggccatgcaactcaacgggcatcaaggaaggcaaaagattatgagtagaccaagaggcattttcttgccaataaggcgaaaccagcaccattttgtttatttagatggtttctctattattatctttcctcctaatccaagttggtgacttgaaaaggtctaataatagtagaaactggggatgcccattcagtgctgctctcacgagagccacagggcacccaagaaagccgagtaaacaaatctatactgcccttcatcttgcaggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatgcttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaatcatatacataattttttaaatgtgtaaaaactaaagctgggaattttttttttttccatacagacctaaaaaaaattgtgtctggactttttccaagaaatccatttgaaaagcaaaattcacttaaatggtgctgtataaatcaggcccagagtatccaaatctccactctgaaaaattctcaatcttgctggtgttttggaaattttcatatgcaaaactccttttgtgttaaaccaattaagtctatgattataacccattgttaaacattaacctactaattctgctcttctagtcctctattttaaaaattatagtcgtctttgcttaaacataaaataatgattttaaagtctgaatgttaaaaattaatttaatgtgtatggtctattgtatttaagccatatcctagtggtcatttacttttactagttcaaacactaacagtttaagacttgtgaagcatggttttgatattctccaggcttgacatatctcagtaggtgataaattaaaaatgtttgatgccatttggaggcttttacatgattttttttttcaaattttacttgaaaacaatttttaaatgttttattcaagatggagagaaattcagttgtcacacgctgttttaaatgttattgatttatctccctgataaattgttcaactagcaaattttaccatctggtttatagttacgtatgttaccatctcactttacaagtgaataaaatattccaaccaaaagaagaggaagaagaaaaaacgtccaggcaatctaacagcatttgaaaacttagccctataataattagtgcctcattatgctgtctgttggagagaaagacacttctctggcaggttattcaagagctgcaaactgaaccattccatcttgaaagaacagttcataataatacctgttccagacttcaggttttaaaactgtttccaatagaaatgaccagagactcctgctgagatcaaaaggctgctttattttagctgaaacagtaaacatctgtgaggttgcctatgctggtgtctgttttagttatgtctttgtaaaatgcattacttaatacagttgggtccataaaagattagtatgtatttgactaaactgccaaaaatacaaagaaagcagtggaacagttactttaaaactggtggggtcagatggtccagaacaaaaataaattccaataattttaacttccctgcactgtcaatcttatggacaactactgctagaaaggtccaataaatgctatttgttctaagtggtagatattgccaattgatatagagcccatggctttgtttagacagggcaaaaagaaactggacttgtactaattgccgatagatatcatggccaactttccattcaagcagttccaagggaagtgctttccacagcatttaatctcttgaacatatgacttctattaaaggactgttcaggggctatatatatcatttactttttgaaagtaaagtccctcagagattgaaacagcacaccatttatagtctttgagatctctttttatgcaaaacataattctattaaactaaagcagaaataaaaatttcttagcaacaaacacagaagttttcagttcattggtggaacagaattggtgatttataggcacttatgattgagttacttatagaattctttataaaaaaaattcggcaatgaatttttaaattgttctactgagcggggaatgcttcagcaaaagccacgcagttttgtcctaatgataatccttaaatgcgctctgaagacatcgtgctgtagttcaaagttcgatactttttcacttgcactcacttttttcttagatgtagacattgtagaaaaagatattaggaatatttccctgctttcagcattttagaagtgcaaaagttaaaaatatataaagtatgaagttcagtgtgaactcaaaagactatagtgctgaaagccacatggtgtgtttttgtcttgtttaatcaactaggcagggggaaaaatctagacagtttctgtactgccatagaattttaagaagtgtcaggttctctcatctgtatacatccctgtgcgcatatattggctcatctaaatattaagaacccaaaaaacattttctaaaaccatttgaaccagcgctgatgtactatatatatatataccctacataaccagccggggaatttccaacacatgccctgaagatctatacatgattgggctctttttctttctttctttctttctttcttttttttgcttaaaaacaatgaagtgtgcaagtcagatttcttaatgaaagtgaatgaatatatagaataatattcctgaaaattccacatattttaattcttggactgctaaatttttcatatgtggccatatatctatacaggtgtttgggtgtttatgtaaatttgccaggcttggtgtgtatgtgggtatgcttctgtaagtatctgtgtatgtgtataaaccatcaacagtaaagtatagtatttgtgatacagccttataagttactggctcttgtggaattatacataaaatcttcatgtaataaagtgttactctgtgacatattagttggggcatgtttaaattaaaaagcagtttgctcaactggtatggcaaatggttcaaaatattcagatatactgatttataaaaaaattgaaattcagctaaatccaatattgtgttaactattaaatataagtaacattaatgtttatattgatatatctttgttttcaattattaacaagatcgaatactatgatttttttctattgtgtgtgtatggatggcttgtagtggttgccaatcactatactctaaaaaaatgaaacattgatacagttgcagattgtcaagtataatgttggaacataaatagaagaaaatccagagtatatttgatatgaagtaagtttaataacaaagccagataacctgtaaggcgattctgtatgttctttcaaaactctaaactgttgacaaattttgaatatacttgctgtatgtgtgtatatatctacataaatatatacacacttgaaaatgttaatcgaatgaatttactatatatgcatacatttgctcatttatgcatatttgcattaaccttgctagcatctctatttgtgcatgttagtgacaactgtctttgattgaaatattgcacagaggcatagtgtgaaaaatagagatacactgaattcaatataccaattgcctgatatagcgtgttgtactgtcagttgaaaaatatttgtaattttgtgcctgttatgcatgtggaaaaaagaggaaatcagaggccctcactataatttttaagggtgcatgacatatgatgtctttaaaatgtggttcattttagtagattatggataaattccaagatagtataaatgatgcatgtaatacctgagtgtttgtattatatatggccacaaaatgtttttgaagccagggtagtagatatctaaaagttataggcaaagaagtatgaaagttaactttctgtgatgtgtttttgaggagttgatactcatcagtaagcaaggaattgagtttattttttctaagaactctttactttgaaatatattatgaatgttgtaaatttggataacgtttttataaagaggttacatactttctgctcacagtttcagttgattggatgtgtattctctttaaaaaaaaacattttgtgttaaaacatttgacacagcaatatattttttaaatccatcaactaagtccatcagcagagctttatagagctaagggttgacaaaatgtttcattgaactacccaattttgaaagttcagttactttgtgctgtggtttcattgtaaaatgttgtaccttgtgtttcacactggaccatgttattcctcttgaagttaactttgtgacacttaccaccttagaataactatataataaacaggaaaaactgcctatgttgttcagtgagtttctttcagaaaatttgataagtagacactgaaattgaaatgaccacatgtgggataagggtgaccttcacaatcacgtgtatggcattcttctgttgtaattagcatcaatgagtgatatttgagagactgcagaatggtaccacataacgtctaaagtataaaatgctgacagtaataacaaaataagattatttgatgaaaaattctgtttcaggtagttgcgttaaaatcaggactctaccttcctttcagggttgccttaaaggaggaatttgtcagacatatcgataactcattgaggagaagaaattaacatgcagttttaaaaccactaatggtgtcctaggcttgaaggcatttttcccaaggtgatctaatttgcaggggaaaaaatgtgcatgtgtatgtgagcatgtctgtgtgtgtatttatacaagctatttcttttaaaatcactggataaatatatagttttaaaaataaagttaattaaaataatgataataaaatacttgactctaactcagaacaaaaatcataatatatttcatttccaaaaggatagaaaaggatgttaaagaggataggaaattctgctgaccaagctagaaaaaatatatacatatttttctgagacagagtcttgctctgttgccgaggctggagtgcagtggtgcgatcttggctcactgcaacctccgccttctgggttcaagcggttcttgtgccccagcctcctgagtagctagaattacaggtgtgtaccacctcatgcagctaatttttgtatttttagtagagacagggtttcgccatgttggccaggctgttctcgaactcctgacctcaagtgatccacccacctcagcctcccaaagtgctgggattataggtgtgagccactgtacccagacgaaaaaatattttatattgcaattaccatttaagttccaaattctggttttaaatctaacatttttactagttttactttaatcttcgaattacattaactttaattggttctctttattatttccatgataaatgtccacagcaatgatcacagcaaaatataatccatgtccatagcaataatcattggaaggaatgtttccaaatttataaaaatttcaaattgtagttgcagtttcttaatataaccagagtttaacataaaatgtagcaggtgcctagaagactagtgagctcccttcattacaggttgggaatcccatttgaggagtaaatcatggagggaattattctatccagaggaaatacagtggatgacttcctgggctgcttccaaactacgatttcatgaagggtgtaactcatgagaggaggcttgtgactacccaatgacacaagtctccttgggacaaatggttcagattatcaatttatagatcttggcttgcatgagtatagtgattggacaattgaggccagaaaaactacccaatacaacaaacagtacagatctagttgtaactaagtgcatttgtctttgaaatcttggctctcgtggtttcactaacatagccataacaccactgtttccattcgcgttttctcctcctttcagtaaaccaacttcatgagtaacagttttctagtcttttgaaaaaattatccaaatctttatgataacattttacatttttcagtattcattcttacttatgctcatgcttatctgtgccataaactttatttaggctgaatgtactactatgaagattgcagacaaaggaatttggaaaaagcagttcctttgtgccttgtttcaaatagtggagccttattagtaattgcagagtgatgccttcaacttattgttctatacccagttgggaaataaataaatgtctggcttttctgtatcatatagaattctgtgggtttcaagctctctacaccaagattattatttaattttgttagagattatctttagagcttctgtggatctaaagtcaagatcaccaagacaactgtttgagtttgttaaaaatgtattgcttgtgtttcctttataagattgattcagaaatcatatgacagtgataacttgatttctaaattatttttaaccatttttcaaatcaatatcaactcagtaaggtaataattgtatgccaagataaaatgtgaagtggaaatggtgcaattatccagccaaagctaaagttgtgtggtgagatttttctaccttgattagatcaattctcttaattggatattttcaaaacctttatgcagcatggaccccagctgagtgacaacattaatacaaatggcaagagtaactcacaccatttaaagtgaactcttttccactacacagtcatcagatacatcttgataaaatgtggttagggttgttatgtcagctttctcacttacttcaaaaagtgtgatatgttctccatctgttatatgatcccaagctcaatagctacacttaggatgtgttcttacttagggcagtgcttttatgaaggtgtgccataaaagcatccaggtgccagcaacctgcccaaatggttcccattaaatctgcttgggggtgatgacatttcaaatgtcacaatatctctcagagcagctaattgccctaaattctaaaataactgtacgttttgtactgtacacccagatgccttggaattagcgaattgaagcaaacataaaatcttgttggcatgtggactataaaatggtttatctgctcagaaaaaccaaaaaggtaaattgattccatttacaagcaatgaaaaaatataggtgggcttttcagcatccgttggttgtaaacaaaggctggttaatctcattaagttaattctaaagagcaagcacttacacattttgcctttactatgttcgaaatcctttcgttggacttaaggataataatagaaatgttccagcagggtctaagttagtctatttaggtggtttagtgaagaattggtggattacccaaagagccatcctgattactgaaatggcttcaactggtagacagagcaaaaacattaggagaccagatcagaatctaaaagataacagactggaaggatattaatgtaataaagatgacatttaacgtgaggaagtgtgaagtcctggacttggcccaggacaacctttcaaacacacaccagggagacatgacatagctgtgggctcattgtaaaggtgaaatgctatggcctcatccacataagccagtaagatcttgaagtgaattaatattctattcatgagaaagaaaaccctatccttctctgctttgtgctagtcagagcacacccagaatattgcattcactttcaagcaccaggttttttttttgtttttggagagacagggtttcactatgttgcccagggtggtcttgaatttgtgggctcaagcaagcctcctgcctcagcctcccaaagtgcttggaagacacagacggagaccagtagctattttcaaacacctaaaagcactgtcatgtgaaaagtggattagacctgtactgggcaactctagaaatcagagataggaccaataaatggcaaacatggagggacataatttcaacataacttacagaagaacttctttttttttttttttttttttttttttgagatggagtctcactcagtcgcccaggctggagtgcagtggcgcgatctcggctcactgcaagctccgcctcctggattcacgccattctcctgcctcagcctcccgattagctgggactacagacacccgccaccatgcctggctaattttttttttgtatttttagcaggagaacttcctttattttgcctcccattaatgatgaagggctgcctcaggaagtagtatgttcagtactagaagtatttggacagaggccatctgaccacccactgggatttctgtagggggcatttggtctctgaatggaagtggggcagaataggtaatatttaaggtccatcccagtcccccaaactctttgaatcagcggatggtcaccatcttggaaaagtatttagtattaactatcttacttctttgggaaaaaagagataatactattagaagtttaatacatttattttactgtctttgagcataataaataaaatgaaagctttccattttcagagaactctgtatgaccgtaagtacgtttttctcttgactgcccatcatctgttactctcaagcagcagaaaatttgaaatgacttgggatacattttcagaaacacaaaaatacagttgtaacattgaaaataagcagttataaacataagcaaacttgtcttaaccctacttttttttcctttttttttttccaccagagcctaaaatccttgagagatttttgttcagaaagcagagaaaacccagctggcattgtgacaagcattcagggatcagccatttggtggcactgttaaatccaattcattagttgataaggcggttgagtgaaagcccacaagtttatagaatgttacagtttaaaagatgttttcatgtactatgggtcagagctctgtatcgagtacctgatgttcttactaaaagaacaagcttttgggactgagtgtctaaattgtgaacatctttgctaggaaacatgctactgctctattaatttggtgaaagaatgtgtctttgtattctaaatttaaaacgccacgtgacaaggcagcacctgctagcctaaaccacaccatgtgtctccattatgaaataccatttgtgctgctgctggaagaaattcaaggtccagaaagcccagaagagaaggtctacattgtagacatttacttagtgcttttctgtttggaacaccattatgtctgcagcaaaaacaatgacccagaggatgaaggatctcactgttctggaaaacacacaccttcccctcaaatgtggttatgtttattttcttcggttattgacataataaatctgccttgtgtcagcctcatactgcaatattataaacacaaggttttcacaaaaagatgtccatccataaaagtcagcagagggtggcttagaagctcctacatttatagtcccttccacagtgtgggttatgggtacatagtgtcacactaagaaaaactctgtgtcaaggtgacaatctcaatccgtttttgtagcctgacatatgacaaatgtgtgctgctggttacaaaagatagaaaaacagctcaagtcaccaggcttactgaggggggatttttatagtattggaaaataatgggcacattacacaaactgtgtagtattcaggggtatacaagggtcatctctcaacttttagcctgttctgtagaaaagcaggtgtactattgctattactttaactttcatcccaatggtgtcaactgtgagctttgatgaacctgaccaatgggacatgctcatcttagtcacacccaggaaaacgttctgtgatgtttgacttagatggctctgcagtgacttaggcagcatttccccaactctattaatctttttaatgaaaactaaaatctttgaatctcctatgcaggatactgtagaccataatgaaattacatcaaacctctttcctcctactttgtacatactttaaggctgaatgggttggggaggaggttgaagggaaacaggtaagcagaggaaaaataggtcagctttgcttctcgccacctcttcattattaattcaactacagatgctctttcccttctctctgctccacagacagccggcaccatgagccaatgccgcccgccccctcaccgcctcctgctcccatcaggccaaccaagtggataaacccagggaaacagaaggaagatcttttaggacaagctgtgttcactatttagaaatagcattgaaatgtgcaaattgttttctcaggaaatagatgcagagatggaaacattcattgttaaagtactgccccatagccaatcataatattaaatatttggtactgttttttcctctgagctctctcatacagttgttaccctgtttgctttcatggatcttgggtcaaaatcaaacaaaattacaaggcctaggcttttattgttgtctttacttcagacttattatgtaacgtttaacaaaccaataacctactcagtgcttatgttttgatctcaagatggaaatgacaaccccactctttaacctttctcctaaagttgtggtaaggtggagcatttaatttttttaaggatattttataaaaacaaactgaagagaaatgttttctgtcagaaaaatagaaaaaatagtggatgggatcagtatagtgccacatttgagggccatttgccgatagtctgtggaagagtgaggtgagatgcctgaactctgccaaacccaaacagcgagctaaaggaccccgattttgagcaaaaggaataagaagtcacggaacattcaagttcacaataaccagcttgatcctgttatcacagtctattcttggttaatagggagagagggagatgtggccccagttgaatatgctgaaggcgtctttttccaagtgttaagatcaaatcctccctagcatgggcaaagttttctcctgagattccgggctgggcatggtccctggaaactcaggcattctgacccagtttttgaattaccggtttctgttcccctacagagctctcagcatggcggctcctctacgtcacttgcgtccaccaaagtctgcagctcgatggatgagaacgatggccctggagaaggtgatgagcttgggacttggtatctgaggaggcagaggatgggttggctaaatttactccaagaaactgtggcttctcaagcggaatgacatggacaaggctgagcagctcctgagggtcaatcacaaggggatagggttgaatatggtgcccaccagggattggtatctgctctgtgagaatgggaaggggaagttggcccatttcggagacatttcccatcctctgagggcatatgtatcctaagaaggccagctattgcctgctttggaaataagaggggatcgctgggatcgtggctgcttttgttttcccaaactctgttcacttttagtgttactttaagtgaacaaaggccaaatttaaagacaatttattcttttgactgttgtagtctcacagatgtactctaaattaagtgaactcaatacatgaaatatggttttacaaaaagaattggtggaaattgcaaaaatattcttgaggtaattcactgcagaatgtctctgtgatgtggtcaaatgatcaggattccagaaatgactttttcactaactcactggattgttttggacaagcattttcaactctctgcgtcttacttcctctcctatgaaatggagattgtgaatcacacctatttccttcctgaaggctgttaccaggttcaaatcaactgtggggaagtatttggaaaagataaaagtgataccatcaagccactgttaaggaatctgcttctcttacttgttttaaatgatatgatttaattttttttccgaaaaaagtaccctttgggaagtgcttttattatattcagtgaaatatgtgatttacagtataattattttctgactacaatgcaacttcagaattttttgtatttccagaaatatgaaattcagccacatagaagtctcatttgttccaaagtgttttgtatcctttgaatgaaatgaaatggttcttgatttaagcctttggctaagccttttttttcttttcttttcttttctttttttttttgagatggagtctcgctctgtctctcaggctagagtgcaatgacactatctcagctcactgcaacctccacctcccaggttcaagcaattctcctgcctcagcctcctgagtagctgggattacaggcgtctgccaccatgcccagctaatttttgtatttttagtagaaatgggatttttccatcttgggcaggctggtctcaaactcctggtctcaagtgatccaactgcctcggcctcccaaagtgctaggattacaggcatgagccaccacacccagcctggcttagccttcttaaccaaaagtgaggaaaggtaccttttatgaatagtcaaggaaaaaaaatcccaagccacgtgctttgaatgggtgtctcagtgaatgctcccaccagaaggcagaatggaagtaccttcttccatttcccacctgcagggtcacacttgtacccaacagccaaggagggttcctttcttagccacatagtaaagagccttaagattgtgtcatctgggagctgttttgtaaatttgggtgctttgcagtagacaaaactcccctggctgagtccttcaaacagaggcaaaattgtggcttctttagaggggtgagatggggttagggggattggctgcagccctcactttattctagagaccacctagatggcttctagcagggtaagagggaaatgtcacctataaaggggtgaagaggctgtaccaatgccaaggacaaaagtagcagcagcaaatgtcctacatttgttcaacgctttccagaaatttcatcccctctagaattcagattgatgccaactgagcatcatcataaatcgagaagaaaggccctcatgcagatatctgatgattatgagtctccaacaatacagagcaagcatgaatacaaaaactactaagaaagcccattcaccacctaaagttttattttgaggagagatgtttagtctcagtttatgacgaaaggtcggaagaggagtgcatttagaaaacacaccggggttccatcacattttgcattcaggttgcctgagggagagctgggatttatcactttaaaacatgtacattttagagcccagctataaaagactttttacacccttaagatgttaaaggttattcagtatatttacgtgacctaactgtggcttatttagttttatggccttagatatttaaagcattattaggcatttgtaaaatatttcaaaatgcattttcagggggaaaatgtgttgtgttagtggcactaacataattgaaactacaaaactgttccattcacagacataatagatagtgtagttttaactcaacatctgctatgcagattgctggtgagaacatttgtctaaagtctgctcgttgataccgaggacgggtggccatcagtgcttagttcatgaggaattttacggagatttccatttcaggatgtagtaaaactaagtgtccaaacagcaggcaattttcatgcttgtacagtgtcaagcagcccagagtcccttgcgaactgcggttgcctcctgcgccatacatgggaatgctatttttctgtacacagtgggtattcagtaaacactattgatcaaattggcgtgaagtaaaaggagcaaagcttcctcctgagaatccctacggcatcagaaaactcaagtttctcttatataggtgggagtggaccccttacgtttctttttattttatcatttgtcttagtaaaaactgttgagtatatacaatgtcagcaagggtggggaggcagttgcctcactgtacagagaatgacatattgattctgaatccattccagtcaattagatgatacttttaaatgtttccttgtgcaacatctgtgttcccttttcaaccaataaaaaagtattaatgattctttcagaagtgtcggaggaaggcttccagattccagctacaataacagaacgatataaagtcggaagaacaataggagatggaaattttgctgttgtcaaggaatgtgtagaaaggtgagaaggatatcatttgcatcaaaccttaaaggttacatttggcgttatgttttccaagattgtgtctctatttccagtctgtggcacatatggaataagttaatgtctcaaccccaaatgcaaaagaattttttgcaaaagaaagacccatctaacaacagatttgaaaaatgtagtgatacctggggacaatctataaattaaagactttgatttttttaaatgtactcagagagacgttgccagctctttcaggtaagcctttttattgttgttaaaaaccatattgaatagtttttctcacacactttttatgacattttgtagaggtcagaaagttcttgtgagagtatatgtctgtaatgcatactagcataggatgaaatacatacacgatcatcttgaaaagctttaaaatgcatatgtattgaccccaacagaagtggtatttaacacattaagacgtattaaaatgaatgaacccggtactctgtggcccaaagggaagggtttatcctgaggttctagatacctaatggaggacgttagctggtggctactagacggaaaagtgacaactgataaagttacaacccagctacgggggcctcaagccctccactcggtatcagatttgggtttcttttcctgagcagctgcttgctttaggggagctggtcagccagcagcttctcctcagggctggtgggcagaatactgcaaagttgggggaacttgcctcattccttgagggactgtgtcctctggctttctgggggctggactggggggtacacacttccctgtcacctttctctgcccgcagtggggctggacaccctgcccattcttaatcctccgagaatcacactcctaagctccactcagagaggacgactgaggagagaagacagatgagaaggctttggcctggaagatctagaccttgcctcctctacaggctttgatttagaagcacaggttcctgccatatcagagctggtagtctctacagggccccacatctcatgagggttcttcatttggccaatagtcacttatgtgctcctggcaccccttgcggctctttggaagctgcttccccagctcaggtagcagagtcctccttatggacctttgtgcagaggatctcaaaccttgttctactccaacacttcagcaaggctaggatattcccaacagggacagagacccagctgagcagccactgtgcatccaggaggggcacgagtcatagggagcttgaaaaatctgtgagttgatgctgccaggccaccgttctcctctctccctctcattcccccacctctccacgaagcttggccatttggcacatttgtgccaaacatggaaaatgtccattgcattcctgggcctcacacctcccaaagcaggagcaacctcattttgctgagcataaactatctacaaagtccttaatttatgacatttcatttaattaacacaatactttcataatatcagtattgttgtctccacgttatagatagaaaacatggacatgttaagcgcccaaggtcagtcaggtaagaagtacttagcaagacataggtccgagcccagctccaaaaaccacacttttaaccactttactccactaataaggagcctcccataagactctggcttagctgagccaaaatcacacacgttccctttggccctgtacaaataagactaattaatttgggaaagccattcctatggtaatggatagaagcgtgcatgcaaataaatgtgtgcttatataattttatatttcattgatgcttttactgatagtaaatctggctttttttggctttatttctactgtagcagaaaaccccatttctagcagattgccatgcccctgagctgtggggtgtctggtgatttgccagcatctatcatctgttaagtctgacatggtggcatgtgctgtttctcctagctagttcttggattgggctggtgtcttggtccaacaggactggccttctcacaatagaaatttcccatttctccatccagaatcaatttgtttctttctaacttggattgtgtttgttttgcgtgagttcacatcttgggtctcactgtatgaaacttcagaacctaaacaccagattgctccatgaagttagtattcggctcctgctgaacgaggacatatggcatgtgccctctgtccccagaggtatcagaaaacattcttctaatattttccagaggtccaagaaaataaaaagcgagctaagaatgttgtgaatggcacacattgcttgcgggtacattctgctgtgtttggaaggatgaatatgtattaccaagggtgaatatgcctctcctctgctaatcatatcctgtcacaggcaagatttgtctacaacaatggacacaataacgatgtctttctgtggtcctgttccggcatagtctttggcagctaggtccatttagatttctgcccatgctccaggagtaacttcttgagtggcctctggggtacctgggacatactaaaggaagttagtggactgtgactccagctggaagagacatgctctactttgaagctgtttcgtggagcattttgaggccccatagcaaactcaaagagcagaaaagctctaatgagcggtcagagcataagtagagggcgtgatgtgagatgcctttcatccctaactttcctggctccgtgtggactaataactacacgagccaagggttggggtgatatagtcatgagcagggatggtgcccccggtggctcttggtcgtcttccccacctgcactgctggcattgcttagtgatataggcaccagagatgaattaaaatccttgctgcggatgcttctgtctctcccaccggcacctataagcctgaggatgtgtgccccaagctgctggctctagcaatgaacacaagcaggctcaaatccagcagaacaagcagagatcttagggtcaccaaaatgcattgcttccacctagaaaatcttcaaaattctcaataacctcaacaaagcgaccatgtgtctatagtttgaaagcatttccatcagaactggaatttggaggatgccttgtgctgaaagcttagatcactgctcttggctagtggattactgttcttccttctttccttcctgaggagcctctggctcctgagagccatggggcccttgtcaaattcaaaatcaaattccacttgggagctgtctgacaagacactgtggaatgcctcagttctctgctctctgctcttggcagttatctctttatggaggaggctgagattgggctttgttaggattacttggtaaacaaacggtgtgttactaactcctttttgctagtgttgagggtggtattcctgtcattgtgctaactgccaccatcctctggagtttccacaatatatgcagagcacctcctagttcaggcttatgctgggcacttctggggttacagagagagacaagacacagccccatacagagaactttacccacaaacaaggattgccatgaaattcaatgaatgctatgggagaggaatgcttgggagctgcttttccttctccatatactctttttctaaatccttcaaaacatagcaaacaacagcaacaagagaaaccatgttagcttagagcatcccaatctttgctagccatttccacaccaccacctttttttgacacagggtcttgctgtgtcacccaggctggagtgcagtggcaagatcatagctcattgcagtctcaaagttctgggctcaagtgatccattctcctgccttggcctcctgaatagctaggagtataggtgcacaccaccatgccttgctaatttttttgtttttattttttgtagatgggtctcactatgtggcccaggctggtctcaaactcttgatctcaagtgatcctcctgcctcggcctctcaaaatgctgggacgacaggtgtgaaccaccatgcctggcccatttctttttttgacaagcattctgctacactccctgggtgaggggtgcagtgggcagaagactggcctgagttgggaatcactcagttgaacaagacagctgtctccaaaccatttttagcacaaacaccaaaagttggatttaattaaagtttgtaaaatttgaaaatttccctctagtagtttgggttctaaccttgggtcacacttaataagaaggcagccttacaaattgatttcccttagtcaaggaggaagacaaagttttctgttgctgctggttttgttgtggtaaagagggttctgtaaaaggtcaagaacataatttcaaaaacaagcaagcaaacggcctgtattcacctcaccagtaatcagtcaggtcatctagtattcttctgagtacactcaaacatagacaccttaaagacaaggatcaggtctcgttcccctctgaatccaccaaagagccctgcgtcccactgctgaataattacacaggcacagcagtcctcagagttcgaggtatgcaggaaggcgaattcattatataagattcgatttcttgccaagtgttttcacttaaagcagacacttatattcttattcttatgacacacatttagtctcctaacacctgttttcaggcacactttctagactagctactttcctataaacctgtgattctaggaattaatttttattatgtggcttttattatggattttattatgtggctttgtagttcggccctcagggaatcaaaaaagaaaagatgcaacattaatttggtggtcctctgtggagctcattgtccactatgaaatatgagtagatgtaatggaaggtttaatcctattacgaaaggttgtatagtggaaatccacaaggtctttgttcctagtaagccctaggtttgctgccctcttcccctcagctgtaggctcaggacagaacctgcttccttggcctgctgggagccaacacaccctctggctcactggggatcctgcttcttgtctggctggctgtaaagggggttcagccctcctgtgctctacaccagccctgaggattgagtgctttaaaattactccttcaagggaaaagagcatcaaatggcaaacatggggaaatcaccaagctaagaaaccactttctcttctgaccagcacggtcctgtccatccatcccctttgtggaggtggtgaagggaacggcagcttttatttttcagtctcacaaacatcccttcttgctctctggccttgcctgggattgctgatggttacccaggcaggcagtgcaatggtctagattccctgccatccaatgggacatgttaagccagataggaaattgctcatgtattccaacctgagatttgctttatcataattttttagtaatttatgaaaagcagaatccagaaacacttgagcttttagttttcctcgattaagtattttcaagtttgtagacaaactctacaggagcctcttaagaagaagctacttagagggaccctgtggtcttataggatatagagcttctacaatgaagaatctcttcacacgtgaatcatttcactttctcattttctcatttatgtttgctcttacattttaaatttctctgtcgcccaggctggaatgcagtggcatgatctcagctcactgcagcctttacctcctgggctcaagcaatcttcctgcctcagcctcccaagtagctgggattacaggcacgcaacaccatgcctggctaatttttgtattttttttttagtagagtcagggtttcaccatgtttaccaggctggtctcgaactcctgacctcaagtgatccgcccaccttggcctcccaaagtgctgggattataggcatgagccactgccccaacccacgttttaaatttctaatgttaaatatttggtttacactccagtgccttctcctcctctaccccacagtcttgctggtggtctagtgtttatgtgggaacatctagcacaccaagccctgcatttagccacagcctggctcacaccccatcatggcctctctgcccagccatggcagagtctttgttgaaagatcaacagagacagtggcaggggcatccttgggcttctagtgcattcccttcctgagtgacagctatgggaattcctctggacagccgcatatctgcaggaggggagccccgaagcaaagggtttaccttctaccacctgaaccccaaagccctctagtgaggaaaagaggcttcgaagtcatcatcttgtgattttattcagcagatagaattataattcagtgttcactgttttttgaggccggcaccatgaaaaagcctggaagtgtcatggaagaagcatttttaggagtaaatgacatgaaaaatttctagaatgccctcaaaacacattaacgcctggtctcttgattcgcttagaggcaaatcattttcttgctgtaaccatataaccaggaaatcccacttaattcaccatactgaagattttaaagtcctattttaaaagcatgttcttaattaacctcattactatttgtgtccattggatccacaaaattggcttttatctataggtaaaaagctaggctctcccgatttcacaccagaaataaaacagcaatgcttgtgaaatcgtggtttactatgattatgaagtatgcattgtgccctttaataatagacgtgttcttgtgtttgtcactacagtttcttagcaatgttagcacaaatcaggaagctgtttaaaggtagcgatacgactaaatccttcctcctacacctatcacagaggaggggcggcgttcactgtgctatgcagggagcaggggcctggagaactcagagtccaattttaaagctgccatgtggctttgggaagtgagtggatttccactgtcaccttcattttctttcaaagaaatgagacagcccataaaagggcccaggggtccccagggagctctgaaatagattttatccctttctttacaccttgaccatatcatctatgagttctccagcggaactcacacaggctctcacactgaactgaggtctaaagagcgtggagtgctttctctagagtcttcagtgtaattgcatgaacattcagaaaactgtcataggtgccctgggtggatagagaacctcaggagagacttgaggaaaggggaagggcggaaactcatctctgctttaggctgctgctacatcacttcggagggaaggggagggaagagtaacctggcagcaggagaagctaagacacactagcaatgctagtgttttgttttgagagcaggagtggaagtttattagaaagttttccaacagtaagaaaaggaaggaaagtacacttggaagagggacaagtgggcaattcgaggaacaaagtgccagtgctagtgtttttattacaagtacggcaacataaatagcccaagatttctctatgccagcagacttactgtccttacacttggtcagtccatcaacgtttacatatttatttgtttttttttaaaaaaggaaaggaaatcctttcacaaaatatttacaacatgatgcaagatctatggggtaggaaattgatccctgacaaaataattcaatagatttgaagttaagtttcattttaaaaacatgaactttctcttcgcagatcgactgctagagagtatgctctgaaaattatcaagaaaagcaaatgtcgaggcaaagtatgtataaaatttgttcttatgagataagagtgttcaagaggtcaaaagaaacacaaagatcactcccaaacaaatacaagttcaccctaagggttgaattttggtggaatagaatgttatacacttactagaatataactttatgtatatccctgggataaaagttatttggaatgattagatatgacttcacttccttatctttttgtttgcttactctcttcccttcttaatgtgatctaagtttcatcccattctttgctatgaaactgtagttatcatgattggttctgaatttgcaagcattatgtaaggatctccatatctattggcaattctaggctatatctgaatatcagaatataagacaggcttattacattttaccaaaatgcatctctcttgacccttacatagtatagttgtactcatttgagttagccctccacatgttttatggaagctgatgaagataacttttcctttggacaggagcacatgatccagaatgaagtgtctattttaagaagagtgaagcatcccaatatcgttcttctgattgaggagatggatgtgccaactgaactgtatcttgtcatggaattagtaaaggtgtgtattttggaaagaaagtaagtctttattgatggcaccgcacttgcctatattctagagctctttcccttattttctcccatcagtattcaggttctcatttctgtacattggcccagtgattaggaatgttcacaggagaatggtacacaagggctcaagtcccagccttggcacaaagaggcccatgactttgggtctacctctttatgtctcactttcaacatatgtaaagtgagaatattaataatatctgcttaatggtgttattgtggggatgaagagatggcttccaccagtttgtgtgacacacaaagcattaggtaccaatacaattgtcgttgttgtaatggaaaatcattcacttttccatgaactatatccaaaggtaccagccatcttgtaaaaacaagctttaaacttttagtcaccaacataatgggaaaatagcactgtcctaataatgatgtgaatagtgtactgactttcagtgaatgtcgtaatctcatcctgtcacataatattaccttcttattctatgaaaacaaactatcgggatagccaattgttgatgacggttgaatggagatgaaaggtctcttacctgttctctctccttccatacatttgacattttcgggaagtagaagttttaaaaaatggcatgcttcattttcatgaagctgttgtgttctcaagtcttttctagtatattcatcaaactgaacgtgtaagtaatgtctaccttagttggagaatgttgtaattggttgcaccgccttctgcatcagctgtgagcaccgccagggggcgcctcaggctcccagggcatgtttggaatccctacactgctgacttgaatgtgaggttttctcttttaaaaattcaagacgaggaaagcatttagtaagctaatctgcgatgatatgaaaaatgttcattctagggtctttaagtttttgttatttagaattgcttcaccttagacatattggcattttttttaacttagtggttatttgtatttataggtgaaatttatttttagtctacttcaaattaggacttgtttctttctttctttctttctttttttttttttttttttgagatggagttttgctcttgctgcccaggctggaatgcaatggcacgatctcggctcacggcaacctctgcctcctgggttcaagcaattctcctgcctcagcctccctagtagctgggattacaggcatgtgccaccacgcccggctaattttgtatttttagtagagatgggatttctccatgttggtcaggctggtctcgaactcccaacctcaggtgatccgcccacctcggcctcccaaagtgctgggattacaggcatgagccaccgtgcccggccagacttgtttctttcaaagaatgggagcctttttttagtaacaagggtattgtcatgtttgaggctgagggaggtaaaaatgttaaactgaaaatccaataaagaaaagtcggctgggcagtgtctcatgggccaggcgcagtgactcacacctgtaatcccaccattttgggaggccgaggaaagcagatcacaaggtcaagagattgagaccatcctggccaacatggtgaaaccccgtctctactaaaaatacaaaaaattagccgggcatggtggcaggcgcctgtaatcccagctacttgggaggctgaggcaggagaatcgcttgaacccgggaggtggtggttgcagtgagccaagatcgcgccattgcactctagcctgggcaaaaagagcgaaactctgtctcaaaaaaaaataaaaaagaaaagtcgatttcatttgaataaagaaaaaatatgaagattttcccgttggtgctttattattaaattatctttttaccaacattgtaaattatactttccccagtaccaaggagtctttttacaacaatgttaatttttaaactaacaacttcaagccattctgttgcccttctatgtgctgttagaatttgattaccccccgttattattgacttacccccactgttggctgatttttggagtgctgagactaaatgaaatttcaagatggcaaaggctcaggcactctgaacgcatttggtgagaaatcttagtctgtcaatcgtgtgcttggttaggagactatggtaaggtcctcgttgcacttaactgcctttgtgaattctctctacatcaccaagataccctagaaaggccatagaaggtctctgtagcccagcgctgggaccctcaattgtgctgcaagaccatacccttcgatttaatctcacccagaacgccctgaggacagctcgagaagcttcccagggaagtgaaggccagccccaggcttgacttgaaagactcccaggacttttccactgagacatgtgggtggggtatgcttctcaaaccctcagggcccagggatgtcccaaagaatgcctgaagctctcagacaaacaaggctcatgttccggacggcagtggatcggcagttaatgagaatgaaattccatgctcatcaggcacaggactttagccttctgcctccagaggcggtgcacacgcaggctgcctatgtgttcagaggaaggcaggcctcgtggaggagctgggcctgcagctgggccctgagagagcaacgggagttagaaaactgaaggggaggggatgggacacttcaggaagggcgctgtcatgaggacaggcttgaggacagagatcttggcctgtttggatggctagggaagaaatatcctggagtgtgagggtcactatgttaagtagtggcaagacaggaaattaaacagggtggaatgaaggttggggcagaatatagaaagcctcctcctttcggctgtgggaaaagaatggtgatttcttgaagagagaaagaaaatagcgacataatgtgtgggaaggtagcagtcggtgtgcaggatgctttggataaggagctcacggagggaagcagaacggattgtgagaccacatgacaacaacccagggatgaggcaacaggagcgtttggcggagtaggaaggcccagatggctgcgaaggaaaaacgtgtccaagaaaggaccgataagacctgttgactgcattgttgaggacaaagaagaaaggagccagacgcagtggctcacgcatgtaatcccagcattttgggaggccaaggcaggaagatcacttgaggccaggagttggagaccagcctgggcaacaaagcgaagcctcatctctacaaaaaaaataataataattagccaagcatgatggcctgctcctgtggttcccgctactctggaggctgagacaggaggatcacttgagcccaggagtctgaggctgcagtgagccatgattgtgctactgcactccagcctgggtgacaaagcaagaccttatctcttattaaaaaggacattacaagatgccaggagcccagataactgggactggtggaatctttgcagggtctccatatacagccacacatgccctgtggtggaactccaggggtgctgttcacatagaccacggtgactgtcccacctcctcaagtggcacagagacaacctgaaaacctgtgtgtagcagccttacctttgagagaagcagaaagttgaaaaaactatttgctttgaaaaaaaaaatttgtgtggttagcttgagaaccgttgcagcttgggggacagtgagagaagtctccagagtggagactgtacaggggcacagagggcccaggcccgagaggcagatttgaaaatcatcagcctacaggggctatcttttgctttagctattttaaaaagaaaactgagttccttagcgcattaggtaacagacgatcacagttggttactgtgcatagcggtttggtacactgtaggcaagcatgatgcacatattgatagtaaatcagaccccaattctctgaaaggatttttgaataaatggaacttaggttggaacttaaaaatcattccattttaccaaaaagcaatatatttaaaaaggaacaaaggaaacaaaagttcagatgaatgacagtcctagaaaactttctttgagatttcccccccttcctccctccttctctcactcaactttgaaatgaagtttctggtctttttctctgttccttacaaaggagcacaatattgaaaaagaaaacactatgcccactctcagagagctaaatctagtgtatgaaggggattgtgtgtgtgtgtgtgtgtgtgtgtgtgtgtgcatcctaataatttcactaggcagtagaacattttcagtgtgcagtttgcagtattacctgttcctcactggaggaggtgaaggattacaaatttgaactctggctggcagtcagtgtgaggcaggtagcacatgccactgggatcttcacgtgtcacagtcctctgccctggagatccagctgcatctcctcgtcccctagctgggatctgtggaaatggccatgtgtctggtggtggagaatcctcacgctgcccctttctttgagctctgggggagatgccactggtttttgtagtgggtggagaaatcaccattcagccttcgagcctttgaaaggaaagtagcaggaaaagcctttaggaacccaaagattccacatccattcttcctgtcctttggggtttgtcaatggcctctgcaggtggccccactggcccgtctgttaatgtgctgcttcaccttctgttctcttctcaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtaagaggaattccacctacagggcatcctgagttccaagcactcatgaaggaatatgaatatttcttttttcttttctttctttttttaaaaatttacctgaaaggttaatttccagttagccttcaggagctagttggaaactagccttttaggttgatctagatgagttaatgcgcccttaagaacacctgatttattagcaaacaaaaaccaggcacaagaatgggaattgaactcgcgaagggtagggctgtattgaacaccttgggctaggacaagatagcgacaagttacacagacacaaatgtcatttatcttaggcacttttatgttagaaagtttttacttgccagttggggcaacatagtgagacccccatctctacacaaaaaaaattttttttaattagccggacatcgtagtgtgtgcctgtagtcccagctactcaggaggctgaggttgctggaggatctcttgagcccaggaggtcaaggctgcagtgagctgtgatcacactactgcactccagtctgggtgacagagtgagaccctgtcttgaaagaaagagagagagaaaagaaagaaaagaaaagtaaaaagaagtttttacttggggaaaaaaaaaggaagcccttttagacttttttggagtctcccaactttacagctcaataatatgatccaaaacctaaaagaaaaaaaaattataattggtttttaagactctagccccttagcataaaaacaattttgaaaaagactaatttttaaaaacggagacatccttcccccaactttacactatttggtttgcttttcatttactccacatctctggggaaaccttgagagatctccacaaaagcaaatgggggtccttcctcacccagttattaaggggaatacataggaaaaaaagaggaggtagagactaagtatggggtgcttcactgggaaatatgggagtaatataaatgttgctggctcttcaggctggaatttaatgaaatatatttcatttctatatactgtgcatatatatatatatatatacatatatttatatatatatcttttcccaaagatgctagttcttcctttcattatccacccctgagcattatgtataaatatatgagttctgttactttgcccgtctcttcagaaatctgggaaaagaggattctctttctaaagtagtgtttctgcagggtggtctaaagactccctgaatcaaaattattcccagatgcctgttaaaaatgcaaatttctgggcctagatgcagccctaccaaatcagaatccagtgactgatgacagcttgcagaaatccacaaggcagccacctcccccaggtaacccgcatacacactcaagtctaaaagcagatgagccacccaactcccatgacacaaataaaagctagtaagatccgccatgatggagaaccatctatgtacttggccctgtgctaacgtctttacagtcattatctcgtttcatcctcacagcaaccacattgggtaagttctattactgtttcatttcataggtaaggaacatgggtacctagaagttaaatgacctgcccacggttgtcacagctcttaagtagaagagccaaggtctcaacctaattctgacttccagagccttagctcatactactacactacagtaagctctgcattaaggagaggttaactgagtacttgctatgtgtcaggtactgtgccagggaacaagagagacacatgtcttcatgaagttgacgctgaagcagaaaagataagcattcaagaaacaaatatgcacacaattagttaattgcaattatgctggtaatcttgtagctactggctaataaaaggcagctgaggtcaagtgactgagccctgacttaattgcaccttaaattcctcatcttcacagtagcctaaacatattcttctgcatagttacctccatcaactgcagcaattttctctcatctgcactcatttttcctgtgtcttgaattatgtaggattgtctcatgggaacagacttacaactgggcctttgtttaaaaacttctctaagctcccaaacttcagcgactgaaaattaaagtttcattttctttcctttttgcttttgctgctcagttttgtgtacccattgttcacttactcctcgctgaagtgttatctatttctgtaaatgccataagtgattacattggagtgcacttttactaaaattacagtttacgtgatacttctaatgtattatgctcattcaaatatattttactttaaattaccacaaaagaaaaaaaatgttctctcctttctttttcccttctcttctaatttaagaagctgaactatatggagaaacaattgcagtcatttataatgtggttttaaaatatctatatgaaaaactaacgagattttattctcctttacagtgatttctgatggtagggattaggggttggtgaattttgcagggataagtctattataggataaaatagttcaaataagtttagcaaaacttaacacaacttattctgtcctggtttaacaaaactaggatgatgtcactaattgcacatgagaccactgttgatttcacattctattgagagttgtggaaataagagaaccatcacagaaggtagaccctcacacacccaggatttatagtcagatggacaaaagttcaaaaccaagcggttcactcttccactgcctggtcttatgaccttgaggaaggtacctccttcaagcctttatctttaaggggatttgatgaagataacataactattaattttcttttgaaaatttcccctttctttgtaattaaaaatgaaattaaagtattccttaaaataaaactgcctaacgataatatatgtagtgaaaatcactttttaacccttttttttttatattgctttagaaattttactattcacctgtgcatggatttgccacctcatggcaaaatgtaaagctatagactattttttgaaaatgttataataaagttaatataaagatttggaatccatttacttattatagggaaacttatcaaatacataaaaagacctcacagcatactttgttttactacgttattaaaaggcttataaaacccttctaaattgtaagactgacaacaagatttttgttagctaagtgttagattaatatttgttataactagcaaagtatttttaatacatatctaattcagctatagatttcattgtacacagtataattgtgtatgtagaacttttagcgttttttatttttaattcttatagaacagcataaaaatgtagcctggtcttaaggatctatattgattgtatgaatgatttatttaactctagtgtttggttgggttaaagtattttgatgagaaaatatgatttgacttacagggatgttttcagccacattttaggtgaaaactgggcattgacccaataaaaaataccccttataaatttattgttgtatttaactaaagtttttccccccaaattgatcatgcccatgattttacatggttcttgttgctttactggttgtcatgcctggtacttaataattgtatggacaggtggacgtcagagtggatgagtggagtgagtgagtgaatgagtgatacttctatgaacagaggacagagccgcctggcaagcccaaaacattcccaactggcctgttagacggagttctcacactggcctcagtgtaaacttcactgagcagtgggagaaagtatgatgcttctccagatgggcttaggcatgggaccactgtgtatgtatgcgtgtatgtgtgtatgtgtatatgtatgtgtgtatgcatgccatgatggttcatgactaaaggaactttttgcttaattaaaaaaaaaaaaattaataccttcagtttacacaagtcaccactagatggcaagcttgtacccttagcaataaaaaccatcagtagcagcttgtgtttctttcaaggacctgggcaggtctttcaaaaatgtgtacacagatgcctcctccttatgaaaattaaatctttactaaccaaactataactcacatcactagtttttattagattccagaaacaaacatagtcgttttcttcaaatataaacattcaaaaatcttttccctcccaaagtccccaagaccctgcaggagaaaaactgcctctccttggctagaaactctgtgttcaagtgtttgtgcctgctcccagctgcccatcaaaatgacacgtgcaactcatggtccttgttttcacgcagtggattatatctagcaataagctagtcctgttccacccaaatgacgatgacaggttgtgctccagctcttcctagttttcaattccatgctcacaagataacatatttccttcaccttaatcccatgactcttaattctccaaataaatccatttggtgataggatagctaactgcactggtggacaagatgagtgccacagagagaatgggtctagaggtcatggacaaaaacacagaacttgagccctcagagtgtattgactaatggattggaggttacccaaaggaagggagccagtgatcttctgtgagtctggccccaatcctgccctattcatcattaccagtgacttcaaatgaagatgaattataccaatgacagaagtgaaatccaaaaatatttttggctctataaaggtccaaaactggtaagaagaaattaaacaagagataaacataaatccctagagactaagttagttttggtgtagttgtgttattgtcaatttcagaaacagtaatggaatacttggcctgactgcaggtcaaaaggctattagttgacctggagaaggctgttcgttcagtgtgagtctcagtatgacaagcctgctaaaaatattcatatgcccttagacttctttccctgaaagagtcaggagagtccttggtgtggcttaccatggtaccccttatggtaatactctgaacacattctgtctgggcctggggttgacccagagaagggatgtaccacttggggcatggtgattctcatcaaatataggaaaggctgccacatggaggacgggataactttcttgtactgtatatgacagcatggaactaaaattaaagagaagatattagtgggcaagagatttagggttaactttagaaaaactttttaataatctaatttctttgaaatttaaatgtcctttattactggtagcttgtagtcattgtgagtgtccgggcagaaactgaacgatcctttttttgggggtgtttagaaaaaaaattctactctctgaatttgcatggaagttgagggaaaatagaagacgcaacattttcccaaagcattatttagtaccgtaattggccagttactgtactaagtgtttactgggcctcttgttcaaagacctgtgatttcatcagggagatgaggacaggaaggaaaaggtatccctttaagaagacattgattttcaccttgtgtcaccttggtgggtctgtgtttgtctaattcactgctcctttctgctgtcattaagagatgacactcatttctttctaaaatggcacagccttatcagactagcaaaaattaaaaataacatacaatgatggcaaagttaagaggataacagttatctcatatgtgttggtgggagagtcacttggtggaacctgtcagagaggcaatttggtaatatataaccaaaaccttcaataacatgtgtgccttgtgaccaagtaattctacttctagaaatgtaacctaagaggaagaaactggatatgtagctatccagagggatgttcacatcagggttttgcagtatgaggaaaaaaaacccaaacggtatatatggagataagttatctcagggcactgatgaattaaatagtggcacaatggtggttagaccaccagtagtggcaggacatcctggttagactcttggactcagacatatctgagtttaagttctggccctgccacttatttgctgtgtaacactgggtaaattactttacatcttcgaatctcaattttctcatctgcaaaatatgagtaagagtgctaaattaatagggctggtatgaagatcaaatgggccaaaatgcacatgaagtcttcatcacaatgcctggtatgtcctgtgtgtacaataaatgacagtggtaatagtaactgttgggattactaatatggtgccatatggaatatcctgcagccactgagagtaattgtatagatatatgcgattcacttcggaaaaacattcaggatatgttgttcaatggaaaaagaaggataggaaggagagaaagaaagctctggaagtccatgtcccaaaatatgaacagtgtttatttctgagtgtcaagattatgggtgagtttagttccttttcgtctatagtgatcattttcctactatgacatattggataataattgtgtgacagaaatgtaataacgttttttaaaattgcagtggcattgagttcccacagttttggcaaaatcctgggatgtataattcctaacagaatccggaatgtgcatgttttgtgtatctcgctgcagctgcatagaactccttttaagatagtttcatgactattttaaattgagggtgagaatcaggtttcctggagtttccgttcacttctccatcttcccagatatctccagtgtaatattgaagagcaattttactttttagtttaattacctctcttctgacttactcctttctaacatctgcacaacattcattatttttattatttcatttaatttttgatttcataaatattttacatgtaggtataaatttttttattatgtttttccaggagatttaattcaaaagtacatgggccataaaatgcattctataaaataactccctgcttaaatgttgttatatttcatttcttaaagattaaagatttaaatttaagccattttcctcagaaagcatcataaaggccatataccgtagcaagaggaaaatcaatgtctttttaaagggataccgtatatgttaaaaagtaaattgacgttttttcatggctttgtcaatttcatgccacttttgttcaattctatttggtgaaataatttttagttcctactgagctcctctgtgaaatagttttcagtggttactaataattcattagccaacgtttcatcagggttacccttggattcgtagaaacactgagaattacgtttgttccaacacatctgttacattagtcagcttttagtgccatattatgggaatctcagaaaccttttgactgggttcaggttatctgtgaattttcatattattttatggccaccagctgcattttatgactatatattaaatgttttattttttcaaataatttttccaaatggtctcagtttcccatccaagggaaatcaagcatatgcctaaagatctactgttcagtaagttgtagctaatgcaaaaccccaaataaacaaaaaagaaacaaaaataaaaccctcctttcaaaaacaatcctgtgcaaaataccagtgtgccccaaaatctacatacctgacctttcgttatatctgttcttggttggatatgccttcaggttttaattggaacctttttcataattgttgccatttaacacatttagtctgtcaaatcataggatgtctttatagccatataataaaccctagagaacaacttctccgactgtagccatctgcaatgatcccaagagtagcttacaaaatactgacagtctttatggtaatatgatacatatggcagcccacaattatgtgtagctgcattcaattagtgttgtacaattacacagttttattgcttagttaaaacagtgaaagcactacatactgggtaatttgcactaatccctgtccctttaatagcccctcagtgtttaaaatgtgggggaacatctatagtacttaaaggaccagggatgaacattaaatcatacctcatgttgtgaatactccttgactgacaattaatgtactcccacttcacgtgtgggtcacattttatagaggctttaaaatacagttatggcaaaaagttcttacaccacagctccactagctggaccagcctgtccaagcctgcgcttgcagcctgctcatgccctttctgaaagatggtcagaataaggaggaacgccaagtaacaagtcaatccagagagcagtctaagccaaggatttggcattttcaatgtgaacttgttagaagcctttctgatttctaacttttaattaaaaatttagttcaaagtggatttatggctgccatttggaataatactttctggagatggttttgtgaggctgtgtgtgtgtgcgtgtgtgcgcgcgtgcaggctttaaatgggtgtatttagcaatctgtgattttttaacaaaggtttaattatattttcacatggcctcagtcatgcccctgtgtaactggctcagtaagagataagggtgcacgtagctcaggccgtagcaggtgctaatgaagagtccccgttgagagagggcttcttaaaccactgagggaagggctctcccactggagaagaaacactgaagtatattcttctccatcctcctcccaaagtgttgacagagaaaaaaaacagagtgaccttgtttcctgccctgcctgacagtgagttaaacagaattccaaactagaggactggacatttattcacctgcaaaaacatttttttttgcagcatttcaaatgtacttgtgtctagatatggtttcaattacatggaattggcctttgtctttaagctcttattttctctcctgagtgtcccttgaacctctttatgttcacaaaaatcctactgtgtggtttttaaagcaaaaaaaaaaaaaaaaaaagcggggcggggcactgtgcaagtgattaaaagaccattgtacagggaataaaaagaacatcacaattatggttctatgtacttcaatggttttcattttcgtagacttattattacttttaataatcattttgtattagtactcattttctttattttaaggaagatttttagtgattttttcttagttattgaaactttgaactatattgttcattcatattaaatataattggtctatggctatatgttagatggaatttctattaaaatgtagatgttcgaaaagaaaacttttcctacatgtaggagaattacaaggtcatatttagaactaaaatgggacttatgactgaatccaccaacatctgcttttgtcaaacttttgagtacagttaggtggtgtagatactgtgtttaagaaaaaagctacaaaattcctgcatcaagtgggttgaataaattacaatctgcatcacctcacaaagcacacagaatgaatgtttggacctagcagaacatcaaagcaggagattattttgcattttagaaaggttattgttaacaaaatggaattaaggaagtaaacaattctgctctgcctcggaaatcaacgagaccatctactagatgtttccatctcagatttcttttcatgaaaaacatttgcttgtcatttggatgaccagaatggctgacgtggtaagactacaacttagggttttcttttgcctaagaacagttaggctggggccgatgttgtgttttgcagctgtgatgcctcaaagtttttaacttaactctaagtgaccaaggctggacagctgcttcattaagttaggaagaaaatgtccgtcccagatgacagctgggcaaagccacatctgtgagggacatatggctgtttttgccctaacaacccaatcacaggtgacctcacaaatcttcggatacctgccagagggcagcccaaacttgatcctgatcaacagctcctgggaataagactccatgctatgagtgtggagaaaatgtaaaagaatattttctgctcagaaaagatgcagtctttcagataggtggatctgactgcctgcttctgccaaaactgttggatccaagtgatcattgctgatattgcagcttagctggccaaacatctgcattttgtgttgcagtgaaacgcaaagttaatctactttttccaaaggaaggcagacgtgacgtgtgaacagtagcggtgcccctgatgtgtggagatgtgccttgctgtgcaaaagattcaaactactgcagcaagtaacagatgatcacagagtgagaacaggagaatatgcaagcctcggcttgctggatcaagtattttgatgtacatggaaaacttagctgcttccttgaggcatttcgtgaagattgcccttgctggaattactagccttttactgtggttttcttttcttaatcttattcattccaacagaggggactcaattaggattctgaacgccctttcatcttttctttgaaataaaataagttatttgggatactttttagagcagctccatttgttttgatcgtggctggaattaaaggagtataaatacttgcctacagtcacatgcatccttttcttgatttgttgggtgaaagagagaagatttttactgccttaataagggaaacctggacaggatgctgactctgcacctgataaatctttccaaattgccacaggtgaaatgaaatgttaatatctctttcaattattaagaaatgtaaatagatcatgttgaaaatacgaggcactgaaaataaagtattttactataagtatagtttttttgtatttagttactaaagaattgcatttttaaagtttctttctttttttttttcagacagattttcgctcttgttgcccaggctggagtgcaatggcttgatctcagctcactgcaacctccacctcccgggttcaagtgattctcttgcctcagcctcctgagtagctgagattacaggtgcccgccaccacgcccagctactttttgtatttttagtagagacagggtttcaccatattggccaggctggtcttgaacccctgacctcaggtgatccacctgccttggcctcccaaagtgctgggattacaggcgtgagccacagctcccggcaagttttcttaatatattgaaacaaagagattattttcataaatcggagacactgcactaggggctttctatacttcattttattatgcaaatcagttttaattatagacaacatcaaagacagataaacaaaaggattaagaaaacctgtaatcctaccaccaagagacagatacatcggcactgtgttctttcagactttttcttttttttttgtatgtactttttttctttaatggacattttataaaaaccaatctgaaaattgctctgctcatttcccaaacataattcaataactataaacctgtatcgccattttaaggtcatgtaacctctcgttgtatgaatgtactataatttatttaatcaatttccatttgttaggtgttcaccatgattccagttttgcagtaatctaaaggaagtaagctattttgtatgtatatccattcttgcataattgcctaatttattttttacctcctatacattaaatttaaacacagtgttcctcatttcttcaagaaagggcttttgagctcttggttttcagacaattgtgatttttacctttgttttaggtgtatgagcaccaagatggcagcaaatcactgaagctgggtgactttggactggccaccattgtagacggccccctgtacacagtctgtggcaccccaacatacgtggctccagaaatcattgcagagactgggtaaatgcttctcttatgtttaagtgctatgcttgcaaaagaactagcccgcttcgagaataggaaaaatagtactgctgtgccctatccagacataattagctatcaggtttcttccactctttttaaaattgtattttattctttaacatttacagtgggagccattttctctgttttcccaatctgttttgtcaattactgcaatcttaaggcttccatttggtctttgttaaaggtagaacagaagttattaaccccagagtaaaaaatgttcagactaacagaaacacacagcgatggtaattaactctcatttggagataaaagaaacagacactgccgtgtgcggtgattacagtctcctgcagttatttctctctgctgcccttatcctccagtccaggtcccatttgggacctcttggggatccattgattttccgtggagtacaaacacccttaggcatcagggaccattgggaatttcctggtttctgtgtgcagaatcagatgaatgtggggagaagggtggggtagcctattccttactaagaccccacaatatgctaggcctgaaactcctttacttcttactcttccagtcgatggtttgattcccattttgcacttcaataaattgaaactctaatgggttagataccatgcaagctcatgattagttttagtggttgagtcaggatttgaactcaggtcagcctgagtcaaagactcctttggtaagaagccctatttcttaccaagggccataggcaggctctgaggtgccatccttaagcagaaggaataacagggtggggcactgaggggaggcagccctactttttcttctcattagcagtttcagtccacagctgggaatctaggtggcactctcccctgtgaccagttggagatagtttttcgaggttttgttttgttttgttttttgcttgtaccatagaccacaagggcagaaaaaccaaatagatgagaagggaatcccaatagggaaattcctgaggcgagatgtgagggaatgaggactttgctacttggcaaatttgaatgaggtgggagcccacatccatagccttgtctgacctccctcaggtggggctgcctggggcacagacacactttctactgggacatgctctgcttgctgctgggaggaagtggtgggtcttgaagaccatattggggaccagctctgacactaactgtgtgatcttaagcaaaattactcacccatctgaacctgttttctctcttctgtacaataagcaatacttgtcttgtccaacctacagagttgctaggaaaacaaagtacgatcatgtatgtcagtgctctataaattggaaaacgttctagaaataattattattcctaaagtgagggagtttatctcaagggtccatccttatctcagaattgttattactataataaacctttttgctgaaaaccttcatttactgatatttacaaataagtccagcaatgcattcctttgatttttattcctgcaccttggtcttttttaaaattattattttttaaactttttctttgaactctgtttaggtggtgggttttagtttagcgtttgttgttgggattgttattttgtttggttttatttttggcttggaggaggaaagtcattgattttaccaagctgcataatttgtccgagcctgaccctcctaactctaacatcccttatttttccagatacggcctcaaggtggacatctgggcagcaggtgtaatcacttatatcctgctgtgtggtttccctccattccgtgggtatgggcaacaatcttttattcagcgccgacaaagcatttctctactctctgagtgatccattagcccttcttgcacaaaggagcctgcagcaggaaaagagcacaagaactttacttgcaatccctgttattttttccctgttatgtcatgcatgctaatttatatgccttccatatttcttccccatatcattaaaaactcattctttctttttttttttttctttctggttttgagacagagtctctcttttgctcagtctggagtgcagtggcacagtctcagctcactgcaacctctgcctcccaagttcaagcagttctcctgcctcagcttcctgaatagctgggatcacaggcgtgcgccgccacaccagttactttttgtatttttagtagagatgggggtttcaccatgttggccaagctggtattgaactcctgacttcaagtgatctacctgcctcagtctcctgaaatgctgggaatacaggtgtgagccgccgcacccggcccaaaaactctttcttaatttaccaaaacagatccacattgacatttttcaatcgattaaaaatacacatttttacacatttatggggggaaaggaagggctccagtgcctaagactgaaaagatgtacactgagttgatatcttagtgctgtttttccttgttgtcgttcacctaaacagaagtggtgatgaccaggaggtgctttttgatcagattttgatggggcaggtggactttccttctccatactgggataatgtttccgattctgcaaaggtaggtgtccagtgccttcctcttccctatattctgtgtgtcttaacggaattatttttccaaatcattgtgtgcaaagaaactaatgacatcataagtatgatttctgtacacattttagttgtaattgctaggttttccaagatttcacagtcatcaagtcatctgttcccagacatcccaacaagtacttatcaagtgtctccatctgctgccttcatctctctcaggtgccattccagtgacattgctatagcctcttgctgtgccccaccctcgccaggcttgagcccagctcagatttctatatggcctgtggtttcacctctctcagctcttgacttaatgacttaatttcccagtgaagccttcccagaccatcctggttccaattgcatctcttaaaccttacctggcttgctgtatcctacttgtctgttttatttttctccagaacacttaacacctgtgtgtccatctggtgtgctatctaactacctatctctctacccaaaaaaagatagatataaataagtaggcatgtcttctttatatagttcatttccagactctctccactagaatgcaaattctgcgaaggcagggatttttatctattttgtccattgctgtactatccctgcctaaagtatgaccagcatactggtgctcaatgtatactgaataaatgaacaagtatatgaatgaatccatcaattaatcagaaggaagaaaactcaacctcaacgtaggttgaaatcatcaagaaagactttatggggaagctatgatttaagttgaaccttgaataatagccaggatttagaggcagagggggaggaaaacacaaggttcattgtttttatcccatgaaactaaaagatcagtccttaacatggatgaaggtgatggttgcacaacaatgtgaatgcactgaatgtcagtgaactgtgcacttgaaaatggttgaagtggtaaattttatgtatattttaccacattaaataatatttatgataaatcaacttctaagaaggctataaaaatcttacattgagatgtttgtagaccttgaggagaaaaaggaaaaccttttcattgctctttttaaaatttatgtctccgagtgctgacttaaatgtttaaaaatttgagaaaaatgttctcaataattatcttgagaaataattatcttttgattgctcaatgtttatgcctttgcttttgtcatgtcctgaatgtgagttccctttaaaagccaacccctcagacatgaccactttgtgtagaaaatgatgcatattgagtgcaagtctctcattttcttcaactgtccaggaagctgccagaaagggagtgtcagagaaaggcgcaggctaaaggagatgggacgatacagctgcagggccgggggctcttcaggaacctgtccagctccccatgccatcactgcaggatctgagggctcacagttactgacaaataggaccatctcctacacctccatagcacctgcaaagggcatcacacacagcagatactttcacgagttctgatccaagttagaaactgaatgaagaaggctgagtgaactctctccctcaatgaaattaaatcacccccttcccgagtggtactataaagcctgtgtatgtaaggaactggataatgcatatctaaccattttgtgacatgggaacttctaatccagagtggacaattgtatagcatactcatcgttaagacccaggtagagcattcctggtccaagtccatttgagctcatgaggaagttccattaatttcaggatgatgaaattgtttacctctcaatagttctatttttctttgtattgatttgtctggaaatttttcaagcaattgtaacatgtttctttagaattctttagctactaaaggatcaattctatcttgccacccagaattggggaaagacccaattctatgtctttcctcatacctttctttcaaacctaagtatgccgtcttgaaattagggggaaattttcatttttcctttcagctgctaaagtgaaattttaagtaaagtgtttttttaaatgtgacttctatattaaactaattaataaatctgtctttaacatgcaaaatgctagacaaagaaaggaatattaattccttaacttgtataatttcttttctattacaaacatttttatgaaaatgattctgatattaatttaatttttattcaaccacaagctatgtatttacaattccaagtgcttaccatttttaacttttgaaggtgataaatagccacaggtaagtggagttgatgtatttaagatttagagcttttacaaatgcttttcgaaactaaaagagaactcttgcatttgcacacatacagcttttcaccttaaattcagataaatggactctaacgttccccttcacaggagctcattaccatgatgctgttggtcgatgtagatcagcgattttctgctgttcaagtacttgagcatccctgggttaatgtaagtgactcgcaccatttcctttgttctctcctaacattccttttaaaaatcagttgcagattttctaatgttattgcctccttttgaaagtgttgtgggccaggcgcagtgtctcacgcctgtaatctcagccctttgggaggccgaggtgggtggattgcctgagctcaggagttcgaggacagcttgggcaacatggcaaaaccccatctctaccaaaaaatacaaaaaattagctgggcatagtggcacaagcctgtggtcccagctactcaggaggctgaggtggtaggattgcttgaccctggaaaccagaggtggtagtaagccaagatcgtgccactgcactccaacctgaatgacagagtgagacatcatctaaaaaaaaaagaaaaaagtgttgtgttccattttgttcctccccctcatatgtgccaggacagttacaggatcttatacttgttccacgagggcatctgatgtatccattacattttattctgatgagactgccttctaactggtgaggtgccagtggtctcaatcttctaccccgcaacctgctttctgcggtccagattagagctgaataatcatcaagaaggcataacagactttctgagtcagtcctgctttttgcatgattcctacccaaagtgcaagtgacctaagggtttcgacataaaccttgggctactccatttcagcacttctcaaacttgaatgtgctcacaaatcacctggagagcctgttaaaacgcagattctaacacagtagattggaggctctgcatttctaaaatctccccgatgctgcctctgtggctgttctttgagtacacgggtctaatgatatttcattaactatgaaggaattctccagagcagagtcattattttttaattctgtgtttctctacaaccgatgggtgaaatttgttttgattaataatactcatagttggctgggcgcagtgcctcacgcctgtaatcccagcactttgggaggctgaggccggcagatcgcttgaagccaggagtttgagaccagcctggtcaacatggtgaaacgccatctctactaaaaatacaaaaattagctgggtgtggtggtgcgcacctgtaatcccagctactcaggaggctgaggcacgagaataacttgaacccgggaggcagaggctgcagtgagctgagattgtgccactgtactccaatctggacaaaagattgagactccatctcaaaaaataataatagtaggctgggcacagtgactcatgcctgtaatcccagtactttgggagcccaaggtgggcagattacttgaggttaggagtttgagaccagcctggccaacatggctaaaccccgtctctattaaaaaaaaaaaaaatagctaggcatggtggtatgcgcctgtaatcccagctactcgggaggctgaggcagtagaatcacttgaacccaggaggcggaggctgcaatgagtggagattgcaccactgcactccagcctgggtgacagagcaagactctgtctcaaataatagtaataataataatgcttgtagttaatactgatagaatgcttaacttctagagtctgccagaagtattttaagcatcttatataccttaactgtgttgtgtttgtacttattgtgttcttcccaacaacattgtaactttgtaatctagtttctatggtaatccccactgacagatggggaagctccatcactaagtctaatagttcctactgccagaatagaagacagatataggcttgaatatatatatggacgtggtcatagaggtggacaatcataaaattgtcagctcattgatataaattttaccagcctccctactgcactgaatcatctggctgtacattgaaggccacaaaatgttccatttctctgaattgccaccttggtgagtagtcgagtgatttgttttgttttgttttccaaaacaacaaaagcttgaggtcaaggcatgattgaaagcacagtcaatgtgtcaggtgactacatatggggggacaagaacttgggatctcattcatgttgtgccactagatggccataggtctagattccagcattctacatgtctgaatgtgattcttcacactccactgggaggttatatacaaataacaggagaatagacttgaaaatgagcatgtagagctatgcactgaggtttgttttaaggcttctcatatagcagagttttctaactggtgtacagacatgcaaaaatagtaatccccatggccctagggacagggggctgtacagccagtatccaggagtggtcacttccagcctcaacaacatctgcattcaccccagggtgctaagcaaaagttatccttttctatgaagctgaaaagattaggaagcatcttacttgagcctcataacaagcctacaagataagcaggatgggtattattgtacccattttacagatgaggagactaaggctatgcagggtgattttctcaaagtagccaagcttgcagttgagccagaatttgcagccagatatcctcactttcaccccaggtgttttaaagtcccatgcatcacattacatctaccccaccctttgttacacatgaaaacatggtaatgttgtaaacaggcaggtacaatatggacattgtcatcactgtaatgattgctaatacaagtcagcaacctttccaaactcacttacccaggtcatggtacctttttcttagctgtgcggggaggaagaggcacaagccagctgcaggctctctgggtggcagtggttggttctgactgatccacatgttaatgctgtatgacaaaatgctctgattcctagtgccaaaggttcaattcagtgtatataactgaacacactcatccatttgtgctacttttttttaatgatgcttaaagagctcatcctttgcaagtcatccttgttgttatttaggcattttatctttgctcaaattgttgaagaatggtggcttttttcatggtttttgtatttgtgtctaatgcatgttttaacatgatagacgtaatgcgttgtgtagctagttttctggaaaagttgatcttttaggaattgtttttcagatcttcaataaattttttctttaaatttcaaagaaaaaaaataaaagcttaccatccataaattgtcaaattgcatattagctctggagaaactgagacagggtgaccacacagaagaaactagacaatctgaatttgacatgtggccttaaaaggctcctgaagagccatagaggaaagatattcataggtgacaaataatcattttactttttttttttttttttgagacagggtctcactctgtcacccaggctggaatgcagtggctcaatcatggctcactgcagcctcgacctcctgggctcaggcaatcctcccgcctcagcctcccaagtagctgggaccccaggtgtgcaccaccacaactgagcaatttttttgaaaaattatatgtagagatttctaaatacatttttatcagagagacactgtgtgccagccctgccttctaggaacaaagtctgatacaaccagacagttccagggtagtgagaacagcttccccagtctgctctgtggggagacttcccagagcccagagaaggaggtgccagagctcaatcctggagaagactgggaagaagatatctgacagtcagttccagcagaatgtgcatgtttgctagaagataactttgtaaatgtgagcaaatttgtttatatacatgaggggtctggaatgctgttgggaacgacatgaatcttcccctgattccagaccaaatggccctatattaataatatcccaactcaactgtggtaaagaaacaaaattaagaaggcttctggctgttaccagtgaaaaaacaggttgctcattatggcaatatatacgtgtctcagcagtaactttctgcctcttctacctggttttgtgcacagttttacacatggtcccactttgctgataattatgttccattgctccctctggaccttagacttctgctgtccatttcagtttttcctctctgatttcctacaggcattttctaaaagcagggagagaatttaagtaatcatctaggagatcgaaaactaaaaaaaaaataccctttctgtaattcaaacagacttaccatcctagaaaaaaaaatggtcttaataaaagctttttaaagactcgattaagtgagtgcttaacttttgaaattatctttatgaagtaactaaatcagaaaacggattttttcttcatctgaaaataatcaattgttaaaagtaagctttcacaatcagcatttagcatttgttgatgtctccaagtacaacaaatgaatggccaagcaaatgaaataaataaattagggatttcaaagaatatccatttagtaagacattttgcatttggcaatcaaattatatctgattaccacaaaggagagaagggggaagaaaagtactaataattatgtgaaccgtaaggacgttgtcaaaaagcactttctctgctctcattagttctaattttctctattgcttataccatgacttttttacttggcatacttggaattgaaaaggcagtcttggccgggtgcagtggttcatgcctgtaaccccagcactctgggaggccgtggcaggtggatcatttgaggccaggagttcaagaccagcctggccaacgtagtgaagccacacctctacttaaaaaaaaaaaaaaaaaaattagcccagcatggtggtgggtgcctgtaatcccagctactggggaggctgaggaatgaggatggctcgaacctgggggcagaggttgctgtgagccaagtttgagccactgcactccagcctgggtgatggagggagactctgtctcaaaaaacaaacaaacaaaaagaaagaaagaaaaaggaaaggtagacttatataaaatagacagtaaagcatagggcagcagaaaggaaaacctactccgcaaaagtcacttgttttaacctcatccaggagcttcctctaagttcacctttatttttcacacgtcctgggtccaaatcccaccatgctctgccgtattcttgccctttgctctgttgttgaaagagtcatgagcgaggcctctctatggatggttccaatgagccacatgaacaaagccatcgtcagtaagcagccacgtctggaagaggaatgtagacccacgggaggagcatcagcttactcacctgtgtgaccttgggcaagtcttttctctcctttaaacctgttttcctatctgtgaaatggagaaaataggattctcctctccacttgctataaggatgggaaaaggatcatatagttgaagagtctgagagggcaatcttaagtcctagcaccttgtaggtacttagcaaatatttggtgaatttgagtctgagccagatgacaactgtttcatccattgctatgtgctcatgaaatgcaaattgtgattaatgttggtgaatgagaagcttgattaaggaagaaagactgtcatcccccaacatgatcctgtttgtgtgtcacagatccagatagataatatgtgtatcaccagctctgttactttctccagcatcacagctactttgtttaatgtagttacaaaataccaacaaaattatcccaactatgtttccttaccctattacccatctagtggagaacaatatgatttaggcacatttattataatataagaataaaataggcaataatatatcttgacctttccaggaattagaaagggggttgagtcactttccccacaaatgacggtttattgatagaaaatgtaggttcatgataagttcataaacagaattgacatttccagaaaaaaattcttatatataattaggatcaaattatcatcattgtgatattttaaatatattgctgtcattccatttttattttcaaaatgctcatctaccttatcccgagttattcttctgatactctaggatgctataattttatgaatctatgttttacatcaaattattttgccaatttaatagattaaaaaaaaactgagggccgggtgcagtggttcatgcctgtaatcccagcactttgggaggccgaggcgggcagataacctgaggtcgggagttcaagaccagcctggccaacatggagaaaccttgtctccactagaaatataaaattagccaggcatggtggcacatgcctgtaatcccagctacttgggaggctgaggcaggagaatcgcttgaacccgggaggcagaggttgcggtgagccaagatcgtgccattgcactctaacctgggcaacaagagcaaaactctgtctcaagaaaacaaaaaaaaaacaactgaggctcaagcctgaagcccactggagcctctaatacaggtctgatgcctgggttttgcccccagacattctgatttaattggtttgcactggcttcctggcatcaggacttttaaaagctcacagatgattataacatgaaatgaagttcaagaactttggtactagcagaacagactggtttaaataaatcaaatacagttatttagccaattcaagactttctatcaccttcctggcctttacactttagtttacctcctatatcccacctacatactcttttgaaaagattctgctaagtccagatatccaaaaagaaaaaaagaacaagggaaagaagaaaaaatagaagcctggataatctcccaagatattccatgttgactaataaaactcagccctacccacacacacaaaaatgtaaacattcatcttattgtgctggtagaatttgttagcaattaagtgaagcccaatgacactgcaataatatataaaaccacttattgatattcacaaattttaaacgatgacatggaattgcagtttccatatgggcattttatcctgtccttgctctaagataaatctcaacttgccttacattttctcccaaagtgcagtgtgaattgtagacagagaatcatagggccatgctgaagagagtcaaggggactgggggtgccgtgcaggtggggatggttaacaggagtcaagcacactgggaggtgcagcggaactgctattgaagagtcctttaataaccttggaatggttttaaactacgtgggaatattttagcagtaaactgctcaagactgccatgcttctcctgagtttacagatattaataatggagtctggcaatgaatagactgcaaaccagatccatgattcaaaaccaaaaatccgcaaggggatgagaattttttaaagcatgacgcctgaaatggtttcccagaggaaagcgaggaattctacactacagagtgacttcacatccgttcccccacaagcctccccacagctcttccccagtaacccctagagaaatggagaccaggaggccaggtctcctatggacagtggtgagagttcattttccattttgcaaactaattttgttcgtgtcagttgcaatgctctgccaagtggtggatgggaatttctaaatcaaaaactactaacctcaaaccacaaccagcctgtgtcgaacttcagaaactaccaccaaaccagaacgtatggtaataataccgtaactatttgtaaaatactgccagatttgtcacgtttagaaaattcgtagcacatttttggcacataatctattctgaataatggtgataaagatgtatatatataaatttatgtttttaacgtccctatttattttattgatgcatgacagtaagttagctaaatctctatcatccatctgtatggcgcaggtacagattagagccctgcaaagccaattgtttaagtctttttatccaattatgctgaaaaccttcaaaatttatataaaaacactgcagactttttcattgtcatggggtgtgtgtgtgtgtgtgtttacatgtatgtgttttacctactccagctgagacaccttatttcattggaaaaaaatcctagaacgttttaagatttatgaagtcaaaagcctctctgacaacttgtttcgctacttgcattgcttcaatgtgaactaataacccaagggaagctcaaaccttcactggaatttaaagctggaggccttcacctccaggccccagtatctgaaagagttgctaggaaccttgacaggagattaggaccaggacagggctgggaaatgataaggaaatccattgtgaggtggctggagagcaaactcctagctcaagaactggcagtggagggaaagccaggtgaaggcaagtttctgaaaagatgccaatggtggggagtgaaaagaaggtggggttattcagcaagagctgaatctttctcagtaagttaattaggggctgctcttacgaaaacccagctatctttccccatatttacacctaggctggtaaacacagcctgtgccgatcatacggcaaccctgttggctccgtgcaactctatgctgcccagtgtcagccaggccttgctgcactgcttgctgcacataggatcctagagtcccggccctaataggtcacgttgacacatcccagattagtggacacccagtctccacttgacagagaatttctaactgtgttccactgggtccctgaaatgctcagcgtctcttttattgaccaccagatgattcccaggctccattaagtcgtgtccaaatattctctggtttgttcagcccctaattcaattctccttccgcctcaccactgtgccactttcatcatggaaaagatgattcactgagtatttccatttatcagttaagcagcccttttgtagctgatgccatgctagtgagcatcctcaattgatgcaacctggtgtgggaaaaagaacagagtttcaggcctggttcaatgctgactcaaccactttctagctatgtgacgtggagcaaatgaattcaccttgctgagcctcattttgcccatgttcaaaatgggactaataaatggactgaagtttgaggaggaaagagatcatacatgtaaacagcagttaacacttgtgtcaccttcctcgccctgccgtgctcttctaacttccctcccccgcacctctgctcgttccctctttgtttcatctttgcctcagagaaagaggtaaacctatacctccccaaggcaaaccacttcacttctaccctccgtccctaccctgccctttctcgtatctttcaactctcccttttcactagcttcttatcctaagaccacaattatgctcaagtttctttcatcctaaaaagaaaaacctttcctcaaccttctccacaatcatgtttttcaaagtatctcatcattgaaagctcatttgatcattttgcccgaggtagcctggaactctacaaagagatggtaagaagtacttgtgtaatcttgggggtgaggccagtagagcacccaaggtggcccctttcattctggcagaacccgacactctgccaagacatgatactaatattcagaagactttcagtatcattttatcccttgtcaaatgtggaaaaactgtcaaaaattctaacttagttcccaaacgctattgtccaacttaaattccaggggccttttgtttcattcaccagttgttgttggttttttgttgttggttttttttttttttttttttgagatggagttttgcttttgttgcccaggctggagtgcaatggcgcagtctcagctcactgcaaattccgcctccgggctcaagctattctcccgtctcagcctcctgagtagctggagctgggactacaggcatgcgccaccatgcccagctaattttgtatttttagtagagtcagggtttctccatgttggtcaggctggtctcgtactcccgacctcaggtgatccacctgcctcggcctcccaaagtgctgagattacagatgtgagccaccgcatttggcctcattcaccatattaataaaaacattttttatatacaccattcaattcacccttgtgtttagaactctggacgcataatcctaattctttgtaattatcatctgatttctctttcacttgtagagtgaaccaagagctggataatgtactataaaaataccacagtaaagggaaggtagtccttcacatttcttaaacttacagtcctcttattaaaaagctctattcctaatggagatgaaggcttcaattctgggatcttttgggtattcatttatggccagtcttctgttttttcagctttctctgccattaccatggcacataaactcttaactagagacaaactgtttgacttcttgtttggcagagatgactttgtggcttcccacttgcacacaccgcacaccaaatatcaccacacctcctctctgcctgtcaacacactctccatcattaagggccaggtcaagtcccatatccctcatgacgtcagctgtaactgttcacaccagaaaatatgccctttctcctctgaacttctttggtgaatctagctgagccatccagccatgcagccttgtaacagctccttttaatcttgttggcctgtttcatgattttacatagtgtgtgcatgttttgtctcccaattagcctgcaaggttctggtggacagagatcacatcttcctcccacactctgctattcctaacatagcccttgacaaggtcggcacttcatgtggccctgcttctgttccctccccaagtagcatccccactctactggaatttcactttgtttctaacaccaaaaaaatagaaatagtgcaaattgatataatgaaaaagcactgggggtttccagtaaagccattagaatggactgtgcttaacttggggataaatgccttggaacaggcccgttagacccaagttacgaagaaaagaaatggagcagagggtctaggagagcagggcccatgcctgtctttgctcgccatcgtttctcccccacgtactgtagtacctggtccatgtaggcatgcagttaatgtccattgaataagtgaatgcccaaatgctgaaagaaaaagcaaatgccatgtggagggaccagctcgtgcaaaaggagccagcacattatgcttgagaaacagcagacttattttcctgggtggaaccaagaaattacctgcaaaatgatggagaggaagaagaaaagaaaaataatgaatggcatcgaagtgattgccaggagtttctttttagcagtgagttacaaacactctattatctgttcattcatttattccacaattgagcatctaatatgtgccaaggcactatgctaagacctggagattctatagtgagcaaaacacagtctctgccttgaaggatcctgcagccttttcatcatgaactctagtaagtggtggcacatacttatgaccctggttattgtgattctaacagtatttagtacaagagaaccatgtgtccagcctcagtcatagatggctccagcagagaatagagaccttggttaaaataagctccaatataaactatgtcataataacagatgatttgaaggcagcaagaaagacttaaaatttaaggaagatctttctgcctggaaggctgcctggaattttagaatggccaaatgagtaactgtggaacagcctgagtttatttatgggccatgcagaagcccaagcttgccatccaagacccttggctttgggtctaaatgatgggttaagaggaaaaaaaaattaaaaagaagatgttcacattgaattttttttctggtcatctagattaacttgctttttgacatgttcctagagccgtggttggaatagattttattagaaaccaaaaacagaaatttttttttttaatttagagacaaatctctgagggtcagatgacacaaagcaaattaattttagagcagatgtggaaatgaatgagaccttggagcagtacttccaacaatagtgtttaatgagtagacattggttggtttatttctgacatcttatgaattctaagatcactgcctgtgactagaagatttagccttcatttttcatttatctcattttctttctttttctcttctctttatttctttttctccaggatgatggcctcccagaaaatgaacatcagctgtcagtagctggaaagataaagaagcatttcaacacaggccccaagccgaatagcacagcagctggagtttctgtcatagcagtaagcatctgaaatatccacctataactttttttaaagcaacccacctaagagacaggcattactcaggagattctccagtcagagacagcagaatgggtcatttctttagacagctcagccacttaatgcactagaggaggtatgggacttatatatattatgtgtttctgcagatcatttccctgggcatcacatcattatccaacacctccagggtgtcttgcagtatatattaattttatgatttatttatttaaaaccgaaaacctcccccatgctggactctgtgccaatgcaaacttcttggctctaagaaaaagagttcatagtgtccttttgctaggacctagaaaggaaaggcaagctgagagagacgacattgcagggagagcttggaacactatagatcttgatactagacctaaattaaagtcaaagcatagcagaaagctacgcagtgagattttcagtgaaattgaattactgtgaacacccaacgaagtcacgatgtcttgctccttagaaatttctgttcttaaagttgaaagtcttttaacatttactattttattgatgcgtctgcacaaggcctttcttttctgttctatacatgcagacatacactacatgcaatttgatcgcagctctaggcaaagattaaattgggccgaggaataatgaaacctcatacttcctggtgtcatattctggagtaaatatattcaagttccaattacttgagtttttaataaattcctctttttttcagagtgtgtaaattttaatagcatattcaatctgaaaatcacttgagctgtttttcttctccaaacaaagaatttaagacactatgatgtggactttttcaaaagtatttatgctattaaacagcacctctcactcatgagcagtactgaatatttaaccacttctctgggtgtttttagtttctttcctttttttcttttttggttgcgcgagagctctaaaaaaaaactgaagataaacaagtgatctgtttgatgccaccaatcccagatctgggttactgagtatttgatatgaggttccagaatttgcaaatggtacgaatgcatgcatacacaccctcgtactgtttgcatttcgtgtttctcgattgaaccctttcaatagtgatttacatgcgtgtgagcaactggcacatgtgtaaagtgaaagggaatgcctactcttccagatgttcctcagtgccgctgaagttttaaaatttcaagttgttcttgccctctatctttaattctttctgagaaaattcaatgtagaagtaaattaacctttacatcttccatagatggtcagtgttctttgttctgagctgatattcagtcagtaagttttgaaagcaacaatatcatagtgattctctactaaaccagacattctatactctgtttccattgttcgttcaagatatatgtctattccaaacatttgattccacagttttcttttggaatggactgccagcatgcttgtccatgaaagggactgtttttctcctgctaagggcttacagctgctagagagagtgcctttccacctctgtcattttgcttttgttttctttttttttcctggtcttttattttaatcagtctttggttaagtttgccttggttgctcaatatttgtttgttcacagtattctaggagtcttacaatgactaagggcaggaacgtcagggcaattttccaattgacaaacaccacatatttgaggggaaatcctattttaatcaaagttggataaattctgaagcgttatccatatgaattcattaaaacctcatctagctggatcttaaaacactcattagtatttgaagatcaaagatccacttttttttttcctaaatgtcatgattggaccactttgaatgcaattttgaatgcaagtttctcaattcatcactaacacggtttccatggaaactgcacaaactggtaatatacttacaaattgtaaagtgggctgtgtaatgctgagttatgcattggttgcatgcttgtttaatctttactgctgcagaggtttttttttttttaataattatcaacttaattcagattcaaaataattggctggtttcagaaaactgtatcttaaaaaatgcctgtcagatctatagcacaattcatatgttaactatcagcattaatatttcaagcataaaagagaatatcaatgtagatttcagagattgttttaagagaaactggtctaccatactatgtacatgaggcaccttctccagaatgcttttccctcataaatatctctaccttctagaagaacctggctgaggtcagtaaccaaagggtggggctgggaattagaaactggctattttggccaccttcattgtgatactttcagaatagcactggatacatccaattatattgcataaccattttttcattcttaaaatgcaaaggctgactatcaggggactatcacaagaaaaagaaaccctggcattaaataatattccaaagtatgactgccaagaaagattattctgctatgaagcaaaataagtgggaggtagaagaaaaattttttataaatggtatattctataaagactatttgataatttaataatttaatataatgattaatttgctcacatcattaaaagttcaggaattgatataatacagtgatgacttctctttgatagatttacaaaaactggtttcagcataaatttcattcaaacagaattttcctaggtatatacgctctccccagaggctataaaataatgtattttaaaccgcctttaccatgggactaattttttagaattacatacaccctttagaatgttttaaaaattattatttaggacatagtgttagtttgtggtttggtggcagttggggaatcaacaattaaataattaatttttaactagtacttctcattccttagttagaaacctaactacctgctggagatcaccaatgctcatcagagaatctgtgacactctttctttcttagaatgacaaaagaaaaaagcatactgtcataaccggcagcctctctcacaggtgtaatttatgatatgagagtagtttaacatgtactcatgttctgaattgtagtgttttttgttcatgttgtcatttttttcttctgcttcacagtctgtacattattaggaccaaagaaaggacaaatgacaactttatattaaggtcgcaagagggcctcgagttggctaggacagtaattaccagctggaggttcacagggatcacacaccctcctgaaggaggaaaggtgctctgacattaggtcaagccatgggattaggtggaaggcattgcattccttagaattgcagcattctgtgcctctcagagagacgccattgtccctctgctgcctttctcagtagttgggggatttgaaaaaaaaaagagagagagaaagggaaacaaaaggttattaaaatgcaatttatagacatgaaatgaattagagatgacattttaacggtgaactttttgagagctgagggaagagagagaggcattattagatttgctcagcttgatgaagaaccgatgactaagatgtcagttccaatttatttttcctcatttaacactgtttattattttaaccaataattttcctaatgctttaaagttcttcttttgcattttgctcatgcaaatagagcgtttcagtctaattgaacaaatccatactaatcagcatgcatataattgtgacactgggaagcttagttctaaaatgagacctgttatatgacactttgcctgtagatggcaatagaaagctaattactaagtagctgtctttgtggccaagcatacaccttcatcttcctgagagccagtatactttgatttttttctcaataaaatgaaacacacatttttaaaaagattaaaacttcacattgcattttatgcacacttggatagcctagtttataatcagagcacaaaatcctccaagcagtttttagtttaaatgcctggtgccctggcatgtttttgaaatgcctttgtgaatttagaagcagaaactgtcatcagcatcataccagtaacgcacttgaaagaacacatgagcccctctgaagaaaggtgtccaagtcgcatcctctcgtgggcagaatggggaagcgggtacacagcatgattagtgtccttcaggtttgggggattgaatcttttatccccaggtacccaaaagctaacatcttattccaggatgaacaactttgagaacttctcctgtcttctatttattgtactttgtgttaatcaaaagcacttaactgttcatatgcatttttattatacaaagaaaactattttttgttttatttcactttccatattttcatagagaaaatttattgactgttttatactctatcttcttagtttagaaatgtaattaagattcacctttaattagatcatataccttttataaaaaggaaaagaaaagaaaagattcacctttaagagtagctctgcttttgaagattaactcagaaatttaaatgctgtaattgatgaggtttcaaaacctgattcttttcctctttcatttcatagttatgaagccctcaaatttaagccttatgcggtaatactctatggggtccaatctgctttctcttaagtggctaatgctcatttcagtactttattgaattgtgaagcattttctattctatggcatatgaagaggtgtttatatcttttgaaattgagaggacatgattaaaatggtcattcaaaaacttgtttgaagaactagatctatttgagcaaattggcctccaaaatagtcatgaggtgtcacttcctgcctttttgttgtcagtatgcagacttaggatattagctagttaccctgcagaagaggcatcgtaactatatatacatatagaatcaatgaagaacagcttggtctggagtcttaattctttagcacaatgctgatccactgagttgccccatttctctctgctcagctggaccacgggtttaccatcaagagatcagggtctttggactactaccagcaaccaggaatgtattggataaggtatgagatggtgcagctcaacagtcagtgtttccatggcaacgtgctggcagtctccattaaccagttccttcggtggataaacatgcttttgatttgttatccagtccatatgctgctttatcagtttcattttaatcttgattgagatgccacaccccctcattcctttttttcacccattattcacactgacatttgccagctttctttccattgcacatgctcagtatcaattttccttatggttaaaaggacagtatatttagtgctaatgccaaagcattttcctgacgttgctaattaaaacaatgatttccagtgctcttctgtcccttaacaaatggaagaacaatagcacgctagtgtgtgttctatagaagtatatactgtcattttaaagtcatcaagcccaaccttgacctgattagatggataacaatgcatttacaccttagtagtagaagcgcctcaaagtacaatgggctatagaatgcattgtgtgtgttggtaagcttgtgttttcaaattctccacctttttgttttgtttttgttttattgttccctcttccccctggaaatccctctatgtattagctattgcatgaatttatttttcaatatcttgtaactgtcagattatttagctggcttatctgctcaagcaaaagggattatgggaggtatcgatttttttaaaactgggttaagaattctatccaatcgttttctattccagtcaactgccctggcatttccttcaaggggcattgtttgtgtctctttaagttatccacaagcaggatggtttttgatggtttgagaaatgaactctgagaaattctagggaggctgttttcgccatcttaatgtttctgaagtgatctccaggtaacactccacatcttagtatttgaaaaaaaaaaaattccactggttttggcatttgttttttccaaactgtggagcctatctgtagtaagacagtagctgcctgatgttgtttcatggttagactgcaaagttttaccaaaaaattaaaatatatatgtatgtgtgtatatatgcacatataaagtatatatgttatacataatgtgtatgtgtgtgtatatatatatataatatatatatatgattttagccccaattgttactcctggttatttttctataatcagacactcaaaacatagtacataggaaagcagaaaggggcataccttgacaaatgattcagatatactaaaatcatgatcatttccaaatctgtttaaagcaagaaaacacccaaagctcaataaaattttctaaggtcattttgacatagaaggctatttgtgtcttctccatttataatgcatgtaggagttgcacattcatttatttaatttacctacataattggccttatggatgtagaaagaacttaatttttgaccttattttggagggagaagggtgagttaatcataatctgcctttgtgcagacccttcttttttgactttgtaacacagaagaggattcatccatcttttacttttacctgaaagaatatatacttccagaagagtgcacctatcaggaatgcacatctctataaattttcacaaactgaacatgcccctgtaggcagcacccagatcaggcacagaacattcctagcaccccaggggctcccttccaggaggggtcacttcacctcgagggtaaacactgaccctagagtccagccacattaattagctttggctggttttgtactctatagaaatcgaatcacaccatgctccatcctttttaaattatatgtctcctaatgtcaggaatattaaccagatatatatgtgtaaagttaatatacaattaaaaataggcatcaagtatatctaattatagttgtgcatatttgtgttataaaaattacacatataaagtcatctaatttcaaaaacctctggaaaattaaattactaaatttgtaggattaaggatgggaactaaaccccaagtaaacacaataattaataaacgtagccaactataaaaaggccatttaactaaaatcctagtgatggttcccatcagcagacaaaatgacacatccctgaataatgggcaggagcagatgggagataatctcttttttcttgcgcacataaagtgctctgttttccagctggggcagtaacaacaatgtttatagttagtgctgtactgaacagtgcacccagtatgtaaagctaaattggagaaatgatgctaaaaactcatcggcatatatgcttaattaggaagttttataatgccatttagccccagaacgtacacgctctccttactgattgcgagtgcttgccttttatctccgcagaagtgggagcatttgtctaaccatggtggcagccaactttctaacacaaacaatcattacaggcgagcatccctgctcccaattgttgtgtttaaagcgctcatggctgtttttactgctgtaagccgaacacttgggagtcgcgcttgctttttgtaaagcagatcacatgagggcacaggctgggaaaaccatctcctcagggtgcccagaattggtctgtctctcttaactggctttttggtgattgtagacaaatagtggggatttgttttcccctttctctccattctccagcctcataccagagagctgcttccaagggagcagcatccttcacttgacccacgcatccaggagactttgctcctgtcacccagagtccagggaggacgctgccccaggtgtgagctcactgggctattgcacactctcctgacctaagaagccaccatttccccctgctgcaagccactggagaacatttgcatcccgttatattttccccttcctggaaatgcatccttattcaaaggggacgctgtcacacacatttctaccttcccaagtgaagctgtcaccatggcaagtgctatgccctgtaacacatggagaagaatcctgcaccttcagcacacagaacagggcaacagctagaactgggtaacccgattaaataaaacaaatatcaaaacaagacataagctaaacatgagaaataagataaaatggggaggtgagctaggacaaaagggtggttgagttctcaggcaagatgtgactaaaatgtgcatattggattcaagcaccgtcctgaaacagtgagtaatgaggcagagcggtgatggccgcgctgtcatgctcggttgttaaaaggaatggggtcagttaaacgcatcttgctccgtgcaggtttgagaaaactgttcccctggaagccagggaggaacctccgtgtggtgtgagaagggatgtagggcccgcctcggccagaagcagccaaatgtacacagcaagttgcaatgcattgcaggttgctcggtggctagttgtcctggctttgctctgcagagtgagaacgccgtccccggggacagccagagcatggttggcagccagggcagatgctccacccactccagaggctccctctgtaacacagaatttgggggattcagtttaacacatcgaaaagtcatagatttaaacttcaaaaccactcaaactgtgattagagagaagtctcaggaaagtagttaggattggtcttgcagttgtaccttgtacccaagcatgagctattaggccataggctcaaaagatgagtgatactatgcctgttgtggcgtgaaggtcaccaagggtcattggaaagaacatgggaatggtgaaacatctgcattacatttcccaactcaaacaggttgctcactgaggttttattttcttttattttgttttcagaggccccttaagagaggattccaatgacatataagtctttttaaaatttagcttacttattactaaaaatgagaaaatgtcatggcattccaagtcttaatcattgagtgtaaactgaagagagattttaacattttcctaagattcctgatgattctagattgactgaaaattgtgtagtatcatatttattctgcccttgcctcagaatctctttccctcattttgacttaaaagtaaacatctatgctcttttctacatattcattcctgccatactttgtgaatgctccttagtgaggttcattgagaggatagaggctttatgaggtataaatgcacaggaaatcatacataaagaacgtaattataagtatcaacacaccttttgctaagaaagggtgtaagtattcataggctgaaataaacaattctcaaatatatgtcagacacatgacacttttagaaattaaacagtcttggaggctgggcgcggtggctcacacctgtaatcccaacactttgggaggccgagttgggtggatcacctaaggtcaggagttcaagactagcctggccaacatggtgaaaccccgtctctactaaaaatacaaaaaattagctgggcatggtggtgggcacctgtaatcccagcaactcaggaggctgaggcaggagaatcatttgggcccgggaggcggaaatgcaatgagccgagatcacaccactgcactccagcctgggcagcaagagcgaatctccgtctcaaaaaaaagtcatggagattgagattcaattaacttaattaaagattggcagcccagtgtacagagagagtgtggctttggagtcaagaagccctgggtttggatctagtccgccccatttcctgcagtaaccttgggcgagttacattctctgtctgattttccacacctacgaaaaggtgaagagtgttatccaccttccaaatttgtggtgagaattaaattagctgcttgtgcaaaagtgctttcacacaccccagcccaaagaagaaactaaaaaaaaaaaaatttgctttctgtttccctcacttccaagagcaaatcacccactccacagattttcctgagaaaactgatgtctctccagagagaggcatttgttactaaagtagaatcataaactgttttaatgctctgattagagtaaaccgctcagtaatgtatatgtttatatttcttgtgagcatttgcggcattatgttttacctgaagtagctatagccaaaaattctgatgaagtataagtttaaaatgtgatcctctaggacagggcttggcaaactatggccaatgggccaaatctagcccacttcctttttttgtaaataaagttttattggaacacagtcacacacattcatttacaaactgtctatggctgcctttgccctacagcagcagagttgagtagttgagtcagagaaacatgtggcttgcacaacttaaagtattaactatctggccctctccagaagagttttccaacaccctttctagggggaaaatatgtctaaattaaaaggcaccatctgtacaaatgcaaattccacaagaacaggattagggcttgttaaaaactatgtctccactgcctagtagaagaggccttcaataaatatttgttaagttaacaaataaatgattgaactctccgaagaagggaccattttttcactgattttttcaggatagacatgtttttgaagaatttgggatacatcaaagtttgggcaatcaaatcacatatgagatgctctaaaataacatcccacttttagcaatccaggactaagctttttggcaaggttaaaatggtttctgcaattaaaggaactatccctgacttacttgctttgtaggcactaaattttcatagattttcttaaggcagactgtgcttttggttcatgtttagtttactgatatgatggagaacaaacatggcaattccgctgaggttgggctcctataagaaaatcaggggctgtcgggcagaggaagcacacaaattttgtcctgagctcaaccgccaccaattggctgtaattttaactgtctgatgggaggccatcagaaacccactgcagagctaggccaatttaagactctattaagaaccaggtcagcaggagaagcctatgtttaagattagtagtgcagaagcataaggtcagctctcccaggaaaatggggaataatatttaagatagtcttgccaagaaagtaagcagcttggaaggctactcagttgcatcccaagaaggcctccttttgccattttgatggtcatctttaagaaaagccatgccctgtcttcagatactgtgtcatttctggcaagacctcaaaaggatatgaaagcaaaacaaaacagaactgcaataagcctgagagtaagcccaataaaatgaggagggtggatatttcaatcgatttgtcagtttaattttactagcaagcaaaacatttccaaactgacaagcaaatcgtaatgtagtccccacagagtaagggtaagcaaaagaaagggttcctgagattaatgtcccagcagctgcatccccagttcagtctcctaggtagcatgaataatggatgggctaaaaggcaaaatgcacaataatgttcttttattaatgaaatgaagactatatgtgatggctagcaataaattaagaaaagcaaaaaaggaaaagcagtcaatgtttgcctctgaaaaatgcagttacttaaatccaataattactgccatgacagaaaccattgcctcacaatgaaagtgagtacatctcttgtgaatcctgcaagcattgcggaacagaaacatgtttggtccatagactgtaaggcctattgtttgctaagagaaaaacataacccattaagtagattgatggtgatattaagaatattcatagaatttcataggtgaaagtttccctagggattatgcacaataaccccctttcagtctatggacctggaaattggggctcgatgtggttagaaaacatgtccaaggtcacataattagctgaactaggacaaaaagctaattctcctgacttccacctactgctgcttccaaggggattaaacttaagctaccagacaagacaagcatagagacgtggggtgactcagaccggcaaaacctaagctaatgcttcaattcatgttcttgattattcctgaccttcctcctctatgctatgtttttcctttaacgttagacataccagatgggtagttcatatgtctttatactgattttcccaatttaatgtcagaacgaaggatttaaactatctgagcacatgtggaggatactgtcatttcattgtaacagaagaggccacaggccaaattcagtagatgtatcctttatgggaataaatctgataataggcaagcactgtcttttatttatgtatgcctggtgttacggcaggcaccaacacgatggggatggatttccctaagattttcagctaccacatgtgcagccacctgagttgctgagatagctggcattattttaccgttcctctgctttcacacttgatctagcatctgctaagggctttgtgataagccagggcttacagattgtggtaggaatatgcggtgtttcttctggatagggcaggtttatattagtccatttctctataccattttatttaatcaaccatgtgttctctctttaccagcttcccccaagccatcattactcagctctcacccagtacccagcatggcagtcactattgtgcacatatctgaagtaactaggttagagctgcatccttggttaccactggtcaactccagaatctcaagagatttcttgcttacctctaacctgtgataattagcaccaaaatgtgataatgcactcttcagagtctcttaggatctcttagtgaagtggtaacttactaaggaaacacttgggaattctactgcaagcctattcatgtaggttccaacaaagctacaaactgtgaacaaaataactaataaaataataaatctgttaggaactcttaagtgttcatggagcctcaagcctatacctgaggacatacttaatttacaaaaataggcgttctgaagagaccctatttgcttgatgtctggggatttttttgtgattgataaagagtaaagctagccatacacacacacacaaaatcaagttgactcttgaggactcccctgcctaaaaaaatagtaaagctgccttttagaaatggttgaaagggctcacactctgaagttgtgatgcaggatttcagaggaacaaattatgtttcaaatgcttttttttttttcaggggcggggaagaaattttcaattggattacatgttttatgagtataccttgtaaaaattatatattagcctacagtgctatttccttggtaacttcatctgtcccaaactgcatatatgggctacagaattcaattggaaaagatgaactgcatatattttagagtcaagttaattttgtagccacaaacttctaaacatcatacatgacagtgtttagtatgataagaaattagaccacaataaatgcttgtaggatgagtgaattcataagagaattttaactttatctgacataagaatttggtcatatttgaagcataagttatagtcttaaatattgactcttaatactttttacttcttttttgtgttggagttgctttgaattctattttttgctattgttattattcagaaagtatatagtcccctaaaataatgccgtattcactaagaaatgtttaatacacacttaatatgtgtgccacagtctactaatcatctggaaaatgcaaagaagtttcaaattctaccatagagtagttggcaaggtatttggggaatatgcaaagaaaaataatagaaggtcagtgtgcaattaattcccaaaagtttggtcaaaacaattcttgcctaaggagtttaggaagaaaatatatggtacaggtggtaaaatttgatcaagtcttcaagaataaataaattggccgggcgcagtggctcacacctgtaatcccagcactttgggaggccgaggcaggtggatcacctgaggtcaggagttcgagaccagccaggccaacatggtgaacccctgtctatactgaaaatacaaaaattagccaggtgtggtggtgggtgcctgtgaacccgggaggtggcggttgcagtgagccaagattgtgccactgcactccagcctgggcaacaagagtgagactccgagaaaataaaaataaataaataaataaatttgagtgggcagagagagaaagagaggtaatttcatgttggcgagtaccttgaaccaagaggtagatgtgagaatgattaaagtacattcagagatacatcagtttggactgtttttatggcaagtgaagaaaaccaaaaccaaactggcttaagtgaaaaaggaaatgtattcttttacatagcctgaaagattcacaggttgagtctgagttcagtgatggatggatccagcactcagttaatgcttggtttcttgacatcctccaaccctgcctccctgtgttggctttagtgttggacttcacatggttcccaggatgggagaagcagctccaggcctgccagtctctcaaaattgggattcattataaatgtgaagttccagcaaaagtcttaccatgtcctattgatggggtcgggtgcccatcttgggccattcatgggtattggggaatgcagtaaactcaggcttactcctgagtcacaagcccaccccaaccctactcccagagataggagtagggtcaacttcatcaggatcatggaatgtgggagtgaggaggtatgcaaagggaaattaaggtatagttaaccataggcagagtaaacagatgctgtgcttgaaaatcaagtgtccagtaaaggaagacaatgagtctactgatgccataggatcattttgagtaataataggtatacaccctggaagtttttattggaagcacattgcaaaggctgggacaaggaattgggctttatgaggagctgtaaataaattggaccttgtagaaattgacctgacagctgtgtgcagaatggaccggaaggtgggtgctccagagagaagcagatcacctctattgtactttctcatatctcaaaagccacaaagtttttgaagagagagaaacagatcacttccattatactttcccatctttcaaatgccacaaagttcgtagaatatctactgtgtgctgtgaactgtggaaaacacagagacaatgtccaacgcttgaccttggtcctccaaagagtctacaaagtggtagggaaaacagttaattaggatcaattatggtgcaggcaggatgaacaacgataatggtactagactgtcatggaaacagagaaggaagaagttcctaaaatactttctctaagcagagtgggcgggggcccagaaggagagacctgtagtcagagacaccctctggaacatctctgagagcaggtcagttgggaatcctcaatgctggtttgagaatattatgaggacctgaggggtggaaaactgcacctctgtcatcagactcaggtctccttaggaatttatgagcatcaaaattcagaatgtgtacacgggattgtgtacatggtggatcctatctgctctacaaagagaagtttctctgatcatcaatgtggagaagccactgtcttttggtctttgatactacctgtggccaatgtctttccctagctcatgctggctgggaacagagaagggttgagctgctgggagtgcagtgactttaatttatcatttcaataaacttcagagtaaatgggaagaaactgcttgggctttgcacaggagaagactgagttctgttcctagttagcaatgcacatgggcaagtctctccacatgcctaggtctcagtttccctgcctgtaaagacagaacattggacaaaaatgctttataaaccctcattcaactttaagagtctgcaaatccaatagagacaaccttgaaccactcatgacacatgcccatgaccgtgatatatttccaagaatacgtgtcatgaggatcctggggatccatgcacctgaaagctcaggagcatttgtgcatgaggtcttatctacaaaggtgaacatttagaaagctgctgagtagggaaatctgtaggagtggccagaactgactacttcaacagggacaggggaagggctttctaggcaggacaagtaaggaagagaatataattgttcttacaaggatttgcagaaatgaaggtgaaagtgagcgtgaggggaccatccaagcatgggctcaatattaagtgccaccagcttctgcataaactgaattacagtatttgtggagaatggtgtatttcagtggctgcagccaagagtgtgaagtattgagtggataatggggaaatgaagtaaatatcaagaaggtgccagtgaaactgaaggaaagagggaaagtactgagttaaattctaatgtgagctttgtgcacattgcttttctatgacctgcagttacttgattttaaaacagtgtcttacatcaaattgtaaacaaaagaacaccttacatttctgggagtcttggctgtttagaaagcatttgcacatccatttctacctacagcaactctgtgagagtggaaaggtgcttcttatttaaaagatgagaaacctgggtggatggtcagcaatggacagagtgggacgcaaaatccctgaccacaaacctgatgtgcttttcttccccacatctgactgcctctgttcacaagtcagaattcattccaatgccaatgacttttttctttctcaaggaggtagaaatagaaagattttttatggccaagaggtgtttatattacttttggattaactacaaaatgctttttatgtaagacagactaaatagacgtctgttttttttacaaacattcaactctacacaaacagaacatttcagtttgctttgaaagcaaaataccatgtgtcgtaactttacaatgttttaaataaagttaggaatttgggtttatgatactgaaaatatcataaaatcaataggtttaagactaagaactatatgaggatccttaaaaattcaacaagaatcaaaggtagacgtttcaacagaccagttactgaatcattgtattaacaatctagtgagacaagaagtgaattattgaagtttatcttcctcattggtttgtaaccctgttcattcagtgtgtggatagtttctgaagtagagcagttcagcctaacgaagccatttactgtactggttctacacactgcctctctttatctctttattacttcattttggaactttgattggcctattttagatctaagattgccctaatgctatactgcaattgtatgaggggcttagttttcactttgttctcagaaccaggctggctgtaaatttatctctgttctttgaaggagctaacagtaaattttcaagaggaaaaatggtggcatatatccctgtagaagaaaagtaatctcttaaaagcagaataacctccaggctacatcctttttaagggggattttcaaataagaacgccttcaacttttatatgtgttctatatttttcttcagacctcatacctactcttctgctttctgtgtaaggtttctctgtaatgaccccatttttcccccacacccattaaatctgtgatgaagtcatgctgtcccccattctgatgtcatgataacatccagagctacaggcagataacacatccggggaatcatcggaggtctcctcaggaaattgaggcatagagactgggagttggaatacctacaaaattgaatctcagtttcataaattaccaaatactatgatgaaaatgaactttgtaaagtgaaatccgtgggaaggtttccacttggtttaattgcattcaaagcagtgttcaatttcaggcattggtttcattaaaattaaaccaatccttcccagaaattcagccacactccctcatcaacagataataagatcatttagagtgaggaggtgctaaaagaacaggatgagccgtggctccgtttccatgtctgactgacaacttcatcacctttcatctgtattatgcagctaccctgagctgcatgttaattgaagttgcccagggagcatttttacacacaggactcaggcaccccttttcagagaaggtgggagtgtcctctggctagcctaggagccaccaagggtaaataaatgtgcagctagcaaaagtctggggaggagtggggaagggtcaaacccagtacaccatccatcctgcctgtgcctgcagatgtcatgaccaggtcccttaaagacctggatttgtggggagcagagggctccctgagagtggtgactgtcaacaaaaagtgtgccatgatggacaggtgaacttggccagtgtattttttctgacctcagaaagttctagaaagagtttgttttgccatttccctcgccctaattgtcctctttctcattttatgcccctgctagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacgttgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgataagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggactt

SEQ ID NO: 15755 - DNA, 12449 bp, Human
ctggccagagaggaggtactaagagaggtgcgacctagccaagaacgaggtcgtggagaaaaccctgtgggggcggcgctcacatatgcggtgatgaggagttgtgagggccctggggtcggccccgaaaagtagggataacggtcgcagaggccatactgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacacacacacacacacacacacacacacacacacacacacaccatcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggtatttcccctgaacgaatttcggggagattaaggagaagcgagaatatttctagagggcctagacttctctcctgggcatcagctttcatctcagatcagggagaaagagggtccccagatctgagcacaaggcctaaaggaggctgtttaggagagggtctgacaggcagaaatgggatctcctgggagcaacaaccacaggtggggtcgtccgggcagtgatgagagggcagagcagccgaccacaggggaaacagccaggcggcagcggtgtgcgcaacgaggagggataaataaaggaggagtggggtcctggaacctagaacagccggttccaatgggatctcctcccttccctccctcccaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcgtgagtgttggggcagggtggggacggtgcaggagcttgttgacccagcactgcagctgagcaggagagcagggcggcaggatctcccagggggaagcgctgggcaaacccccagagtgcccctgcccgggtcactgccctgtggtctacgtgggctgggcctgggcctgggccccagcgctctcctttgcaagcctgggaaatggtggggtcagtggctggcagctcacaatctcagttcctcaggccgtggagggtcccttgtacggtcaatagggaggcaggtgctgccaggactgggtctgcagtgctggaccacggaggtcaccctgctcttggcctgtaggtgccgagcttggaagacctgcccatgacctcaacttgtccatcacccttctgccaagacccgcgtccctggccctcccccaagactaggggatttaaaagttaaaccaccctccccacccacccccccagcctccctaagacctttccctcctcccacaggcagatgcccaactaggaggagagggtttgggggttctctccatttatgcctgagcaaggccccagcgaacgggggtggtgtttcatagggtaaaaggaactgcccattctgaggtagggcagttggtgagcccccgaaggttggaatctcctctttgtggggttagggggtttaccagtgccagaaaggaagagagtgttaagagtggaattgtaggtctctgttttgttttattttgtttgggtttcttttgtggggaggggttgttttttggttggtttttttgttttgttttttgttttgttttgtttttgctctgtctcatttctgtttccaactgggaaattttttttaatggcaagagaaaaagaagctgtgaaaagagaaaagcgagaggaaaagtagaagaaaaagaaataagggtgagaaaagagcagagacaggagaaaatggggaagaggaagaaccgagagagagagagagagagagagaagtggagaggaagaggtcaggtacccaaagaatagaaaagctcgggccggggctggtggctgccggctgacccccaccctccccgcagaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaaggtgcgcgcggcgggcggtgggctaagcccctgcactgacgcccctcaacacgtgcaggcccaaccgtccgttcatcgcccctcgaagccccctgcacgggatccgcgctcttgcggcccgcccccgagcaccgagcctcgcatccatacgcgcagcactcacggaagtcctcaaggcgccctctcaatcccaccgcgcgcacacacaggctcccctggggcgagcgaacagctgggccgtcgttctgatggagatgtttacttaacaattagctgagactccgggcccgcgctgacatttttacattttattcgtttatttcttggctcaggaatgagaatgtaagtgaagagagggcgcccgaggcaatctgcccaggctctaccgatgctcagaacccggggcccagttttcactctctcggggggagccagagggtgggacaggtgacacagccccccaaagcactcctggctactgctctgggtcagtctaggccccagaccccttgggaggcgcttagagaattaccttccaatcaaagggctttttctgcttgcggcttctccacccttgttctagtggggcagagcatcacccctctaggcctgtgcccttgtgcgccactgtcgagtgaaagagagggtacgagtgtccgtgccggtcgttgtggctttgtgaaccaaggtgtacgctgggctgtgcgtgccccgtttggggtgtgttggatacctgtggaggcatgtgaattcgtttggttccgtaggcgtttgttatgtctgtgcacacttgcgtgtgtgcgagcccgtgagtgtgatttggctttgtgtgtacctgcagccttgcgtgtgaactgcagtctctgttcgcgcctgctcgggtgcggagtcgtttaacttgcgcaagcccgcgggcgggtgtgcatgcttgggctggttccgacactgtggcactgctttaggcctgtgtggggctgtctaggcctgtctagggataattcctcgaatgaagcttttggaggacagaccccgtcgctttccgcgaggccctcccaccggcctcagctcggggcgtcccatcccaggcgggtgggtaccaagtggacgctccccgggtcttccctctgcggccagcacccgctgacctcggggtgccaccgaccacgctggaagagccacggcctgacttagcgccgcccccttggtccccgcagatcacacagctgaagatcgacaacaacccgtttgccaagggcttccgggacaccgggaacggccggcgggagaaaaggtgagaggccgaggacagcagccctgtggcgggtgcccgcgggagcagcgagcaggagggatggagggatgggctccccgctgacctggttcatccgctcatccccaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgagggtcggaccggaggagggacagggaggtggcggcggggggtcctcaggtcgctgggctggtcttttgctgagccacccgctaacctgaaaggccaggaaggaaacgtcggcgagtgtctgggatggggtttccgtcccgggactcccctacgagggcggtccccggtagccagaagatccggccggactccgagcctggccccttgggcgccgtgtaattctatagctgtagggtttcctctccagggctgggttccttccactgtaaatctggggtcttggattaggtgacctgcagctgccctttgcccgactccagcagctcctccgactcggcctccccgagagcagcccttcccgagtgtccctgatcctgctcgtcggcctccgcccaggcccctgtaatccgcgcgccctctccccgcagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcaggtaaggcctgtgaccccgcggcagcgccagcgagggagaaggcccagggagctggcggcgaggccagcggagggcctgaggggtgccagggtcgctgggatcctctggcaggcaagaactccatccaggggaggccccgggatgccctttaggacacctgggttctgagagacgaggactgtgttgtaagtccaggggctggccagggcgccgcttctgactcccgtgtgacctttggcaagtccctgaccctctctgggcctgcttccttccctatagccccagcgaggagtgcggtgcccatcgagactcttctcaccctcacagaccagggccacccctggcttgtgaagtcttctctcctggcctcaggacatttttcttgagaacaaagacccttggctccctgtccattctgaaaggctaaggtggccagacagacaaagggagaaggaacatttgcattattttctggacagttgaccaccagccctcccagaggtctctggcccctcccaggccttctacgaagtcctctgtcctggtgaaggacaaggctggtctttcccctaccttgagttcccagcacccccagccacatgtcagggatgagaactcagctcttcaggccccattgaaattccaagctcccaggggagtgttgacgaaaatgtggctggggcacagtaaggagatccgatggggacagtggcctctttggttgcttgggtggaatattccctgtggaaagatttggaatctcttcattcattttcttccctctgaggtttctggcaaattgaacccctgagatcttatctcaagggaaggaaaatagcagttcaggtctgagaaagctcctttgcttcagcagcaaatattttaaaagttgggttggtgggtgggggggtggggggttgggaggcaggcgattctgaaatgagttttacacacagctcagtgttagggtgtgtggagtgtttgaggtatcaccatcactcatctggggctctgggctggaagggaagcctctggagaaagttcagggcccagaggtttaatctgcacccctgattatttgtgtatatgaatgcctcctccccagacaaactggtaataatcaccagcatcacagaggtcatgaggaagtcagggcttctagacacagcctggccaacaggtgcatgacccgggtgagaataccagcacctgggaggcatccgttggtagggctgctggtggttacattcccaggccagtgcagcccatcccagacatcaggtagagccaaatcccaagagaactgaagcctccctccttcctcccaacctgggatgccaggtctgaaatgcccagtaggacctgactgtctcaggagggggtattttctcaggcctgatgaagctgcctcttttcttcttcctgctagagccaggcctgaggctccctgggagcccagtgcaatcatcagccccctgccctcctccccatacccactagctctggggagtaagccattatctcaaaggtcaggccgtgcaccagccagacctcatgaactcaggaaggtgcttgtccaggagttcctggctgctgtgcccttcacaggcaaagactgcattccttcctcagctgccagtgaggtgctgccaggcattccctgtagaactttcaggccagtttatgaactggttggcacccgtgtcctcctcctggcccaggcaggagaaccatgagcaggcagaaggagactttgcaaagtgccttccccagcatgtgtgccctctgcccttcagagcctgcagataggaggggtggcgaggacactgttctcaatgagcagaacctccaagacacccaaagctgcctgtttgccacctggccctatgcctgccccgttttctccctcaaggccttcacccgtgctagggcagtcacctggaatgtcctttccattacccctgctgtaatgcccagcacagaacttgatggcaggcctttgcatggtagcctgaagcgatctcacccttctaactgggtttggccacaggcacactggctcatgcttacctgtgctgcctgtggttatagttatgcgaattgtggttttacatccctaaaacagaagggcacggtgtccaggggatagcacccagcccaacttcagaaagacttcaggcaagatgtctaaccctcgtcttgttctgtttcttccagggaattccaatgcccactttcggaggcctcttcccctacccctacacctacatggcagcagcagccgcagccgcctcggctttgcccgccactagtgctgcagctgccgccgccgcagccgccggctccctctcccggagtcccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaacgacaaaaacgcaagaaaacaataaaacgctagaaagcgaagtgaacggcgctgtgcgctctgtgggtcgcgcggggctggggcgctgcacgcgcgcaaggagggacgagaggcggggacaaaaggctgcgcgcccctcgcccggcggcagctgcaccccggggacggcagggcggcacggcggcagggcggctggggcgctggcggagccgcgaggccgggcggcgccggcgcgggacgcggggtgcgtcccaggccggggctggactccccctgccggccgctcccgcagctccgcgcaacgggcctgggcacccacccgggccgggaggagagcagccgagcggcctggactcctggcttctgactccctttccgggaaaccacactggaaacccatctcctttcaatgcttctgggtgggtgggctgggaggatgggtgttccttgtccaacctctcccttcggaggaggggtttggctgtgtcccacccccgtactccccgccaaatatcgctgagcctagaattctttcccctctctctgcctcctgaacctcaaagacaaacatttcctccgcgtcagggctgttggctagagtggcaaaatctggactaaaaggtcttactttaactcatctatctaaatccctcttgggagagtggagagtggggtcagtgggctatttccattcctgcctcagtttcccctgtataataatgggcttggctggggtctctccggggtccagctgtgtcagtctccattaggctggtccttccccgagacccactcctgcaaggacagctgcctcccaccccgcgccggtgagctccccctccttgcccagctagcaggtgtctccagcccccacttctagcagtgggagctgggcgggcactcctttagccctgggtctggtcggtcaccgagcacgccacctccttcccagttctctcctctttaagccttggggaccctgaacgccctgccccaacaggctgcccaccttgggcactgcacagggtggggcttggggagggtgctggcttccaaaacaccagggacgttgagatggaggaacggtgatggtgaaggtggaatggacagttgggcccccagactcccaggacgcctttgtgggccgatacatttgcaaggagcgagagagagagaaccaggcccgcctcttcaggatggtg

SEQ ID NO: 15756 - DNA, 33157 bp, Human
gaagttttaggatcactcaaaaattgagagtaaagtacagggatttcccacacatacatagcctctcctgttatcaaaatcccccaacagtgtggtacatctgttacaattgagcttccttgttttattttttaacccttcttatgttattacacatggctatttttcatctatctttattagctatctcctttgttaccttcccctcccgcactgatgttttagcccagtggcccaacatagctgataagaagcagactttcattccaggttcattttcccgatttagtgttgagggtgcgggtagatgaagttttgttttgtttgttttgttttagagaagtgtattgctttaaaacagggagagatagtctgacgtactgaaaggaggtgggtctttaaagttagcgaaaggtaggtaggagccttacttttgcctttggcaagtttattgaccactataagcctcagccttatctgtaaaataagttggataatgcccatctggaggagctcttgggaagattgaagcatggaaagcacctctctggaaggttcaaggaaagggaactagaattatgggtgacagaattccctggctttccaatgctttactgtaggtcgaatgagcactcctagcaggctggcctcatgccacttcagagtctctagcctgcaggctgggggctgggtatggacacgatacctggaagggaacacatataacttccatcagtgatcctggaaaggctcgacaaatcacccattcattcattctgtgtgtatgtgtgtgtgtgtgtgtgagagagagagagagagacagagtctcactctgtcacccaggctggaatgcagtggtgcaatctcggctcactgcaacctctatctcccaagttcaagtgattctcccatctcagccccccgagtagctgggattacaggagcccgccaccactcccggctaatttttgtatttttagtagagacaaggtttcaccaagttggccaggctggtctcgaactcctgacctcaggtgatccgcccaccttggcttcccaaagtgctgggattacaggcatgaaccacagcacctggcccattcattcatttttatttgaacttctcttccaggaagccctctgagtttaggtttagcgacaggaccctgattcaagtcaactcgtttatttgaaagctgcctggataaaaataaaataaaataaaaaataaactggaggataacataaaaggatccttgcagaggattcctccttttgtggatctcactgaatctcagagttagaagacgctcagagatctcaactccctcaagggtcagacaaggacaggtttttcattctgccctggatcctctcacaatagcctcgcgggagctggccctcaaaatgatgaaggaataaatgaaaggagggatggagaaattaatgatgaagaaaaaatgaatgaggtagggctgcttgtttgctgctattttcttcacaatgcttttaagatttcctggtccatctcctccttcaccacttctctccctccctcgatctcttctccaacttgtctcttacagaagggcgccgcgttcccgcgctcctccccttcccctcgccccgcccctccccagcgaggccccgcctcgccgcccgagcccggcgggaatgaatggcagcgtagccgccgcgccgctcggggtgccgattggctgaccggcgcgctgacgcgccggcgaccgcgggtgcacgcaggcgaacagagccggcgggggcggagccgggctccggggcggggcgcaggagccccggggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggtgagagggatggcgtcccggtcccgctgcccgtgtcagaagcgggttcccaaatcccgccgttaagcgcacggctcccggctcctcacctggattcatcctgggtggatcccgcaccttggccagggatcagttccctggggattccccaccctgctgtccctgggcgatccccttcctccaaggatgggagctcctgcctcacccgggtctcccctcgcgatctgcggacctcagatggattcccggccccgggactccaagcctgtcctccttcccggggatccctttgctcctggggctcaccctcccgacccccatacaggctgggctctggctctctctgggaacccgaaccccagccccgggcaccgcccccgagtcctccgacctggctttggcctccatccctttacctccagggtgggggtctcccggggcgcgcggaacggggtggcgccctgcggagagatttgtcgtaaagcggggtgctaggcattttgggtgctttgtgaacggccctagcaacagggaaactgaggcacgctccgccagcttagccctgcctggccgtgtaggggccttgctggttctccagctgaacgtcccagggcggtgctatttttgggctctgcgaaggggcatgttagctttcgggtggcgagacctgctgtggaggcgccggtgttaggaaacgaggaggaggaaccgtggaggcgccaccggaaggctggccgactgctcattcactgtagagctggtggaaatgccgggctggggggcgccgtggccttactcccctctggggctccaccgtctaacaatggatggaggttagcccatgactctgagaggaactccgggcttttcttttctgtttaagtgggtgaaagttcacctctccagggcatatggtaactgcatccctttgtgtgaattcccggaccttcaccaccagcatgtttgctgggggtgcagtgacaggggaaattttaagaaatgcatgaaatcttccaagaaggttgttgagtttttagacactaccttttatttcagaattttaaagtacacattttttttttctttccaatctccatgccctcactgccctctcacccatctcattcctcccccagtcccaaagggtaaaggaggcaacaaatgcacagaagagttgccatggtctgggccaccaggaaggggatcagcttgaagacttggattgacttctgaatatattgcttatcagtcagggtgttgaatgcctggcactgttcccccagtggaacttcataccggtgtgtctaagggcaaaatggaaccgtagtgttctgactttagaacctgatgtcagaaatgaagaccggaggggcttttagagagaatgtaacatgcactccagtcatgatcagtgaagccctgtgcatgcggtttgatttggttttacttctctacacgtctgtgctcttcctgttttcagagaacagtggcaatattctgtgaaattgccccttccttgtttgattaagagtttgtcattcttacctatacctttggatcctctaaaaagaaaaaaaacaaacaaaccctgttcaattatttgttgcacaaacgttaaaactgttaaaacaacaacaacaacaacttcatttaggatgctaccctctcagcttattgaactgactttttaattatttttgctggacactgatctctccattccttattagcacagttgtaatgtgatttttgcgctattattcacttaaaaactaaaaatacaggtattttcttttggtgtggcatagactgtaattttcttgggggcttgtgtgtttctcaatggatatttaacagtttctttcttgatgacatctagatctaccctgattttctttgaagatttgtgtgatctcataatttcttggttttctatcataagctaggttggaaacatagttctaagcatcaattttaacttggaaataaagcctataaacaaaaagtaatgtaatgagaatgtcctgatttttgtggttcacacattaaaatgctgagagtagtactattctgcatcttttaatgctgtgttcatgatatatctttctgagcattcccaggtaggtaaattgcaaaggaactggagggagagacacactgtctttgaagggagacatgcttcctccctcctgatagatttattgggactggatggaggagcatgaggagggtttatgcaatgatggcttcttaacaaacttaggatgtgaaaaatttcactggaacacagaggcatattttatcttcctcattttatgtttcacacttgagtatccccaagatacctacacacacatagacaaacacaaagtcatcctctccccttcatagcatctctgattgatggcaataactgctaatatttattgagtgccatttatctatgccaggcactggctgggcacttgtatattactcatcctcaactataactctggaagacataaatgttatacccatttaatagaagagtaaataggtttagagaatgaaagggaacttgcccatagtcacacagctaggaaggggtagacccaagagttcaacttcatgtctgtctctcaaccagtcatgctgctagctcacctctttctctctcttaactctctgcccacaccacatctgtgtgtgggcacacagatcttataggcataagatccacagagctctactgtatcttcttgttggtgtgtactcatttcaacagtcttgcaaccaaaaatccaaggaaaaagaagcccttttcctcagccccaacctcatgatcatgcagctagcttcaaaactggatatgtgggaaagcattttaatctacagtattagaagtcttacagggctacctattgtcttttttcccatgttcttaaagcactaaatcataggcatggggtagtctccttatatatgccatcttcctttatttaataattaagtcaagattggcactattgacagtagacacttttcctgaacaaatatgctcagtcataaaggggagctaatagtaagaggggtccacttatacgttgcaacataaatgatgttgaaggggcccttggaatatccgttgtcttggattttaagtgtttttgtgtgtgtgtgagattcggggttctcttggttccaaggctgcctgtttctcttacttacagaacctgctgtgtccacagtaaaactaattgactatgggatatctttgttaagacaaaatagttcagcagtagctggaatgtctttctattcattcaacaattattaagctctagcaataagctgggcattgtacttcagtttggtaatggaaaggtgaacaagacagccttcatggaattcacactacagtgggaaaagatgaaataaaaaataagctaaaacaaatcaaagtcttaccaattgtgacatagggctctggttggatggggagggttgaaatgatacttcagttaggatagtctggaaaacctctcttgaggaggtgacatctgagctgagctgaaaggatgagaagagagctgagcattctggagaatatcctagacagaagtaaacagcaagtacacatgcccagaggcagacacaaccttgatgtgtttaaggagcagaaaggaggtggtatagccagaggatggagagagagaaagatgccaccctgagactggaggggtagtgaggcccagaccactcagggcttgtgggcctctgaacactgtgttacagtgctatcgtaagcactttgggaagccagaggcagactttaagctgggattggggtgtgtgatgtgatctgggttttttgttgttgtttgtttttgagacagggtcttgttctgtcacccagactggagtgcagtggtgccatcacaactcactgttgcagccttgacctccgaggctcaagcagtccttctacctcagtcagaagtagctggggctacaggcatacactaccacacctggctaatttttacatttttttgtgtgtgtagagatgggatctcactataccgcctaggctggtcttaaactcttgggctcaagcaacctcccgcctcagctccccaaaagtgctgggattacaggtgtgagccaccatgcccagcccctcatctgtttctaatggaaaactgtagctgctatgtaaagaagagagtctgtactgggtcaagcaggaagactagttaagagactttgtatttgtacagacctgagatgttaggtctttatttaaggtaggagacgcggagctgggattacaggtgcacaccaccacaccaggctaatttttgtatttttgtagagatggagtttctctatgttggccaggctggtcttgaactcctgacctcaagtgatgaggtggacttatttgaaatatattttgaaggtagtgttgatggtacttgcactcggagaatgaggaacacttgtgggatttgatctactgagatcagcctctgagatctgctggtgggttgcagatctactcagtgggcacagtgctttaggttgaatttaaagtgtgttagtgtgctaaggagtgttcccaggtctctgatctgttctttccctccatggttttgaaattctgtcatggcatgggagaggggtatgggggaaggaggaggtgataagaacgttgggcaagggggaaggcaggagagttttgaaagagaaagtgaaggaatgagtaaaaaaactctgcctaactagtagctttattaagtgcagctcccactcccaggactgaatcaccttccttcaaaccctctagagcttgttggttactcaagcattgagtaaccattagggccactccgctttaaatagagatgtcttccataaatggatgctgttttccataaccagcacttgaacctttcccattcttttttcggggaagagatgaaggccagagtgtgggagttgatttacattttacatctgcttttccatttaggttttaggagtgatttcttcaggaggctgtggaggaggcttgattgcaccctggcaggttagagagaaatgggaaaattgtattgtactttcccagcagaacaattatgctgtctatcctactgagccccagatttagagaattgcttccaggatagttacccttatctttccctattgcccgtgtcttaccctgtgcatcaggatagagtgccttaagtcaccatgggtgggatatttttctgtataactttctacttttattttttaatgtgaattattccaggtgatcagggactaagctgtcacaaacatggccatccagtttatttgtttttaggagaaaatgtgaaagtctatccctgttgctgggtaatggcttgactatttttagattgggctgccagagatataaattgctattttagtctgcagcctggtggtgggtagacaaatcctacttactgcaccctacacagagcacattcaatttcatctaactacagccatcttggggccttgctctttagccttgaaaattcctaatagggtatgctacttatagctctgttgttatgtctcaggacaatgatgtggtatatcctccaattcttgggacacttttaaagcattcttcccaagagtgtaattattttcttttttgctaataagagctgtatagcaacactcttgtctcttaggaaattagtaaaattatttaaaatattatcaggggagaaaagatgatgcttaataatagttaactatatttgagaatagcttggataaattttgaagctactaactgtatatttctctttaacagttggttttcaaaccatctggtagattatactcagtaagtacatattttgtacactagttaaatatcttaacccatcagtgggccaagtgaaatatcttcactgtcccaaattcattccccagtggattttccacctgaactatctgtattgtgttaatagtggctgccactttatttttatttatttgatctaacgataacaggctcttcctaactcagggaaagagtattggctggtcttttattaataaacttggcactctctaaaatggcttggtcatgcgttttagccaatttttggcaacttggttctaccatttggttcagccctgtaccattttttattttgtgtatgaataaggtaatgagtagttagaactcattagtggcacaaaataccaacccccaacccccattcacacttctttaaactagcttgagcaaaaggattatttattgtgcaaagcctgttgacgtcttacagactcttaagcacaggagtgcagtggacctctgcaacctgaatgctgttgaaatttttttttttttttacgtccgtctgtttctgtgcatctacctctttcttcttttattcagacagctgcttttttctctcctgagaaaaaaaggattaattagactaatccagagtccctcatgaaacctgttgtgggtatgggttgggtttttggtggggagggcatcctcactcagcatactgaaatggaagaatgctatcctctctttaggttctgtggtattcatgcttttctctgtactactgatggtcacaaagttagcctaaagggaagtgcggaatatgggcatatgtctatatatgtaacagattttgatatttagatacgtacacacatttgtgtgtatatatgaattttatagccaaaagaatcaggtagtagtcatgtgtttggtttttgaagcagactttttgatttcaggaagaacaaaggtgaaaacatacctccggttttaagttgcctagaggtagccaggtgtcatttatttaagctgtctggtaatacaatatagggaaactagtgggacaggcctgttaatcatgggatgtagggtttaaagatgtgcctatataaagctttataaattttaagagagaaaatagaaactttgtttttcaaatgtagtgtatcccttttcactaaatgacaataaaatttagaaaaattcgttttttttttctagttgtaccgtgtgtgtgtgtgtgtgtgtgtgtgtgtgtgtgtgtgtgaatggaggaggagggttccagttgaaggggtggatatggtttctctttgcttttggttgtagaagtttgcttttggttatggaaggtttttcttttgaataaactgaaagaaggcttaatctaataaactagggtatttgcttaaggatcattgctattggctcagtttactcctctttagtggctttggctttattaccgcaactgggtatttccaccagtcacttctttgcgtagaatagaccacatacccactggtgggtttcctcattgttcttcacacactttgagtttttcttacatgtgttctttttgtttttacaggttcatgaaccatcgagctccagccaatggccgctacaagccaacttgctatgaacatgctgctaactgttacacacacgcagtgagtacaagttttccaccattgccatcctttccacggggctttggtgggaggaaggggtagttatctctagtaacctcagcacaattagttggatttacccatctgtgaccttatctaccaggaaatcagttctgggtcgtgtcaccagaaactatgtaagcatgtagaatgctttgtgtgttctaacctacagtcagctctgtcctggattcgctttctccaacaagatattctttaaaggaataataatagtatgtaccctagttatagaaaaaccaaagacacctatttatgaagactgtcacccctagaatgaaatgaatcgccttttcaagacaatcaactgtgttcatttggcaaagagagttcacagtttgttgaaaaagatgctttttaaaattaagtgatcctctgaaatggggaggggagccatagcctcccactcctacagtggccattgcttcccagaggagatgttattccatattggtgaagaaaaagccgatgtgatccctaaattttttgttaatttttttctgctttgtaaaagcaaaacatgcttattataagaaactttaaaaatactgaaaaatatataagaaaaacaaaactaaccagaaataaactgttaacacttcggtgcatttctttgtgtgtgtgtttgtgtgtatgtgtgtgtgtatatgtgtgtctctgtgttgggggtgtttgtgaatatgtatgtattttcagttttcctgttaatgtgacattaatggcatttcttatgtcattataaattttttactttacctgtggtttcattattcccttgcatttagtgacattgagggaaaaatagtggctgggatacagtctgaaaacaagaaatagagaaaagaccagtttgcttctttaacaatgagtgtttggaacaggctagtttaactgtggtagtcactgttggtacaatacaatggttcagatattgaaacacacagcttacctttaggaataatatttactcggatgaacctgaataaaccttaacttgtctcttctgagtgtgtcacaggttaaggaacacttgtgtaaacttaagtaaagggagacctgacaaaacccccatattaatttttttagaacagaaaatataatcttattaaaccgtatcttgaatttttggatttcagggaccagtaatatttctaacacagacaaaacacccctattgtcatcatttcattgaagagaagatactttaacatgaaaagtagtaaggacatgatctcaagataaagggcattcctttaaatgaaatacattttgttttatgaaaaactttattgtacttaaatgtacttaaatcctctgaaataggaaggcgagccatagactctcacccctacagtggccattgcttcccggaggagatgcaattgtatttaatgttctaattttgcttgggccaacgaaaacttcagcatctgaaaaactcatgccagtctcatctaggggatttaatagtctgttgcaaggtgacaaatgtaggtttggggagaaaaaagataagcaaattgctaacatttgtattctttgtcaagtatgcttactctaatatctaataaagtagtttattctcctgggagcttctgtcattgtaagatgtttactagtcatagtcatacacatatgactagacattaaagtttgtgaccatgtggactatgaaatatgatgcagaaagcaaatctctctaaaattctcaagattttttgaataggtgggccttggaaatggtttgctcttgcttacttaaaaggctctgttaaaaatgaagtgaccccaaaactcttacattctgcagtagctctcaaattggtggaatgtacagatccaaactgaaaatcagggtatataacttcaacaactgactttttgtatgtgtgtgttgctatgtacattataatacctattacttgatttgttcaattatcctgtcctgaaatattgagatttcaattgcaataggacagatattttaaaatgaggacctccctgaaaaatctgagtatatgcttggctgttttttgaaatggggtctcactctgcctcccaggttggagttcagtggtacaatcatggctcactgtagcctcaacctttcaggcccaagcagtcttcccacctcagcctgccaaatagctgggactacaggtgtttgccaccatgcctggcgaattttttaaatttttgtagatacagagtcttgctgtgttgcccaggctggtctggaactccagggctcaagcgattctcctgcctcagcctcccaaagtgctgggattacagtcatgagctaccacaccctgcctgcttggcatttgaatattttaagtaattactctaaatcagattataaagtagaatgaaacatgtccttatttaatgaaattaggataaaaaaaaaaaaccatctgttttgcaacagctgaatgatgttgcatccttgatggcttaattgtatccccactggttggcacaattcctggaccctgagtggtattacctgctttccagtgtagcagctaacttcatctggctctcgttatgattatccaggagagacaaatacttgctctaagattattttactaaaattgttcctggtaaagctctgtatttttagtaaaagactcaattccataaaagccagaatattccattcaccattctttatctttccctcagttcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggtacagtggatgacatgctgtttcaacagatccaaatagttgactcaacgtgtttggtacccttccaagctggcatgctttagtcaagtagggcaaagagtagacatttttctgccttgtagactagaatactatcccattattcaggacttgttctttggactggatgaagttttaggactcctccccagcaggcatctaagaaggtaggcctttgctcagtaaccccaaacaaaacctaactgattccccaggacttaccacttaaaaacctgagagctattttccagtactatcaagcacactaaggatatgatgagagcagcagctatggggtagtgacaaagcacactgagcttggagtcagcaggcaggctttgaggcccagccctgctctttaattttgggtaaatcacttgaccttgtggagcctcagtatctgtatcactaaaatgagaataataatacctgagtcacacagtcagtgtgataggtgaatgagataaggtacttgaaaataacttgaaaattacaaaagaccctatgagtgtgtgaggtatgaaggtatacttatagtttgcgtttaccattttgcaaagtttagctttcagaattaagtcttgtgtatattattcaaacagagttcacgtattttgctattaatagtcaagcactttcaaaacaatactatagctcttggcctgccaatgagaagaacgtaaacgctttcctcctctgagtgaaggattgattttggagcaccacaccatttaggtgggaatggtttgcttgtgaaatggattctgcacaaccctaaagggcaaaacttcttttcaaaaaaggaagtttcagagcagactatgagcaatttaaagaaatactcgaatatgccttttggttttaaagaacgtccaaaaaaaactcaaactattcaaacaatctgatatttaaaatatatgctccttttacaagcaggatttgagatttatgagatgattactggtttcctcacatgcagaatcctagagttttagagctgggaggatctttagaaatcatctaattcaaatcacttcatttttatttgggggaactgaggctcagagaagtggcctgacttgtctgagtcagtgaaactggcaaaatctgattattccaagacctctgactccaagtcctagtttttttcaccatatcttttacaatattgcatatagcttgcagtctgctaccttttcctgtaaggtgacagtttcctgggcttaaaataaaaccacagcattgaatcacaagggcactttgggacacactcacaagagaaccacaaaagtgcctgtcctggctccttaggacacactgtcgcagcgcccagaggccagtttagatgcaaagtactatattaccttcttggcacaatttagtgcttgtggttgtttcagcaaacttggcttcgatgtctagattttggatcaataaaaagttgtaggtacctacttcagtattctgggtctccctgccagaggtgtaatagaaactagattctctttaactttgaatagcattgctagaatcatatgccatgtgtagatttttgctcctcattaaaatttctaaatatcaaaaaagccttatttaagtaaaagtgagaagggaatttgcatttattatgtggtaggtgctcctgtgtgctaggtactatgctagatacatggcctacattatctcatttaatgttcacacatactccatgagaaagatcttatttccactttacctatgaggtaagtgagagtcagagaggtcggtggcagattttggataagattccaggtctgttgtctacctactctaacagcgtatgacaatctagaaaacagaattagaaaggcccaaaaccttgctagaaatcacagtcatccaaggagttttaaaaacttattctccttcctccaccctctatctcacctcctagcacttcagaatcttctgaactggaggccatcactgtattttgtaagctccccaggggatgatatgcagtcaagtttgaaaagcattgacgtaatgtttgcttctttagacctatggcataaagtatcatctatgggtatgctatagcttctgatgactagtagactgaaacccattctttctcacaaatgtatttttcattcctttaaaactttttttttatttttaatttttgtggatacacggtaggtatatatatttatggaatacatttttgttttttttgagacagactatcactctgttgcccagactgtagtgcagtggtgcgatctcagctcactgccacctccgcctcctgggttcaagtgattcttgtgcttcagccatccgagtagcttggactacaggcgtgcgccaccacacctggctaatttttgtatttttagtagagacagtgtttcactgtgttggccaggctggtctcaaattcctgacctcaagtgatccacctgcctcagcctcccaaagtgctgtgattattgctgtgagccaccatgcccaggctttatggggtatgttttttcacttactcacacaagtctttattatttgctttggtcaatgttacgtgtagggggaggaaagtctaatactagcgttccctcaaattatagttatacctacttggacactgaaaatagattcaagatgatattacaaatttgtacttttaaattacctcagtaaagggcaaattccatctaatccattttatgaatagacctcagtgaaccaaactctttgtacatatacctctgacttttcagttttggaaggaggaacttgcttagaaatacaggtggctatgcttttgtagtaaatgtgccattttttgtttttgttactgtttttcctaagttagtttctgaatttcctttattactatttactgtccacaccaggatatttgaagtaaaaactgtaaataccttctaaaaagacacaaagaatgtgatttcagctcagggagtgtttactgaacatcaggactttgccctgcactgataggagctggggcaggttgcggggaggtggtctgccctccaggaacttcatttttctgttagaggggatccaaaagaaatggaaaacatcagaaaaagacagattttgtttgtttgctttaaccacttcaggctttctaactatcatggggctctgtccctatgtcttatatatgctgagagaatctattgtatgtgcaacctaaaaaataacagaaagcttttactcgtgacttcataacattaacagcaacaaaaatctgtgtaaccttggaagaacaagtgtaaaggccatgagaactagaacaagaatggaaattgcaacatagtggagtgataacccgtacttcccatctgaacactttctgacaaatttacttttttttccccctcactaggacagtggagcattgttttcacatgtgtgatagaatggttatctatttcttcattgctgcttcttatgctccatggtaagatacagtcttcctattttcgaaggtagtgattttatgattagaattcctcactcctcctttcctttctccctcttgtccccaccctcagccctcatgtgtacaccaccttccctcctcctgaacacatacatgcatgcatttttttccccatttgatgtacttgggtcagattgcatatttgaaggggagaatattgctgctgtttataatatctgggtattggattgttcaagaagtgctatgaacttgtgtgcagatagcttgctcactcttgaaatctgtaacctttgctctccatattgtttccctatacctctgctattgttcagaacactagaaaattgaattgttcaagtggaaatgctgtaaatatgtatgaggaaagcaagcttatttatttatttatttatttatttatttatttatttatttatttattttgagatggagtctcacaatctcggctcactgcaacctctgcctcccgagtttaagagattctcctgcctcagcctcctgagtaactgggattacaggcacgtgctaccatgcctggctaatttttgtatttttagtagagacggggtttcaccatgttggccaggctggtcaggaactcctgacctcaagtgatctgcccaccttgatctcccaaagtgctgggattacaggcgtgagccaccgtgcccggcctatttttttattttttgagacagggtctcactctgtctcccaggctggaatgcagtggcgtgatctcagctcactacaatctctgcctcctgggttcaagtgattctcacacctcattctcccaagtagctgggactacagacatgtgccaccacacccagctaatttttgtatttttggggggagacgggatttcactgtgttggccatgcagctcactgcaacctccacctctcagattcaagtgattctcccacctctttctcccaagtagctgggactacaggcgtgtgccaccacaccgagctaatttttgtattttttggtggagataggatttcaccatgttgttgataccaggttggtatcgaactccgaccccaagtgatctgcccgcctctgcctcccaaagtgttgagattacaggcatgagccaccatgcttggccatttttgtttgtttgtttgtttgtttgttttgagacagagtctcactatgttgcccaggctggagtacagtggcagtggcccgtggtctcagctcatgcaacctccacctcccaggttcaagcgattctcctgcctcagcctctcgagtagctgggattataggtgcctgccaccacatctggcttctttgtttgttggttttttgagacagagtctcactctgtcaccaagcctggggtacagaggtgtgatctcagctcactgcaacctctgcctcccagtttcaagtgattctcctgtctcagcctttgagtagctggggctacaggcatgtgccaccatgcctggctagtttttctatttttagtagagacgaggtttcgccatgttacccaggctggtctcaaactcctgacctcaagtgatctgcccacctcagcctcccaaagtgctgggattacaggcgtgagccaccgcacccagcctgtttttgaaacttaagccatttgtcttcaattcacctcaagtgcagtagctactatatagcaagtgtgtttatcatttcttttgctgagtaagagaaccatttaaaatacctagtatcctgttcattgcctttgatctttctgcctttttggtgctgatcaaatataatcttttgttgctttgaaactcttaattaaagaaacattagctttcttctacaagacataatccagttttaaaaactcagaagcttatattttgcaatcatctattgtagtcattagaaacagtatgcctctagattctgactaatgcagcatcaatgattcaaaagaaacctgattatctgaaggagtaaaatgtaagtgctatctttgcccagcatctgactaaattataggtcggcttcatgttggaagaacactgaaaggcttttatgaatggacattaaatgcccagaacaatgcttatttcagtaggaacctacagggtgttccaaacaggattccttacttagttattttaaattctttaatttaaaataagtaaatgaataaaattaatttaaatgtgagctgaggagttaaatatcatagtaggcaatttgtttacctgtagttttagatatgtaggctgtactttttccatttggaaatgtgacttttgtagttatagataatcaggacaacatttgtttcttcctcatttattctttttttttttttttctttgagacggagttttgctcttgttgcccaggctggactggactgcaatggcgcgatcttggctcaccgcaacctctgcctcctgggttcaagagattctcctgcgtcagccttccaagtagctgggattacaggcacgtgccaccatgcccagctaatttttttgtatttttagtagagatggggtttcaccatgttagtcaggctggtctccaacccctgacctcaggtgatccacccatgtcagcttcctaaagtgctgggattacaggtgtgagccaccacacctggcctcatttattttatttattttttttgagacagagtcttgttctgtcacccaggctggagtgcagtggtgcgatctcagctcactgcaacctctacctcctgggttcaagcgattctcctgcctcagcctccctagtagctggaattacaggtgcccaccaccatgcccagctaacttttgtatttttagtagagactgggttccaccatgttggccaggctggtcttgaactcctgacctgaagtgatctgcctgccttggcctcccaaagttctgggattacaggtgtgagccactgttcctgaacttctcatgtattcttaatatgaaattagtacaaatgaatttgcagcattttaaaattcaaacctcacaacagtccatggttaaattctaccaaaatgtcttccataatacatgttaggaataattcttctcatactctctcttggcagagagactgataatggagacacacttggtttgtgtattaggtatccactgtgggtatctgatcctgcgtcaaaattttgttccaggttcttctcattaaggtttgtaagtaatctgctcccaaatacatggtcagaaattaaagggcaagcagttttgacctcattctgcctaatagggtaagttaggcgtcataagagtgctgggactcccttcaacttgtctgcttttagctggttctatttttaaaccatgttgaaactaattcttttttttttttaggtggagtcttgctctgtcgcccagactggagtgcagtggtgcaatctcagctcactgcaacctctgcctcccgggctcaagcaattctcctgcctcagcctcccgagcaacttggattacaggcacatgccaccacacctggctaatttttgtatttttagtagagatggggtttcaccatgttggccaggctgatcttgaactcctgacctcaagtgatccgtctgcctcggcctcccaaagtgctgggattacagatgtgagccaccactcccggcctaattctgagtcttaaaggtcgactgacaaatttgtttttgagttgcttaattttacctaaattgcccaaatgcctgcttgatgtgttgagtgtgttttcttcctgctcttatcctaagactttctcagttttcaatgacacaggttctatgaattcccttcatttatcacttctgttctttgttgtcacgtttacatttttaggttaaatcttcgtgaacttggacccctggcatctcatatgcgttggtttatctggctcatggcagctggaggaaccatttatgtatttctctaccatgaaaagtaagagaaaataatttacatttgatagttttaaaattgactgcctaaatattatctgcactgcaatacaatttacttttatttgtacttcaaaacagtagaaatacatatatagaatatgttatttttaataaatcttcaaaaccatttggtattcattattagtggaaagattgctgtggaaaaacaagagtggtacaggtttggtataatgtagttgaggggacatggtaaccagcccctttggagtccatcagacttcatttctatagcatgaggcaaattggccttattctctgtgattcagtcatcacgtgagaaaaccagccacttgtcaaggtgtctatgaagattggagagaatagatattaagtgctcagtacaatatacctaaataagggcctagagggtattccaaaaagggtatcttgagaaaaaggatgttgggaaggacattggaactcttaatatcctatccctagggcacagctttttagccagttattcatagctgatagtcctaattattgagccatataaaaacaaaagctaattgaaatttagtatctttgctctagaggagaccttcaaggtcccctattccaacttcatgattaaaaagtcagaacatttaggatatgcatcaaattagtgactcatctggaaattaggacccaaacatccaagttctgattccattgctctttttattaccctgtatgtttgaatttgagaaacacacaaccaggaaatctttgtcattgggtttatttacagttcattaaattctgtatctattgtgcttggcagaatggctctcagaattgaacataatttgtgtttatcagaaaatactaaattgttttcccctttcagaagaagaaaatggtagttttcactaacttctttttgtctctgaaattcacttaaatacctttttgaccataattagcaatgctgagtagtgttatatattatagcatatttaagtccaagggaatggtttgcttcttggactcaaatctcttatttatatccttggataaaataggaagtcaagaaaggcaactatcttttctccttttcccggccttctggtgtaaacaaaacccataaacccattcttcccctatctgattatttcatggtaggctttgagtataaaacacgatgaatgaggtatgagtcacccttggccattcagtttggcagacattagggagtacctaaattgtatcaggtactgttctaggatttacagatcaaaacataattaatcttggttcctgcctttgaggagcttatcgtctggtttgattaggctgaaatgtaatttgaatttcaatacaatgtatttcttagggtttttagatcttttgtagtctaacgtgatgagccttaaaattacagtttgtgcaggtgcaaaataaagagacaaacaaaattacacgtcctttccttagggcttgctgttcctttttgctgataaactaggctccaggctgcatctccattcatcttcagaatttcacttctagctctggattggaatggtaatgaaagcagacactctaggatcaaaagaggaaatattttacaaggtggagtgggttaaacgataactacttttggcagaaaacattttcttttttttttcttttctttttttttttttttttgagactgagtctcgctctgtcacccagactggatggagtgcagtggtgcgatctcggctcactgcaagccccgcctcccgggttcacgccattcgggttcacgccattctcctgcctcatctccccgagtagctgggactacaggcgctcgccacgcccagctaattttttgtatttttagtagggacgggtttcaccgtgttaatcaggatggtctcgatctcctgacctcgtgatccgcccgcctcggcttcccaaagtgctgggattacaggcatgagccaccgtgcccggccggcagaaaacattttctaggtggcatgtgggatttgatgccttttcaaccctgagagaaatgctagttccttgttactcagctactgtgttttagttagaggcctagtggttgcctactgagaaataaagttttatttgaatagttaagagtttacatttctttctcaaaagtaaaaaggaaaggctggtatgtaaattgttaggtgttatagaaatttataagttaaattaactgcatttttgttcctgcagatataaggtggttgaactctttttctatctcacaatgggattctctccagccttggtggtgacatcaatggtaagacatggcttcagaattttagttattttcttttaagctgctggaacttaacatgattatggatatgatatgtagcttttctttataaagttatgtccattaaatagaggctcaaaagaaaaagaacttataaataatgaagtgtttagctcggcatggtggcatgtgcctgtggtcccagctacatgggaggctgaggcaggaggattgcttgagcccaggaggttgaggctgtggtgagctgtgttcatgccctacagcctgaggaacagagcgagaccctgtctcaaaaaaataataaaaataatgaagtgtgccagcaactcgtaagcttgcactaggtaccgtgtacagtttgggaaagctataaattcaggtatgtttctgtctttatggtactttcctgaatcagaaccagaataggttcagagaggtatttttcaaatccctttactcttacttttcctttcccttgcttttaagtcgtaagtcaagcactttttttgtttgtttgttctgttttctaaggcaagcacttttttttttcttttactttgcttgaaaatatcttttggggattttcgtgggtaaagtgtaacattacctgtaataggcagttgcatgtatatatttgaattccctttcaaattgaattactgttgagaagtctgtgtgtgtctgtctttttgaaatgaaaatatattattacgacttcatggttccatccacctggttaccagccctttagcttatatattgcagtatcttaggctctaggcactatattaactaaggaggtcccaaggtgtttcgtttgaacccttctgagcctacattgttcagaagaactgtacttaggatttcactcctaatctcataggcacattgtaagaaccttttttttttttttcttttttttgagacaaagtcttgctctgttgcccagctggagtgcagtagagcgatcttggctcactgcaacctccgcctcctgagttcaagtgattctcccacctcagcctcctaagtagctgagattacagatgcgggctgcaacccttggctgattttttgtatttttagtagagatggggtttcaccaagttggctagtctgttcttgaactcctgagctcaggtgatccacctgcctcggcctcccaaagtgctgagattatatgcgtaagccatcacgcctggctgtaagaacataattctgtgatagtttttttcctggtcacagaaacacctataaaaggtttaaaagtttcaaatctggttctgttttttcaggggatgtcttcatgagaatataacaaaatatatttctttgagatacgaggtttatgatggctttaataattacctagcacccaaaatacatatagatggtaaaagcaacagggaatggtaaggaggaggagttaaaggacagaaatgagaaaatcagccttgaaggccatatagttagaaggcatttcaggacaccccaagcaatataagcaaggtttgtgcagcttaatagagtagaatttcaagcaaattccctctgggtatcataagagcaggtttatccagtaattttactagcctaaatttgaaattgacatttccataagtggtacaatagcaggtgactaatgtttgtgataatcaagcaggatgatcccccacactgccttcatagaacttagagtcaagcaggcaaatgcagttcctattaaagaaaaagagatcatgaaatttgataaaatatttgatgggggaaagttcaggctgctatgcgaacacgacagaagtaccagaggaagtgatatttcagctgatttggaaaaacatgtagaagctgagagatggtaggggtgaggcaagtgttacaggtagagaatacagcatgaaggaagcccagagaagggggaagcaccagcatctttggagaaatgaaaatagctcattgtttgtaacataaaatacatgtaccagcttgagttatgtacatatgcatggtgggggcaggtatgcaggtagcacaagtcttgtaataaagctggagagctagacaagagtccagatcacaaaggacctcaaaagccactaacacagtaacagaatgaatgaaaatgcgaatctttggttctggccagaatcatgggtctcagacttacccttctgccataaagaactgtaaaactagaaaaagaataaaggcaactgtttttttggctctgaacccaaacagtacaggactgtgatccttgaaggaagagaaaccaagaaaatgagctttgaattcaccccagtagtttccctggagacactttccaaacagcaacaaaaggaggtaaagcccagagaacagcagcctgggtggaggaaacagaaattacagttcaggttactgacatggctgcagtttgtggggcagggtatggaagaggaggaagccgctcagggaggatgcttcagaaatccatgaagcagtttccgtgagtcgttgtccagatatcaagctgaatgttgtacgggccaaaactctgcaagctccagttgcaaataactcttagaaggctggaagataaatggaaattccggacagttcccagtgctgaaagacattgaagttccaaccaagcagagttcagagatggtgctggacatcccaggcactcagctgaccctgccaaggccacagcttaggagtagagctactctatccctagagggagggctactctagaactgccataacaaggcccagacaaaccttgaaaggataaaattgatcctccagtaaataaaccgcctaacagaacaaaactcaacaatttttaaaggaatacaacagaatctttactgtaacaacttagcatgtaccataagtaaatattatcagaaataaatcaataataatgtaataaaataaataataaatatataataaatattaccagatgggcaagaaactggaaagtgacacatacctaagggaaaacagatcaatagacacagatcaaaagacgggagagatactgagattcacacacagggagtttaaaacagatgaggaatctcagaaaatacctggagactatgaagaagaatccacatggagattctagatccgaaaactgtgatgtcttaagaaaaaaaaattattggagggatttaataacagattggatattgcagaagcaaagttcagtgaacttgaagccaggtctgtagaaactatacaaactgaagcatgagagaaaagagtgatttaaaaatgaacaaaagaagaaagaaattggggcagttttttgttttgggttttctgttttacagtttttcttttctttttttttttttttttttgaagaaataatagttacaacttttccaaatttgatgaaaaatatcaacctagagatccacaaagcacgaggaggcctgagcagtataaacacaaagaaaactacactaagacacattaaagtcaaattactaaaaaacaaaggcaaagacaagaccttaaaatcagccagagagagaaaaaagagcaaggagagaagatgaccactgacattttatcagaattcatgggagcaggaatacaatgtaatggcacatttaaaatgctgaaagggtccgggtgctgtggctcacgcatgtaatcccagcacgttggaggctgaggcgggtggatcatgtgaagtcaggagttcaagaccagcctggccaacatggtgaaaccctgtctctactaaaaatacaaaaattagctgaatgtgatggcagaactcctgtaatcccagctactcgagaggctgaggctgaggcaggaaaatcgcctgaacccaagaggtggaggttgtaggaggttgtagtgagctgaggtcgggccactgcactccagcctaggcaacaacatgagactccatctcaaaaataaataaaataaaataaataaataaataaaatgcggaaaggaaaaaacaaaaaaaccctatcaacttcaagttgaagttagcacagtttagtaatattaatgtcaaaaatttaaccagggaggccaaggcaggcagatcacttgaggtcaggagttcgagaccagcctagccgacatggcaaaacccgtctctactaaaaatacaaaaattagctgggcgtggtggtgggcacctgtagtcccagctacttgggaggctgaggcaggagaatcactggaacacgggaggcagaggttacagtgagccaagatcgtgccactgcactccagcctgggcaacggagcaagatgctgtctctaaataaataaataaataaaccaggattgctagaaatgatgaatttgtatgtaaatacatggctgtttttcatttcttaatttcttcacaagataacatgggggtttctaacatgtagaagtaaagtacatggtaacaatggatggggtggagaaatagaagcacattgttttaagggtcttaaccttgtatagggggtataataataaaggtacattgtgatgagctaaggatgcacactgtaatccgtagaataaccaccactggccaggcgcggtggctcacgcctgtaatcccagcactttgggaggccgaggtgggtggatcacgaggtcaggagttcgagaccagcctgaccgacatgatgaaaccccatctctactaaaaatacaaaaattagccaggtgtggtggcacacgcctgtaatcccatctacttgggaggctgaggcaggagaatccacttgaacctgggaggcggagtttgcagtgagctgagatcatgcactgcactccagcctgggcaacagaacaagactccatctcagaaaaaaaaaagaataaccaccaccaccaccaacaacaacaaaagcaaaataaatgttatagttaagtagtcaagagaaaagataaaatggaatcccaaagttattcaatttagtctaaagcaggtgggaaaattggaaaacggaaacaaaggatggatgaaaccaaatagaaaacagagagcaagacgggaggcttcaatacaaccatatcagtaattaggtacctcatatataataacaattacatcacaatggactgaacactccaactaaaaggcagagattgtcagactggataaaaaagttttctcatctgtataatggagataatagtacctaatttagggtcgttgtgaagattaaatgaataaatatatgaagtgcttcaaacagtgcctggcacatagttacaataatgataatgataatgaaaaaaaaattctgttttgatacagaattaactatgttctaggtctttgaaagttgaggtaaatgtggtatcttgaggatactagttaacagaatgcatgtcaaaactaacctgcgtacttggtttggtgtcttgcttgttttggcagaaaggaaaaaaaaggatattttgtaacagtgactggccatgtgattttgttcaggccacttcactgctctggccttagtctcctcacctctgcaataagggggttgtgttagatgagtgactcttactatttgggagtccctgtgcccctttgcgaatctgatgagagccttacccctatcctagaagagggctcctaatacacacacaaatacttttgtataatgtgtattcattgctgtataaccttgaggaattaataacgtgtggtattttgtctttgtttttactttttaaataaaaataaatctagctgaagtcctttcttaccaaggttaggaagaaatccaatgtcagtccatttggattggctccttccccatcttttgatcccacacaaaacatgggggcttctgtgaactttgaaaaaggactgaagctcacagctggccctagatcctcacacctggtccttagctcatgatggtctattgttgccttgcttttagccgagggccttggggcccattctaatcaggtgcctgagttagagcttccctttactcttgcggggcacacaaggctgctgcccagtgcccaggcctctaggacacccacacacctatccccttccaaggccctgccgtgatctgccttaggtttccattcactctgcagaacctgtctcctttctattcctagtcctcagaaatccaggggactaacttgtttcttcatcagcttctaagcattgcctctattctctctcctcattcatacaagccattttaatcttgtagatgggccttggtctttgaaaaccaagaacagcctaaaaaattctcccttctgccctaagacacacaagaatattaacttattgctaagctaagcaatggccaggctcgaatacaaaaaggcctggagacatctagaaggctaggaaatatcttgtactatgtgatctgtgatttcagaggtcacttctagttacggttttcctgtgtcagccttaaggaatctataagctcacataagcaggggaagtctcaaagcagcaatcagtgtagaacagtgtttgagaaggacaaagggaagtaaataccctgcctgagatgtaaattataaatagagtggcttgggcctgccttagtagggaaggaagcatttaaaggggaagatgagaacagaggattgcactttattaaaatgaactcccatgtctggctatgattgcagtttgcttaaatatgctgtaaatgagcagaatgttctgctttttcatttgggacctgtaatgtgattgcttgctcaactcaagagtgtcagtccaaagggcaatccaggtcgatgtataagagactttttttatgtttggttcatgtttacagatcaggattgtgttcacacagcttcttcattgtctagaaaatcaagagccttagagagaattacagttatctgtagcttgccatgcagagtaacatcaaaccctttttatttttttttctctgttgacagaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttccactgtctctaaattagatgactgtgaagaaaaatgaatacaccctgtcacttagaactttctagtctactttttaataattgaaatgccagagtcagctcaaacattaatcaacagacattttcagtttaaaatacactagtcaggacctaatgatttcaagttttttagatgatgcatccttaccaaggtaagccttttggtttagcatatttaatattctataggactgaggtgacagtcttttatgttaccaaccagacaagtagcagattataaatcttaacaactctcctagtgttagatgccattctacctcttctgtagtgtgggaaaccagggccagagaagttcaactgcttcatcctaaatcagggagctggaacagcaaccagctctatctgattccgaagcctcccattgactataccactgcatttctagagtcagcaaaaacaaataaaaaaacttgaactaaaaattcatcaggcatggacacagaaaagaaaacactattcacatggtttagaacctcaataatccctcagataactctctgtcaaatctaattttgaagattgagtgtcttgaagcgttatgattcccaagagttctgtcctttaggtcaccagtgtgacctcatccatttctagagtgtccccactattgtgctgtcagcttcttggtcagtatcttcagccttaaactattttctaaggactagacctctctctagtcaactgcctaaatgctcccagacatattgactcaaaccgtcccaaactgatttcattatctttcctcatcctaccaccaaacctattttctgaaatttcctaacttagttaatggcatggccacagccatctgttcattcatgcatccttgatttcttgcaccccccagatgcaacaggtcagccagaactgtcacccctgcctttctcacaactccctggtctggttcctcacctctcttcacactgcagggtcctaaaaagacctacttagcactcatcagactacagcagccacctcctcatttgtatccctgccactgcttacacccctcaaatgagctcatcctccacactgtaccagcattatcttcccaaaataaaatctgagcatgtgtctcgatgctccaaaacttccactgactattatcctataagattcacgccagatgctttagcatggactcttcacatgctgactccgcctgatcggccctctccccagctgaaccccacttgacatcagccctgctagtgattttcacagcctcccccacaacacacatgccctcatggtgcttttgcagctgtgtttttgtacctgctgttccttggcctggaatgcccttactccagcccctttcctacctggcaaatagttgcttattccaagccttcatcaggtgccacccatctcccttgtgccattgaccaagttccccctggcatgagtagtagtgccctcctttgaccccatggcacagatattccttcatggcccctgtcatggtgcattgtgattgtgtttactgtctttacctctggtcttgggactgacctccttcaggcagggacagagtctcatccacttctgttcctagcttctagcatagcactggcttatgacaagagtgaagaagttttgttgaatgaaaggggcagggtcgggggaaggttggagaatgttgctgtggaagggaaagactgagaataaagcattttttaggacagactttggttttagcaggtttatcctgtccatcacaagcactcttactagctggaaactgacttttagcttcttaggccttagaggcttttttgaccacaagggtcagctagaacattcgtggcaaccacaggaaagttgatgagaaaatagagtgtaaatattagaaaatatgtcctaaagaagaaaatgtccagcatttttattggtgctttcctagaaataacaatttacaaaattattttgagagaaaaaagt

SEQ ID NO: 15757 - DNA, 44072 bp, Human
aagtcatgatagcctgcatttaaggcctcagactagctgagttatctagcaagtgtggaaatgaaagaaaagagatcctaggacttcgacctggggcattctgacataagaattattgactccatcagttttaacatccaagaaattttatcttaacatttatggagccccaaggcttcacaaaaacctggaataaaattcccaagtgtcacaatgctggcatgaagtggcagtcaataaatatacatggaatgaatgaatgagctccaaaataaaggtttcaaaaacccctgagattttgcgattttagaaccccaagtttcttcccacccatgatgtgttaggttgaatggtgacttccccaaaagatatgtccatgtctcagaacctgtgaatgtgactttgtctggaaaaaagagtcttctttgcagatgtaattgagtgaagaatcttgagatgagatcatcctggattatctgagtgggctctacatccaataagtgtccttataagaaacagacatggaggaaaaacacagacagatggggagaaggccatggggctgtggcagacattggagctgcggtttcaagccaaggattgacagcagctgccagaagcttgaaaaggcaaggaggattctagcctagagtctccagggagagtgcagccgcctggctgacacacgccagtcctgccaacaccttcattttagacttctggccttcagaacagtgagaaaatagatttctgttgttttcagtcatccagtttgtggtcatttgttacagaagcctcaggaaactattgcacatggtctcttttagctgatgctgatgcaatatttcctttggagctctgctgtattctgattcagtgattctcaactctggctgagcattagaattgcctagatgttttctaacaaaggttggttggtgtctggaacatcctcagagattctgattcagtagggctgtggtacaggctgatattggtgtagagtcagacataagaattgccatttaattagtcacaacaacttaacatcaaggggtggcacagaggtacagggggtgggaatacctatataattgtttcaccttaggaatttgctttgaaacataacaatatgtgtctttacattcaagtatattcttagaaactagctgaagccgtttcgcatccttgtggcactaagtcctgtttccactgtgaaacagttaccaagacagtcctgtttccactgtgaaaaaataaatggatgttctgacaggtggccaccattgctgacctgaccattctccagaagcaccaggaggcattgctttctagactgaagctcagtcatgcttcactttagtctaatcaaaaagatttgcttgcaagccttcattccaaatggttccagtgccttccatacaatcagataatgacaattgtgagtttctggtggcatgctacttcatgtaattaaaaaaaaattgctgcgtagatgtgctgaataggagaagagtaagttattatttggagggaagaggattcccaattgtggaacaaagcaattccttgtaccctggttctacataaatgtttctttatttttgaagttgcatgaccccctgttgtggtcttttttgcacacatgtcagaaagcagccatgagtgcattgtagttggcaatgtgagcttctgtgtaaagggtctttgacgaagagctcactgcatctactgactccccaggatgtctgaggtcacaagtttggctggagcacatgagcccagataaagaagatggttttgccctcctgaaataaagccagaagtgatctcctttattgtgcactttgggtcatgtgctaatgatgagggtttctgtaatactaatccccctaatgaaggcttctcccagcccttacacaagcccccaaggccccgtggcttggcaagccagagagaataaaagcagcacggtgtttggcttttgaactgagttcaaggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggtgaggcccatgctccaagcttggtggggagggccagagctggggaaagagctccttctaaggaagagatgagactcttgacagagactcttagattaggctttgaaaggcaaaccaatgatggttttggtcggaagcatattcaataaggctgatgtgctggtttattcttcacaccctctagtacatctagttatgaagactaaataaatatggcgtgggccaagcctgcttatatgaatgcatgccaacatactattggcttgtttgttggaaggggaatttaagagcttaaaagcgtcagctttgaaactcggagcaagtcctttcaagatggattcggtgccctctcctgaaatgggtttgcacttgttgaaaagggatgggtgaagcttggcattcggaagacaggagtcaaaggcaggtgttctggtctcagcatttctcatgatttgaacagatctctctctctctcttttttttggagatggagtctcgctttgtcaccgtggctggagtgcaatggtgctatctcagctcactgcaacctccatctcccgggttcaagtgattctcctgcctcagcctcccaagtagctgggattacaggcacccgccatcatgcctggctaatttttgtatttcgagacggggtttcaccatgttggccaagctggtcccgaactcctgacctcagcagggtgcatgtttctcattaaagcttatgaccaggttgtaactttgacaaaattgtcgagacgtggcaagacagagctttctcgaggagctgggggtggggggggcgggcggggggttgttattagataacaatggctttttgtcactcttctctggacttgaaccggacatcacaaaatttgctcagtgtccttcctttagactctggtctctctcattacctgttgctttgacatctctgtgcatttctcattcctctagctctttggggctttttcaaatcctcttcaatctttcccacctccagtttccagcagccatatgcccttcgggaataaacactcaaagcctggcagggggccactgaaatacaaaaaacacaagtggcaacctcaggaaagcccttggacactgttgtaggctgggtggttgcagaagactttttccttttaaaaatactttttacttctcttctcataggatgctggaacataggaggatataggtcattgagcttcataaggggttgaataggtattactaagggaacatacaaaggcctgtgatgttggtgtaggaatgacattcgattttttttttttaattttaactttcaactttattttagatcctggggatacaagtgcaggtttgtgacatagatatattgcacagtgctagggtttgagatatgattgatcctgtcacccaggtagtgtgcgaagcacccagtgggtagtttttcaacctttgacccctccctccctcccctctctagcagtccccagtgcctattgttgccatctttatgtccatgagtgcccagacattagatttcttttttcacattaagagttctggctttaggcctggtgcagtggctcacgcctgtaatcccagcactttggaaggctgaagtgggtgggtcactttgaggtcaggagtttgagaccagcctggccaacatggtgaaaccttgtctctactaaaaatacaaaaattatctgggtgtggtggcaggcacctgtaatcccagctactctgggggctgagacaggagaatctcttgaacccaggaggcagaggttgcagtgagcagaaatcacaccactgcactccagcctgggtgacagagtgagatctgtctcaaaaaaataaataaataaataaatagttctggctttataatcattttgtagtaatatttttaattctgtcattcagaagaatatctaggtcctggttttgccctgggtattaatcatgacaaaaatttcaataacatattggatatatattatccagcttttctaagttttttaagcatttgcttctatagaccttctctcaaaattatcatggtgttttagacgaatgaggagcaggttgctggtgtggttagcgtgattgaaaaccacactaacacagtaacttctttgttcaaaaccccaaaatacttctagaacaattatttctatgtcaatcaatgaaaaagtgctggccaagcgcagtggctcacgcctttgggagccaagcactttgggaggccaagacgggtcaggagttcaacaccagcctagccaacatggtgaaaccctgtctctactaaaaatacaaaaattagcgaggtgtggtgatgggcacctgtaatcccagctacttgggaggctgagacaggagaatcacttgaacccaggaggtggaggttgcagtgagctgaaatcgcgccactgcacgcagcctgggcaacaatagagtgagactgtgtctcagaaaaaaaaaaaaaaaaaaaagaaagtgccaacactttcaaaaagttgtaaatctgcattgcatagaatcctgaggcagaggactttaggaagtcacatataaccataaactctttttgttaccagcttcttcatatttttgccatggctagcaagttttgttttgttttaggtagggatagaaagaatagaagggatcattgctatttccctttggtaaggaaatgtttataaatattgctctagaagtaataggaacttaggatcatggagacctaccttcaaaaaaaaaaaaaaaaaaaaaaaaaaagaggctccccctgctctaaaaagcccttgggccagaaataaatagggcctgttctttaagtccaggctgtaaggaagtcccatgtacataagccagtccaaagaagcagggcttcctccagggagatggtctgcctctccagccattgtcaaggcccggcctggccctgaggccccatctccaggctgtggctcacctccccccgtgatctgctcagtccaaactcatcaggaacagaactctttccacacctacatttttttaaaggtaacttaagatttactgtatctataagttcaatttactagacttttaatgtttcccagttttattgaggcataattgttacacagaacactgcacataattaacgtgcacaatatggtgtttggacatacctatacagttgtgttgccatttccacaatcaagataatgaacatattcatcatctccaaaggttcctcgtggttctttgtttttgtttattttttgcttttgtggtaagaacagttaacatgagatctgccctcttaacacatttttaagtgccgaatgccttattgttaactataggcactatattgtacagaaaatctctggaacttgctcatcttgtatcattataactttacaactccctatcgcccctcccccatcccctggtaaccacaattccgtcgtgtacttctctatgttcagctactttagatgcctcatataagaataatcatgcagagtttgtccttctgagactgacttatttcacttagcacaaatgtcttccaggtccatccatgctgtcgcaaatggtagaatttttttctttttaaaggctgaataatattccattgtattgtcataccaactttggatggctctacttatcttgctagatggtctttttctttgaatctcagggcacgagactaagtccttagtgactgagctgggaagttattttgtgtatgtcataattaccattctgtgatgagccgtgtgtcccaaagcaggacacatgtccttcaattaattattccccaaagagtaagttgctagccttcctagggtagcttttttatggtttgtggggcaatctttggaattgaaacctgatcctgagcctcccagagaacatcctctacagtagcctgatgactcttttgcgaatggagtcactggggcactcctgggatgatccaaaatttctcaaggaagagatgtagattagtgtcttgtaacagactattgatgaccccaaatgttgttaattctttggaaaataaacacctcatagtttccataatcatgaagctggtaaagtaatttcagcctaataagtagaaacacatagaaattctgggatttgttttttaaaactctaaattctatggtgaaattctctgtagagagcttctctatagtctctgtagggataaattgaaacaaaaaagccactgagcttaattgtcaggaagagctgaattgcaggagactttgaatttgctattcaccttataaggcttacctgccagttggctttatgagaatatgccatttgcagctatgtcttttggcttctgaaaaacttgcgcaccaaatagtttttgaacagttgacggtgaacttcttgtttgtacaagtgactaattgcctccattttccaatctctgaaatggggataatgatgaaaccacacttgtaaaatccttttgatttctgtagatgaaaggacctatgtaagtataaagtattgttattaaaataatagaatctctaattaaaaggaataggctatttagagttccttgtaaattcactaatcggtggtctttaagcttatttagtctaatggctttctgaggttgagctgatgcagttcatgtaggaatgtgtggtgtttagatgatctcactcttttttccatttttatcatagtcctttgtaaacatgagactttgactctttaaatttaattttcactgaaggacatactcaatggtcgatagattgatattatctaggaatcattttttttcctctctccatttcccagtaagataacacggttctttctaaaacacttctcttcttatattttttgcattggtagattaagaagaaaaaactaaatcatgttaaattgatggaagatgctattaggaaaactaaattaaagaaataaacattttgtctgctaggctttcatgttgttacacttttcagtcatctccagcatttcaacaaattcttcaggtcaggtctataaacttagaaatgaaagggacctgactgcagagctttggaataatttctctgagacatcttggaaaaggaattttttaattgaataaatttctgggtcataaatgggctccaaaacagacacaagctttctttacccccccacttcccattcttttcacagatgttgaaagctttcttattagaacttatacattgccttttggaggcaactctggttacattaaagtttcttgttcactgtagttgtgaagcatctctgattttctgaatcaggattaatcatttcgtcatttgtcatccagtggagcttgacttattcctctgttttcacttttcccacagtttgacttgtgttgaaatgtcattgtgtacttgtccttcatttccactagactaaggtattattgcctcatttatacagatgctccctgacttatgatggggttacatcccaataatccatcataagttgaaaatactgttaagtcaaaaatgcatttaatacacctaatctatgaacatcacagcttagcataacctaccttaaatgcactcagaacactaacattagcctacagttgggacaaagcatctcacacaaggcctattttataataaggtattgaatatctcatgtaatttactaaatactgtactgaaggtgaaaaccaaaatagtcatatggatattcgaagtagagtttctactgaatgcatattgattttgcaccatcctaaagttgaaaaattttaagttgaaccatcataagtcagaggccatctgtatttgtattcactagtgtctgatcccttttattcaattattcattgattctttcaccacccatccaagcaacatttatttagcatcaactaggcccttcagatacagagagggggaaaaactgacgtgattcttaagatgtgcacagtatagtcatatgtaagacagatatgaagacaaacaattgctatactatttgataagtggtctctaataatactagtaataataacacaatatagaactcacggcagggtgcggtggctcatgcctgtaatcccaacactttgggaggccaaggcaggtggatcacccgagttcaggagttcaagatcagcctgcccaacatggtgaaaccccatctctactaaaaatacaaaaattggccaggtgtggtggtgtgcacctgtaatcccagctactagggaggctgaggcaggagaatcgcttgaaccggggaggtggttgttgcagggagctgagatcacgtcactgcactccagcctgggtgacagagtgagactgtcttgacaaaaaaaaaaaaatatatatatatatatatatatatatatatatatatatatatatatatgtatgtatgtatatatttaactcactgtataccagatgtagttctatgtgctccacattaatgtgcttgttttttataacataaaagctatggtagcataaaggaagatgtgttgattgttgtattttttaatagactttagagcagttttaggttcacagcaaaactgagtcaaaagtacagagagttgccaaccccctgccctcacacactcacatctccctcactgtcagtgcatgtttagtgttggctaccttttagatagtagctgttcaataaattgtttgttaaataaatacatgagagagccaattattttgtttctgccaactacaaagaatcatggcaaagaaaataagagtagtcttcaaattcatggcataagttatgaatgactcagtttcaacagtcaggcccccaattcaaaaacaagtgttatgcctttaaatgtaaaaaggtattaaattattattataaattttaggtgtgttatttattaatatttttaaatattgagactttattattttagatcagttttggattcacattgaaattggggagaaagtacaaaaaattcccatctaccttctcccccacactctgcaatcttccactagcaacatccgcaaaccagggttacaatcaatgaacctctaccgacattattatcatccaaatttctcagcattatgaagcaaggaattactcttctactgcagagaagtgactagacatttacctccaatcagctatagataggcagctggaaatttgactgaattttaatctgggtagctactcttctttagacacagcattttgttcactcagttctcaaaacagtgttccattcctgtactgtcatagtaggtgatatgttttaatcaaatctgtttttaatacatacagttttagtaaggttgccccagggaaaatagacttcaaggtccataaaacgaagcatcttgcatagcatctgatgagatagtagccgcttcataaatatttgttaaataaatagtttgtatttaattatctccaggaatcaatgtacattttaatgtttaacttaaactattcaaaaacattgttagtcttgggaagagtagaatttttccttttttcaatattttaacttatgttctcatagagtgctgtaaaagaaaaatacagataattgagctacgtaaaaggtgggatatatgatatattataaaaaacaaaaaaactcaaccgattacaattagaaaaaattctccctacttacattttaaggaaattttctttaactatcagaaaatccactgtagaaaaggaagcctgtgcattttctttacagaatgctgttaatcattttgttttcatgctgttggaaaattttcctttccttgagagatccaaataactccccctcccctatggtcatagtactttttacttacctctattttgctacttgtagtttaccaaaattatttataggggctgctttttctgcaaacccacagaacagggagagaaaatgtatgtggcatcatctgctacatgctcgatacttctgttattcactcaacacacatttgttttgaacaaggctaagcacaggcctaggcagtgagttcacagccttacagctgcctggagctgaaacaagtgtagtaatgtttacaatcagtgtaaataaatgtgaagaaaggggatgtatgaggtgcaaggaagtaactgacccgaaccccgacctttggaatcaagaatgaccttagagagcacaaacgtgaagcttaaaggagaaatggatcacgcaggtaaagaggaatttagggagacagtgagggaaaagtgtttcaggaagaaggaaaagcaagcaaataggcctagggcatgaggtagaggaggaggagtaagtgagctggtcaccctctttaaatgctttacgtaatccctttaatcttctgggagataagcattatcatcccctttcgtttcaatcttgtgctctaatgatatttaaattttaccctctaacctaaggaatgaaatgttggtcatacccaaaggcaataagttggaaggctaagaagggaaaagtctggggcaagctacaaggatgtaaactttagatgctgatcagagagatgcccagagcttgatcttattagtcctgtcctccttccctgggctttgagaaagcagggagctttgtgcagctgacagaaatcctgtggtggtttgtacttcctgacatcatggctactgattcaccctgaggacttgacagcttccgttgattttgtcttaatgctgtcaacttcgtgaaataagtcagctttttaaatgtgagatttcttctaaattcctagaaatcagttaatttatgtatttattttctttctttctctctctctttctttctcttcctttctttctttcttttctttctttttgagacagagtcttgctctgtcacccaggctggagtacaatggcatgatctcggctcattgcaacctctacttcccgggttcaagccattctcctgcctcagcctctgcagtagctgggactacaggcatgtaccaccacgccccgctaatttttgtatttttagtagagacgaggtttcaccatgttggccagtctggtctcgaactccagacctcaagtgatctgcccgcctcggcctcccaaagtgctgggattacaggcgtgagccaccgggccaagccatgtatttattttggtttcatctttagcttgctgtgtattttcttccttctctaaatcaatgaactgttctgtgtcatccctttttgtgggcgtggagtggacgcaggaggagacacgcctgcgatcctgggaggaaggagtgtgtgcatgagtctgctactgctgccgtaacaacatcccacagactaggcagcttaaacactgaaattcaccctcccacagttctggaggatggatggctgagatcagggagttggtttcctctgagggctgtctccttggcttgcagatggctgtcttctccctgtgtcttcatgtggtcttccttccaaaactgtgtccaaatttcctcttcttttgaggacaccagtcatattggattagggcctactctaattacctcatttacccttaattacctctttaaagacactatctccaaatatagtcacatacgaggtatactggggctaggacttcggggacacggtttagctcattgcagtatacagtgtatttcatgtcctgtttctttgctgggaatgtgtctaggaaaccctctagtgcttagtccacttggagatataaacatttaagaggagaccatgggaggaaaattgactttctttgcctttgtgtaagcaccttcatcttctcttccattcaaatttcagagtacaaattcagaaatttcttccaaacgacataaacccccttcctttccatctttctgttttgtgaactaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggtgggttttttccttggctgaaggtatattattacaggtttgtgattgggttgagggtatggcagtgggaagtaatttcatgcaagttaattaagagagcaaccacaaggcagccttaggtttatgaaagtcgtagaattatcaaataccgcctggagttagaaggaagcagtttcttcctgtgcattggatgcagacactttaaatgttctctcctctaccgtatgttcttggttcaaagtgtaaacttttctctgtgaagctgttaatcatcaaagatgtgagttggtgaggtggaggcgaattccttttgatttcagaagaaaatatttgcgaatctggccatggaagccctctctgaccttttctccaaattagaggaattaactgaacatgtgctaaggcacatgaagcttctttgtgcggaattagagtgctcatgttgggagtgggcatcttgttaaactcacaggatagatcaactttggatggattttagacagtctatcacatgatagactttcagataatcatttatggtactcctgcatggtccggaatccccaggtttcttggagctttattgtcaaggaaaagtacaagcttagccacagcaatgtagagtttctgctgcttagctctttgcaacacagtcatgttggatgcttgagaaattggtgacctgcccttccaagtcttaaaaattgggggctgggtaggacttggaatgagggggttgtctgttacaaacttcatgtatcaagtaggttcagctttgtccttatttttcagtcaaaggaaagccatagacaccaatgtattccaggagggcttgactccatcctagattcttcccatagcagttcttgaatgcatggctgcacgtgcacctctccccatttttggggtccttcattggggtcaggatgaatgaagacatcaagctcactttgaagagcaagattctgatttggacaggttcatccttctgctcatcacttgttccccttcaattgataccctctcgttgttgggttctgagaatttgaaaccttgctctgaattgaacatgaaaaagggccgtgtagccaacatcagggacagcagtgcttttctcagtgtgagtcttttaaaacttgccttacaggtaagcatctgtctgtctttatcgatagataaggaggctcttttggctataaacctttatagttttcctgttatcactctgaggaattattgctttatgagagagtactctctcaagaggaaaagaaagtcctagtttctggtcatagctacgaattaaatttatattcacgtctgttcagctctctgaagttgttataggtattttggacaagaactaaagttagctaaagtttccacataaccatcaaagctgttatgaaaaagggaagaaggatggaccaggcagtaaggaggtcattaaatcgtccagagcttttcactaaaattggcagttccagtgtccagcctaaatggcttgaatgtatttttctctcttctggtctcagcgaacatgcttgtcagctagtagttataacagattgatgggtgaggcaaaatacgcgaaagttctttttggttacataaatactgcattaggactaagtgcagttgaagttacaatattattaattaatccctcccttttaaatttatatctttgtgaagcataggttagcaaatgcctttaaaaaatatatttcctttaggtcttaatgatctattcttttggatagtctatttcacctgaatggattgttgcttacaaattaaatatgtatcaggggctcccaatcctgaaagtcacctgaatttcctggatctctgctagaaatcaaccttttaagagataaaggagggtttatcctaaaagtactagttacttctgaaattcatgtcattactattgcttttggagatataaataacaacaaaacttttttttcttactactataaaacatcatggacttattggctctatagatacagcccaggtaagatttaacattttaaaaaattctattctgtcatctctaatatgtttcccaattgtttcaggaccaggacgcccctacagggccatagatttctcacatcaaggacctgcatttgttacctggcaccggtaccatttgttgtgtctggaaagagatctccaggtaggtcaaaactatgcatttagttcttttaattttttaaaaaatttattgtatatatttaaggcatacagtgtgaattttgatatacttatcttgatactcatacaagataagtgattagtgcactaaagtaaattaacatactcagcatcacatagagatatctctttttgtgtgtgtgtggtaagagtacctaaggtctactctcttggcaaatcaccagtacacaatacaacgttaactatagtctcagacctcgagttatttatcctacataactgcaactttgcaccttcagcctacatcttcccatttctcccagtcccttgtaactactatgtaactctctatgtattcactctttttcttttttcttcttttctttagattccacatataagtgagatagtgcagtgtttttctttctgtatctgtcttatttcagttggcacaatgtcttctagattcattcacattttgcaaatggcagggtctcctttttaaaggctgaataatactccattgtacacagtatatatatatatatatatatatatatatatatatatatatatatatatatatataaaatatacacacactgatttatgtcacagtttcttcattcatttatccatccagtagtctttgtcttggtagatatttggttcagatacatatcagcctttgccttgtatgctttcttgttgtatctgatggcatggattaaatgactaggcctgccctttgcttttagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgataggtaatggctcctgtacctgcaatggcatccagagattgtcttttctgatgtctgagacatggaggagaagtcactttatagtgctgtttcttatgcatgtggtgtcctatttacatgtttctaaaaacagttttcctctgggaggtgggatttcaaaaattcaaagctctttaattaaaaaaaaaatatcaaaatcacatttgtgaattggttatgcttggccatcattttgagatcaggttagttttatcagattagtgcaaatgtaattgcggtttttgcctttaaaagtaatagcaaaaaccacaatttcttttgcatcaacctaatcaaattaagagtagttcttgcattcaatcaacatttgctaagcaccaatcatatcccatgtgatgtggtactgccgggaatacaaagatgaatgaaataaaacctcccttttgaatattgtcttgtattaacgagatagatttcttgtaagtaaattacagttgagtgtgggaagtactgtaatagatgtatacacaaagacaagaagagagtctgggcaagtccccaagaggcagagatgatggctctgagaaggggaggggcacagacctgaggtgtagaggagggtgaggggagtgtgggagggcagtgggtgggtccttgatggaggaacatcatgtgtgaagctagataattctctggaaacagcctggtatggctgagtcacaggatgctggtgagttgaggaggacaggggcttggggccagccggggaaggatgatctgtgacatactaaagaccatacacaggtcagtggcctggcctgcagcccatgaagagttctgtcctcaaaggctccttgaatttgtttctctgtcctggaacacctggaacacatttcagccaaaaatttcccaagaggctcctcacctcaccttcctttattcatttttttcctccaaaatttgttttgttttttgttttttgtttttttgtttttttgagatggagtctcactctgtcaccaggctggagtgcagtgacgtgatctcggctcactgcaacctccgactccctggttcaagcaattctcctgcctcagcctcctgagtagccgggattacaggcatgcgcaaccacgcccagctaatttttgtatttttagtagagacagggtttcaccatgtttgccaggatggtctcgatctcctgacctcacgtaatctgcctgccttggcctcccaaagtgctgagattacaagtgtaagccacctcacccggcctcaaaatccccatgtttttaaccccactgctctgtctttcgtcccaggtccttagactgctccagggcacagagctgtggctcccccggcccccaggcttcactgccaacaccctgagcctgcataggtgtgcgttttgaggggcccatgcccagctagcagggacttcgtcttccacatcctgtacatttcctacagtgctcagaacagtgctccacgagcagggacatcatcagtgctttttctgtgactgagcttaattccatcaagcgccatttcccaccataccttggaatagtagtggatggtatgtgaaaagagatttccgtcatcaagtaaatttagagaaggctgagtttaaaaggtttttaaatttttagaatgtcgtcaagctttccatagataaatgtggtattctttttcaagaggagcctaaccctggaactcttacttcaccggacatcccattggaatccactttgggaaacgctgcctgggaggccttggagacctttttcagcttagtgtttaggtcctggcctctttcatccctgtggatgtgctgattatattctcacatactgggtcctatccctaattcatgaaaaccctcacaataacatctttaaatttttatctctgccagtgaaataatggtctgcactttgggagaccaaggcagggggatcacttgaggccaggacttcgagaccagcctgagtaacatagtgaaaccctgtctctacaaaaagtttgaaaagttagcctagctgggcacggtggctcacgcctgtaatctcagcactttgggaggccgagacaggtggatcacctgaggtcaggagttcgagaccagcctgaccaacatggtgaccaaccagcctgacagctctgtctctactaaaaatacaaaagttagctgggcttggtggcatgtgcctgtagtcccagctactcaggaggctgaggtaggagaattgcttgaactcaggaggtggaggttgcagtgtgccattgtactccagcctgggctacagagtgagactctgtctcaaaaaaaaaaaaaaaaaaagttagccagtagtcccagctactggggagactgaggcaggaggattgcttgagcccaggagttcaaggctgcagtcagctgtgatcatgccactgcactctagcctgtacaacagagtgagaccctatctctaaattaaaaaagaaaaactaaataaaaagaaagaaagaaatactattctgatgttggaatccaggccatagcaggcgtgtaggatataatgtcttacggacatgggaccttctcagcccatgctgagcacttaactattgatactctactaccttggaacattttccaacacagtgtttcttctaatatctcccctttgtgtactttcatctgcttttactctgacctccccgtttgccttcagtttgcctaaaaggttttcgtaactttacatgtcacttctgccaaaactggcttagctcagcataatacgaaccaccctattctcccttcagttactcaagattcaaatgcacacaataggagtcatcttgccttgtaaaccctctcactgtctttccaacagaatggtaatgattattcatatttatgcccatgtccgtattttgtgcatctacatttttgaaacttctcgacccataatgactttcaggtatagtactttttaccacatattgttaactctggtaaagtaattgtaatacaattttaccatgattgtgaccctgattgatttgcttggcccaaatttataatactgtacataagttaagacatatcattttttgttttgggggattttttttttttcttgagacagggtctcactctgtcactaaggctggagggcagtggcatgatctctgctcactgcagcctctgtctcctgggttcaagcgattctcctgccttagcctcctgagtagctgggacaacaggcacacaccaccaagcctagctaatttttgtatttttagtagagccggggctttgccatagctggtctcaaactcctggcctcaagggatccacctgcctcaacctcccaaagtgctgggattacagacgtgagccactgtgcccagccaacatatattattttaaatcttattacaaatcttagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggtgggtgctctgagctctgctggacctgcctgtacagtacaggttttcatgcctgtgattgtaaagaactggaaggaaacccaggttttgggggttgtctacgaagctaagtgatggagagaggcctaacgagagaagttagcaagggattggtgtgaggaaagtctttacccatctactatgactaacaatgtggttttaataccttctaacttagctgttcaaaaccaacttttgtatttctaattgcagtacattaataggtccagtctttggaaacagggtacttcattaaatatagtgttttttcaatgtccatgctctttctctttcctttcttattttttaaaatgtcgatattagaaatttatcagccatagaacttaatagtgaggtctgagatctcagaggagtattgcagactaaattcaactcaaatcatagcacagcaatgacattacaatacttaacatttaaagaccaactattaatcttccaccacaggttgggcatggtgttcatgcctgtaatcctagtgctttgggaggccagtgcgggaggactgcttgagtccaggagtttgagaccacctgggcaacagagcaagaccctgtctctacaaaaaaatataaaaaagtagccaggtgtggtggtatgtacctgtagaggtaggcctagaatttaagcacatctcaaaatcaccaaagaaaaacacatgtttcatgccctgctcccagagtttctggttcagtaggtgtaggctgtgtcttaacaacttgcatttctaaccaaatcccaaatgatgccagttaaggtggtctgagcactgcattttgagaacaactcccctaactcaaacatatagaaaatgcaatctgttttaatagcacttttgtcacaatgaaaaactaattcatcctccttttcaaaacaaccttaaatgttacccttcccccacctttgacactactctgaaggctgtgtccaacctcagcagactgagccatgctacacttagcacaacctctacatttgagtccagcctgccctgccctgggcccatacaaattgtctactttaaacacagttaagagagagagagaatccagttttggagaagatctttaatctatctaccatcccctttttggacccatctttgtttaaagtcttatttataaacatatttctcataattcttaaagtctttctatggtggtagaaaatttttttcttttttcttttttttagagccaggatctcactgtgtcacctagggtagagtgcagtggcacaatcatggctaattgtaacctcaaactcctgggctcaagtgatcctcctacctcagcctcctgagtagctggaccttcagtcaagctgaaggtctatttggttgagaaatataaatatcagattatatgttaaataaaagaatttactgatcacagacaatctgctgggcatggtactgaaccctggcaataaatatctgaagaaaacatagagcctgctctccaagggaatgagagacagatatgaaagttgtcatacagtacacaaaagagatataattcagaaatagcgttgcttaggagttctctccccttacagaggattatcattaaagtttggggcaaattcttggtcaatttgctatgacagagcttcccatatccctacccaatctcaaattagacaactattatctaggctgaaaacaacaaaaaagagacctttatcagtctttgtctgttgtcactgatatacttgtttctcctaggaatgctttggaagggtttgataaagcagatgggactctggattctcaagtgatgagccttcataatttggttcattccttcctgaacgggacaaacgctttgccacattcagccgccaatgatcccatttttgtggtatgttcaaagattcagaatgcatgaaaattttctagataatatgtcagatttattttttcatacaattaatgtttgatggtgttttattctctgtgtgaacaatgtgatgtgtgcaaatgtaaattaatttcaatctataccatagggatggttaggtagcatttgaaggccctaatcagaacccatgcttcagggatggttcacttttgggtgatcttagacaagagtttacaattccactggtgaattcataaattagcataataataaatgatttttcattggctaagtgagtattgttgaggttcagtagtccacacaaaccaccttcaatgtgttacctgcaggaaagagaggttctgttagccagaaaaggggaggagaatggagagggtgtgctggacacttaaacctcctactccaacttgagtgagctttacttgagaaagaagaaaagcagcacctgacatccaagagctggcctggtgaaatcaaccaggccttggtgttccctgttggacataaacaatctcctagaacatcaacagcagacaaggccactctgatcatggtggatcaggacaaaaacaagactactccataactgtgtctaagcacagacaaattatgaacattttccaagccacaagatgcatgacatcccctttcctggctaataggagcaaaaaatgacaaatgccttcaccgatggcattaatacaaaaactcacatttgaggcaatttaatttgttaatctgattcatacctctgacatgtaataatacagacagtaaataggattgctgttgactgtgcaggagcctcacagttatttaaatttcagtgtgatgaactcctttggtatatcagtttgatttctgtctcactttaaaacaaaagaagaaaactgccaggcatggtggctcatgactgtaatctcagcactttgggaggctgaggtgggaggatcacttgtgcctaggagttcaagaccagcctgggcaacattatgagaccttttctctaccaaaaacctttacaaattagctgggcatggtagcatgcacctgtggttccagctacttgggaggctgtggtgggaggatcacttgagcctgggaggtcgaggctgcagtgagccatgatcgtgccactgcatcccagcctgtgcaacagggtgagaccctgtttcaaaaacaaaaacaaactgaacaaaacttgacaataggattctaaattttacaattctgagcttttttagtgtttgtttatttgtttgtttttggagacagagtcttgctccactgcccaggctggagtgcagtggtgctatctgggctcactgcaacctctgcctcctgggttcaagtgattcttctgcctcagcctcccaagtagctgggactacagttgcacgccaccacgcccggttaatttttatatttttactagagacaaggtttcaccatattggccagactggtctcaaacacctgacctcctgatctgcccacctcagcctcccaaagtcctgggattacaggcgtgaaccactgggcccagtctttagtttttaaagtatattcatcccctggtgaacttttctaagacaaacaaaatggggaaatacgagtcagggctacactgttcagctaccctagtcaatgctcttcagtctgtgacctctaggaacacaatgtagttgaatacattggtctgttactccttgcaggcagagaatggaggactgtggaaagtctcagccagtgggtgttggaaaagacagaaagggtttgggcttgtgctaggtgatttggggaggacttttggaagctttgctctgaatcagatgttgtcaggaagcaggggtatgcttcctgattctatgagtgggtatcttgatagagtgattatgtctgtatatggggcagactagactgaggttaaagccataattggtaaaacagcagcagatgctcatattagccgggaaagggggtgtcacgcatcttgcatcttggacaatgttcataatttgtctgtgctcagacacggttatggggttttcttgtttttgtcctgatccgtcatggtcacagagtggccttgtctgctgtcgatgttctacgaaatcgtttatgtctgatagggggacatcaagtcctcgttgatagcgccaggccagctcttgaatgtcaggggctgcttttctaagtacaggtcactcaagttgtcataagagatttagacaacatacacattcatgtctcagcagccaatccccaaaagtgctcctgctttacagatacgcaactcaccctcgtctattttaaccctgtctgtgtgtcttctgagttgtatgtcttgaatagatagttttggagcaattacaagaagaaatttcacctcttctccttttttattttgccagtattttgagtttatattgttatccagttagattgtgtgatatccaaagactctctgtttttctccagaattttcctcaccttaatgttaatcttagcaatgtgtcttagtctgctcaggctgccataatgaaagaccacagattggatggcttaaacaacagaaatttatatcccacagttctagaggccaggaggtctaagaccaaggtgccagctgatttggttcctggtgaagactctcttcctgagccttctagctgcatcctcatatagtggagggagagagagaataaactctctgatgcctccttttatgataacactaatccagggccctatggttctgacctcattaaaccttaattacctctttctaggctctatctccaagtatagtcacattgtgggttagggcttcaacacacagattttggggaaacacagttcagtccagatatagcatttataatgcattgtcaaaccatcagtttatagaagtttgtttttcttttcttttttctttttgagacggagtctctctctgtcatccaggctgaaatgcagtggtgcaattttgacccactgcaacctccgcctcctgcgttcaagtgattctcctgcctcagcctcccgagtagctgggattacaggcacgtgccactgcgcctggctaatgtttgtattttgagtagagacaaggttttgccatgttggccaggctggtcttgaactcatgacctcaagtgatcctcgggcctcggcctctcaaagtgctgagattataggcgtgagccaatgcacccagccagaagtttgtttttctggactttttggaggcttcatgactgattacaagtcaatcagttttacttgatacagaccagggcaatcttgggaatgtaattgaaccacatggagcttctgcttcccactctgcaaagtgtgggtctcttgacctgatctggtggtgaaaatgttgttctcagtgaagtgactcttagtagattaggacaataggaaactggtctagagcccgtcaagtacaatacaaatgttatcataacaataataatgtgttttataatggtcagaattagagaaccatatgttaggtttagattttcaaaccttaattaatatttcttatcttgttctccaaagcagacagtaatgccctaagacattttactaataagcacaaagtcagaagtatttcacaggtgatttattattgttactcaacccagggtacaaaaaaaggagctatgaagagggagagtaaaggtatagctttcaatgattctaagcttgcctgatgggtgtgaagtagctttctggggctcctagatagattaaagcatagtcaggtgagcttcaagaaatcctgagacggaattagttggtagagttgttctttccttctaaaaaatgtttctttcctcatatttgcatagtagcaataaatgaaggggttgtcagaagtctgaattaatggtcccagcctctaacaaggtgggggcttatctgtgacgccgccacagcgatctttgcttttctctagaatgcctgctttgttcaatgattttaacttgatagttcacatcattttttctggctatcgtctcagccatagcttatgccaagcatttctggtgtctgctttctcagccatgtatctgtacatctatttatactatacgtctctaagtatttattaaagcatacattgtcaactgtacaatttatacacacaattcatattcataaggaaaaatgtcataatactccttatccagtactccaatatgttataagtagaacagtggaatcctctgataaattaaggattataccccaactctttctctcctattaaaaatgatgctagtaatttgattttctgcatcccaagtctccaggattgctaaaccgtatctccttcttttgaacaagcctgctaagtggacagaaattggcaacatttttctgtaaatagccaggtagcaaatattctgggctttggaggccagatgttttctgttgtaactactgaactctgcccctgtatcatgaaatcagccatagatcatgcataaacaaatgaatgtggtgttccaataaaacgttatttacaaaaacaggttgtaggctctatttggccctcaggctttaatttatcaacctgtggtgtaaaggattcacttttcttctttgtattagtttgtagtaaggatagtaggaatctctctctctctctctctctctctctctctaagagacagtctctctctgttgcccaggctgaaatgcagtggcataatcatagctcacggcagcctcaaacttctgggctcaagtgatcctcctgcctcagcctcccaagtagctaggactatagccacataccaccatgctcagctttttaaattttttatttttgtagagatgaggtcttactatgttgcctaggctggtctcagaactcctagcctcaagcaatcctcccaccttggcctcccaaagcactgggtgagtcaccatatctggcctgtagtagggatttccctttagtcatatttctccttctgctttagggtggaagctcacattgtgacttgatgggtgagaaatcccgtggttcagagatataagacatttaatcatctttgtgttcgttgtttctaatgtgcttaatgttaaaattttatttttctttagtagtatgtgtaatatacatataaataaacaaaaagccacagcctttctttaaaggcacagaatgaataatgttttgggcctagttccagaactcaccattactttaggctattttcaaagagttttatgctgaagccaattcagccttaaatgatttttcacatattgagatccaggttaaagtatttcagttaacagagttatagcttctggaatttcaaattcatgaggcaattcatgcaaatatattgcacatgacatttattaaaattttttttgtgaaatctctccaagcaatagagctacaaaattgtatgtgatcacaataatgagcaaaagaaggcagaacattaaagtgcaggaaaaactctgaagcaatctctagtaattcctaaggtaattgaggcaaatgcacacatttatcatggaaaataagattaggccagagaaatgctaagtgctgtcttcaatattaaatttagatataatccagaaaagagaaaaaaaaggaaaccaacagactgtaaagttatttaaatgccaagaaagaaactgtgttacatagtggtaatttccttcccaattcctaaagatactattcttaagagtatacttggatgttatccttttagaaagtacatttggtgagttctacgttccttcaattcatcagtggctggggggtccataggttccataattaatactaaacagctcgtgcctgttttctaccttgtacgttgacattctaaatggaatacaacatacagtagtcttattactaatcagtgtataaaataagttcattaatttagaaaatgtgcagcaggagaaaatgaatttctaaaaccacacatagctgatggactaccataaattaaccctgtaagaaagagcccttctgagtctgctgttctaggctacaacaaagttagtgaaatcaaaagctcacaattacaggtataaataattctgagttagagtgagtttagttgaaatttaaaaaaagaaggataggtgtatcagtctgttttcatgctgctgataaagatgtatctgagactgagtaatttatagagaaaaagaggtttaatggacttacagttctatgtggctggggagacctcacgatcatggtggaaggtgaaaagcacatcttacatggtggcagccaagagagaacttgtgcaggaaaactctcatttataaaaccatcagatctcatgagacttattcactatcataagaacagcatgggaaagacccacccccatgattcaattacatcccttccacaacatgtgggaactgtgggagctacaattcaagatgagatttgggtgggaacacagctaaaccatatcaatagggcattgcttttttcttcccaagagtgaaacatttaaagatagatccattttgctttactttaaataagaaaaatcataattagactaatattgtaaaaaaataaaataacattgttgtatgtgaaatttttatttttattggtttatgatttttatattatttataattacagaaatgttggtgaaaatagtttttaaatgcctgtaattccatctcaatttttttgtttatttcttttcatattctcgtatgttttatacagttgcaattatagtcatccctcaatatcttgagggaattagttccaggaccccccaccatgggtaccaaaatctgtgactactcaagtcccttatataaaatggcattatatttgcatataaggtacgcacatccttctgtatactctaaatcatgtctagattacttataattggattcagaggaccatctctataaggcacctattatgtataatatcccattatcacttaatttatttaatttttaggttgttgcatagttttctaaattttttcatcttaaaatcttagtgcacataaaagattcaaaatataaaatgtataaaatgaagtccgtattatcactaccatcttccagcaaacaatacaatttttttctaattttccagatatattttataaatacacaaacaaatatgtttatatatttatctacatggtagcatattatagacccctctgtccctttgcctttcccccactttttttttaacttattccaaatcatttcagttctgaagggcattcttattctttttttatagctgtatagtattcttttgcatggatttatcctgaaatgtattattttaattttaaatttaagattttaaactattttctgttgatggacatttaggtgatttctaatcgtttgctttacaatgctacaacaaacatccttgaacatgtaaggtaagtaaagagaatagaatccctggcttaaagggtaaaaaaatgcatttgaaatttgataaatgttacagaattgcctctagaagtttggacaatattccctcctaatacctgtgtgtcacctatgtgtcagagccacagttcccccatcattccctctcattatgctctttgtccctgtgtcatcacactttttcatctttgtcaacgtgataggtgaaaaggcattttagcaaattttaatttgcatttctcttcttataagtgaagtctaggccagatgcagtggctcacgcctgtaatcccagcactttgggaggctgaggtgggtgggttacctgaggtcaggagttcaagaccagcctggccaacatggtgaaaccttgtctctactaaaaatacaaaaattagccgggtgtggtgttaggcacctgtagtctcagctgcttgggaggctgaggcaggagaatcacttgaacccgggaggtggaggttgcagtgagccaagatcgtgccatcgcactccagcctgggtgacaagagcgaaactctgtctcaaaaaaaaaagtgaagtccagcatcttttcagacattcaaaaagaaaaaatccatttgcacctccttttctgtgatctgtcttcataacttttgtttgtgatcatgacttctggaaaaagaaaaaaaaaaccctaaatattcaaaaaagtcagaattagggaaagtaattcgtcctctgtgtgagtaacaaaatacaacattttcttttaatattttattttcctggaaaacctaataatctggtcatgtaaagatgtattttgtaggttttattagtttatggaaaatgaatgtgatcactgaaaacatactcaacctctagaacagtacctgacacttagtagatgttctgtacatttttgtgaggagaatgtcctattattgtacatctattctgtgatggcccctatgcgagatgtcttgcaaagctcacctcttaaatgaacaaatctgtatatagtaaactactctccttgttttaaacacagggaaaatacagtttagagaggctaagaaatgtgtcaaggtcacaccaatcagtaaatggctgagcagagatttataagaaaagtttcctattcaaaaatctccccgtgttcaatctttcaactacaattttgccttttgtcagtttagacaattcttaactcagtctcttcacaattgcattcactatagctgaggaaattaagtcccgttagatcatattaataggaattaacactaattggtgaagggcagatctgactaattttgcacagcttttgaaatgatagtcattgctttcattgtgagcatgtatttatgctttttaaatgtcacatttacttattcaatactagtttttaaatagcaggtacacagttactacctcctaagtggcataacatcttgatgagttttataagagctgaggaatcagagagggtggctggacccctctctggttccccagggtggcagtgtttctatggactaggctgggggctggcttgttttctttaatttcacaggtgctaaatgtcacctgaatggattctcttcaactctagaatttataaggataaatgcatactatattgagaagaactaaacctatgaattacatccaattcattctgataaaatatgaatataataacaaaccacaacttacatacaaatctaagatggttctagcattgagttgagcaactctctcctagagttttcatgattgtttagtcaagaatggcctgagaggtagcttagtctctgtctagaatctcttctagcatcaccttggttctttctccaatccgtaatgtcaacttatgatgcatgttgaactggtcacttcttttaaagttgacctagcagagtctttctgtagtcctctgcatctgttcagagtttaattcttgaagaagaagctttttttcctcaagggtttagaatcagcatttctaattctctcgatttttttttgtatgtgtgctgttagagcttgtatacaatgtatattgtgtacatttttacacacatatagtatacaaggctattatacaagtctatgtgggagaatgtgttcctgatataactcctccaaaatgcctgagaaatactttctgttttgcctgcccagggtgctataaaagaatggatagggaaatatagggagagaaaattatagcaccatccttgctgcgccctgcctggaagatgctattattgctccaatatctttttttttctcttccgtggttgtgtcctagtccattcaggctgctaaaacaaaaataccagagactgggtggcctaaacaacatttatttctcacagttctggaggctgagaagttgaagatcaaggcattagcagattcagcgtgtggtgaggaacttcttcctggctcataacggccattttcttgcttgtcctcacgtagctgaaagggaggagctctctgggtctctttggtaagggcactaattccattcatgagaaccccatccttatggcttaattatttcccaaaggccccatttcctattaccatcacactgggagttaggatttcaaaatatgaatttgttcggggtagggcacacacattgagtccataggagattgtttctcatcagtcactgaaatattctctctgtgtagtacccacctccttgtggcagagcttagttaattaaataaaggcttgggtgttgtttaactatttcatgcctattacatatggcctatttagggcagtgtgaaaccagcatcccaattacatttgttttcaaatctttggtagaacaagacaagatatttccctaaaatagcaagcctgatgaaatatattttttaggaatgaccattaggaattctctcatttaaaaagtccaaaccaaccttttaatgtataccttctactttaagttttaaattagagttcccatatggacctgtgtgtgcttttatctgtcatgtggcttttaagtgatcacatttgaattgtcacttagttctgactctcagaggaccagagcaatagcatgtcaccacaataggatccagtctgatgacaaaggatgccttctgggcagtaacacatgaactcaagtggtgaaagctacactgtgctggtctttaatgatgcacacacatctttgcagccggcctcatatttccatggttctttctctagatgcagaaacttttcttatttcatctgtgtggtgggaatccaaatttatagtcatttaagctaaggccctttgatagtaactttatcctccaatgatcttgaaaaaataatgcacactttcttgtattttattttctttatgcctgcaggtgcaatatttgttggttgattactttctcctgcatgggttacatgaaaaatctttaccttgaaagcccatgtaatcacatttttttttccattatggcctctactttgaaatttagtgttgttttttttttccttttctgtacctatcctcattttgttggaacaagacagaataggtttatatgccaaaattcggaacctcatttctgaagtactcagtttctaataccaaaacgtagctatgtagccctcgagcagatgaaaggcaccaatgatacaaatttatttatttattattattattttttttttgagatggagtctcactctgtggtccaggctggagtgcagtggtgcgttcttggctcattgcagcctccacctcccgagttcaagtgactctcctgcctcagcctcccgaatagctgggatcacaggtgcacgccaccacacccagctaatgttttgtatttttagtagagatggggtttcaccatattggctaggctggtctcgaactcctgacctcgggtgatcctcccacctcagtctcacaaagtgctgggattacaggtgtgggccaccatgcccagcccaatgatacactttcatttaacttttgcttttgtttcctaccctcaaatgacatttgaccctttacagagatattaacttgtatttaacatttttaacttgtatttaacaaagatacaattagtttttcaagagcaattcaaggtaccttattgaggaataatgcccacaattttaacaaaactacctattccgtagattgtactacttctctttttagcttgtagatatgttattgcttgtagcattttgttcattggatgctttgcattttctcagcatgtaccagtcttttcaaaaaaacttacattctataatttgggtactctgtatatagttcttactagagctttgttgttgttgttgttgttgttgttgagacagtatctcgctctgtcactcaggctggagtgcagtggcacaatcatagctcactgcagccttgacttccagggctcaaatgatcctcgcatctcagcctcaagtagctgggaccacaggcacacactatcacacctagctaatttttaaatttttgtagaaatggggtctcactctgttgctggggctggtctcgaactcctgggctcatgtgatcctcttgcctcagcttcccaaagtgctgggattacaggcatgagccactgtgtgcagccttactagagcatttattgtatgttttatagccctcctgagagctacaatttcaattcctccttattattttcccctattcttttatctctccagattactaattgccttaggatcttgccttctcctttattatttacatttttcccttggtgaattctgatactttctataagttatttgcctcttacagcactgattctgcatcttccttgtgtcctgatagtctcttgtctctttctgtcatcacaatttgaaccctgacttgaactcagacagtatctaaaagttcatgattggtttaggactcataggtcaaagtatcctctttctgcattgttaagattggagaatatgccttcaaaatcaatttttcttattctagttggtcctgaaggttgtactacagtgtggtggtgtaaagcaggggtccccaacccctgggccatgggcccatgctggtctgtggcctcttaggaactgggccacacagcaggtggatggtaagcaattgagcattatcacttgagctccgcctcctgtcagatcagcagcattagattctcataagagtgcaaaccctatcatgaactgcacctgagagggccctaggttgcacactccttatgagaatctaactaatgtctgataatccaaggtggaacaatttcatcctgaaaccatctcccttcccatccaccaccccctggtccgtgaaaattgtcttcctcgaaaaccagtccctggtgccaaaaaggttggggaccggtggtgtagaggaagtagagtatgtggattaggaactctcactttagaaccagacttcctgggttcaaattcttactctaccatatattagctgtgtgaccttaggcaagtcacttaacacttttgtgccttttattccccatctgtaaaacagggtaataatgttatgggttgaattgtcccccacaaaattcatatgtcaaagtcctaatagctaataactcagaatgtcaccttgtttggaaataggatagctgcagatatagtttattaacataaaatgtcatactggagtagagtaggtccctaatctagtgtgagtggtgtccctataaaaagggaaaatttggacataggcacctgcacacagggagaacactgcatgaggatgaagatagagatctacaaggcaaggaatgccaaagattgtcagcaaggcccgagaaggtaggagtgaggtctggaacagattttccctcacagtgcttagaaggaaccagccccactgacatcttggtgttggacttccagctgcctagaagcgagacactgtctccaaccgtaagacaaatgcctgttgtctaagccacccagtctgtagtactttgttacagcagcctgagcaaacaaataatatccaccaaatcaggctgctttgaggattcaatatgtcattttgggtaattgagcaaacactaataaatactcactaatttacttatcaaaaagtgctaggcatgtgccacatgcattcctaaatgcccagctcctcattggctatatgtacagtgtgtgtgatttcagaggtgcttgcaggccccacccacctgcaaaatgcgaattccatcattcttcttccataagtccttgtcccaagttaaaataataatagtactgatggtatagtcatagtgataacaaccattgaataaccatttcctacaagaaaggtgctgtgtactaggtacctaatatatattatcttccctaccttctcagtgccatgttattggtgtccactgttgaggtttacagacctctgtgatcctggatcatcagctccacaggctgtgttttattcatctcaagctgcgtcactatccccgtttcaccacctctgccttctcattctctgtctggatctcttagctaccctcccacccagggggcagcagtgtggaggagaagtctcaggcctgacattccatctgttctccttcctggaacccagagggggccaggaaaagggggtggcatctctagccccccaacactgaggaagaatggggctcttcccatttcaccccgcccccccacagtttctcccctgcctccaggaatgggccacttctgcatggggcagcgggtcccaattcagctcacactgagaatgtaagaactacaaacaaaatttctattaaattttgtgtctcaacagaaaagagaaagcgaccaaggaactcccttccctgcatgtgctggtaaccatgagcctgggaggctctactcaggtttttttcctttgttgtgtttatccatttctgcataacagattacgattacccaaacactcagtggcttgaaggtgaccatttcatttcttaccatttctgtgggtcaggaattttggaagggcttgactaggcagttctagcctagcatctttcagtgcagctgcagtcagatggtgataggtgttggaacagctgtggactggcccgctatctgtttttcttcctgaaatcttgagcctcgccatcatggtcactctatatgagttggtttgggcttcttcacagcatggctgcctcaggacagctggactgcttatttgatggttcagggctcaggcacaagataggaactgcaatacactttatgatttaaccttgaaagtcacaaaatgtcacttctgttgcattttattggttataaaagagtcagaaactcaccaagtttcaagggaaggccagatgaagccaaccttcaatgagggagtggcaagattctagaaaagcatgttagtcaagaaacaaacattgtgtggccttctttggaaaatatatttttgtatatccctagacactgtttatttgcacaaactgtttatgtaaataaagatgcatgacactgtcatcagccaacacatacttagtaaatattgactctgtccaggttgtatgctaagctttgcactgtatgcaaagtgtctgcatgacactgtcatcagcaaacacatagttagtaaacattgactctgtccaggttgtatactaaacctgagacttcaaaggtgaaaagtccttatcttagaccttaaggagttaggatcttgttaggggacatagatacataaataacaagttatagtatcatttgatcagtgctataaatgaggtacaaggtacagtggtgaatggaggaatgaatacactgaataagtatttactgaaataagtacctccctttctccatatgagacaccctggggtgacaagctctggggatccagggggaatgaaaaaaggacactgcccctgagctccttgaacttaccatccaggaaggaacaaggaactccaacaactgccatcaaggtgggactgaactctcaaacttgtatcatgttacaaaatcagggctatcaatgtggaaattttgctgttaatatttcaaaacatatagtaattgctatattttaaaaggactttaatggcttccttgagaaaacataaatgagcactttgtacattacctttttagactttcttttgctggcataacagcaagaattcaagtgagagtttatgaaatgagtagacagaagagtattcctggtgagaaaaatttactgttcctttatattataatattgatacagattgagtatcacttatctgaaatgcttgggaccagaagtgtttgggattttgaattttttcagatttcggaatacttgcattataccagttgagaatcccaaatccaaaaaattcaaaaatgctccaatgagcatttccttcaagtgtcatgttggcactcaagaagtttcaggtttagggggattttaggttttaaattttcagatttcagatactcaacctgtaaacacaactttttctttctctcctgttaaaccaaatcatctcaatactagaacatgtatcttatcatacttgcctttttctgaatttcataattaacacatatatgttgaaggcctcaaatgttcaatctgcaaccaatgttaaatccaacatgaactttcatttgctcacttgacaaaggggtttatagtcctgcttggagagagagattcatacatcgttgaaaacttaactgtttttcttcccgaaatcttgatcctcgccatcatagtcactctatatgagttgatttgggcttcctcatggtggtacacagaagggggtattccacacatgggtatacagaagttcctatgtcaagaagaagttattccactttagagaaagcaacagtcaggttggtgtgatcggaacagactgatttatgttaaatgctgtgtccaactgttttgcaggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccaggtaactaacacaacttccaaatgggtgattcattcatcttctaaagaagctagctttcttgctttctttctttataatgtaaaccaagacctttagccgaagctttcaggtctagttaagtttattgaccatttttctagcatatacgtatttagcaaaatgagcctttaaactaccaattaaacatcagaaagggactaatgagctgactcttgttttagaaaactgaaagttttaaatagatcttattaaatgaactatctgcttttacacctgacttgacaattctctctgagtttattggattaataaaaaacctccctatggttctttgaaatttctaaccaatgaaataaaaatgaactagccacactgtacagggactagctggatttagagattattccttgagggcagggctgggattagggtgaggaaagtacaacatttgccttgagcacaaaattcaagaggaggccagaaaactcagtaatcaaggtaagtaataatataatacaaaattttggaaagtcaaaattaatgcaaaaaattaaccatgaataatacatcatcaaaattttaaataaaggcagacttttgtttgtttttcatacccacatcgtcttataactgaatcagtcatttcccatttagcctataccacctgcgatggataggttcatgaaggctgacattgattggtctaccaacagattgggctacgtgggactctatgtgtatgttgcattagttactgtttttaaagtcatgttttaagattgtagatttcttattaacttttcccacttggttcaacatatgggaggatattttgacaagtatatacagggcacatgtttttctttttggcccaggccccaatatggctccacacaccatttaaagaatgttaggagcctggcaacatactgagacctatctctgctaaaattcaaataatattagctgggcatagtggtgcatgcctgtagtctcagccactcgggaggctgaggtggaagaatcgcttgagcccaggatgtagaggctacagtgagccctgtttgtgccactgcactccagtctgggcaacagagtgagaccctgtttcaaaaaaacccaaaaaaacaaaaacaaaacaatttaaaaaatcttaatcaagaaggtgaaaaatcacacagcctatttacccaaagtctcagcctagaaagcaatcaagatgatttcagagctcagtctctctctctttgacctgagtctttcaagcctggctgtagtgggacgcttgggcagagaattacctcgaattaagttcaaatttatgaaagagcctaggtacagagggccttagatgccaggcagaaaccccaataagataccacctcatacccattgggatgactgctatcaaaaaaaaatagaaaatagtaagtgttgctgagggtgtagagaaattggaatccttgtgcattgctggtgggaatgtaaaatggtgcagccactatggaaaacagtatggggattcctcaaaaaaatggaacaaataattaccatatgacccagcaattatacttctggtatacctaaaagaactgaaagcaaggtccagcagagatatttgcacacccatgttcatagcagcattacttacaatagccaaaaggtagatgcaaaccaagtgtctgttagtggatgaatgaataaacaaaatgtggtacatacatacagtggaatattattcagcctcaaaaaggaaggagattctgatacatgccacaacatggatgaactttgaggacactaagctaagtttaataagccagacataagaacaaatactgcatgactccacttagactatgagatagtcaaattcatagagacccctggttaccaggggttgggaggggagaatagggagttactgtttggtgggcacaatgtatcagttttgcaagatataaaggttctgagaatggatggtggcgatggtcgcacaacaatgtgaatgtacttaatgccactgcactgcctatttaaaaatggtcaaggtggtcaaatttatgttacatatatgttacaacaatttctaaaacataattttttaaaaaactaagaggatttggacaaaagcaaaaggcaaccattttttggtcttgaacaaagaaatggcagaataaaaatatatgtgttttaagaagatgaagttggcaataggtgctgctgggttgaatcaggaggagacagatcaaaaccctcttggaggaatcccatcaggacaggtcaggacctcccatgggattgcagaaaaaggactagaaagagaatcttatattaggtgagtgtaaggtatagaacaaattcagaggagctgaatttaagaacagttggccaaggagaatataatttttaaaataaatgaaaaataggcatatgtatattaaaaatgaaattcggccaggtgcagtagctcacacctgtaatcccagcactttgggaggccgaggcaggtggattccctgcagtcaggagtttcagaccagcctggccaacatggcgaaaccctgtctctactaaaaatacaaaatttatctgagcatggtgatgggtgcctgtaatcccagctactcgggaggctgaggcaggagaatcgcttgaactcaggaggcagaggttgcagtgagccgagatcatgccactgtactccagcctgggcgacagagcgagactttatctaaaaaaaaaaaaaaaaaaaaaaaccaaaaaatgaaatccactaattttgtggaagagagcttataaaatatatgagagtagaagattggatttatcatgtgggagatttacattttattcacaactatttgaatgggtataaatatcatctgcttggttattgagtgtctcctggtgtaatagccagtctgatccctctcacaggtttatcattctataaaaaaggtagagacaatagcagaatttctcttcccaagggctgtatattttgcagctccccagatgccattttagcatgcactttcacaaatgagtttctaactcagaaaagtagttacattcttccttagaaggtttcttcggcataagcatttattgtaacaaatttttaaaatgcaataagctgtatttaagtaatgggatgccagttctgactaccccaagaaaaacaattgtggatatgataaatggtgagaaaggagaagataaattttagtctagcatgagtagttttgctttatcaacaaaaagcacgtgaaaggcaagtgcgcttgctctttttctcttctgaaagtattcagctgatgaaaatcctgattgtagacccttctcttctgctttagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaaaaggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatca

SEQ ID NO: 15758 - DNA, 86414 bp, Human; identical to SEQ ID NO: 12345
  misc_feature (1)...(86414): n = A,T,C or G

SEQ ID NO: 15759 - DNA, 6459 bp, Human
gcaaataaataccaaaacattgtctaacactcttctttgttgtgaatagactgtgtagagtgaaacaaggaaataatagccatggcgatatgtgttttctcaactgtgctatatctgtaacaaaaatgtgtgttttgtgggaaatggagtgaaaagcaaggaggactcctgctctcataaacccaggtgcctacatccgaacaaaccctcacatagagtagcaagcttagaaaactgcctctggcttttactccaggttccagtttgtgtgtggagaaatcgaatatgtattcatattttcctctctcctgcaagtacagttccattagcataaggattcctttgaattattttctctgtttgacatttaaattagtgactgttggaagaaataagaataatcattgaaattagcttaggaaatctgtgagtgccccacctcaccctccaaacacacatacactcttgttttctcattccaagattaagaagttatgcaacctgacaatgcacttttctctgacaagtcttgacatcaccactgttattttctttttcacttttttcctccagcacctgttagaaacaagagtagggtgatcttcatgtgaatttgttctttccttattcttttagcaaaagatagggataaaagtctgcaatggacagagatgctttaaaatatgcttgaaattttatatttaaaataaaccacctgaaagtatttttagattgaagaccatacacaaaataaaggtgtttttgcagttactagactgggttcttaaaactttaatcaatctatattcataataatatccttcaatttcttttttagcattatacaggaaactggtagatactgagatggattttaatggctttatactgatgaaaatagcaccacataaaagcaggggaatattagaaataaaaataattgtctctaaagacccatacaaccctttttcccataaaaaaaaagatgcactgtaatacatgaaaagataagatctcttgtcaaaagtgtgagagaatgtccggtggttccaaatgacagttacctcttgccccccttctctgccagagttcctttttatctttgcaatcttccagttcttccgatcagcctgcctttagagggctacaaagcatttctttcaagccaccatagctaacacggtgacatgagtacttaatttgcacgcggccgcgctgcccctggcttcgcggaagccctgagtagcgcagcgccctcgccgcacgcaaggctgcagtcccgctccaggccagagtcccaggagagcgtcctccgcgctcacaggcgcctttgtcttcccgcttcccccttcctttttcaaaagccaagaggtaattatttggtctttgtgcaaggcaaacctctccagatgccacttccaaatataggctctcattaacaccagaggctggcctggtgtggtgcagggcggcccttccttctcctggcggacactgtgtccccgcgcgctggcgctgcaccacatctggaagccaggcgggcagggcagagaccccggctcctgcgcccctcctagctcccagagagcgtggatcgcgggcggggctcaccgagcgaggttacctctcttgaaaatacttaaacactttttttcctctccactgaaatctcaaaaaacagcccattttgaaccagaataatttagtctgacaacagattcttcctctgttcacagctgtcccagagggaggagctgaaatctgaacctctcagctgtgattggatctttcttgcaaaagagaggaaaaaaaaaccctcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacaggtaaaaagagaaaaatatatctagaactacgtatctagagctttgcaaatatgaatctacgtattacccttcaaataccattacaaaagagccaaagattcaactgttttcctttttaacagtgtcctgaaagggagcttacattcttttgatcatttagggttcgttttaattcaaaacttttaaaattcttgactaacaaggaacatttcattcaaatctcgcagcttcgtttgctaaagcctgtgtatacatgcataatgagtatgtgaaagatgagcaacataaggattgaattactgcgtttttcatgcactaagtctcctttcctttagaaggcggcttgatgcaggcatatctttgtactcacggtcgtaatacacctaaatagcccatacgtaacatggaaaacaacttttctgtatgtttaaaaataatgttgaggctctccttcctcaatggggacggcgaaggcactggcttggctgcactgtctgacttcagagcacctatagctccgtgcagctgtcagcctatgtgtgcattaagtacagtaactccgtaggtgccagggtggaaatgaaacattttaccagtgtgtatgccctcctaaatgggtctatcttcttcctaagaaaatcacgtgtgtgttgctaaatatctttccagtgtgtgtatacttgcgtgtggatttatttttaattatttttgccttaatcttctctccctcccttttctttcccagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggtaagagaaaaaccataggcaggaatgttactctgagatacaatgaagccctgggctggctgttggatttgcatgaagttgtgacatagtgcttttaatgatggacagtcattgatagctacttcctgactactcaaaaagttgttagggcacaaagtgctccatttcttgctaacaacctctgctccagggactgcaaacagcatgtagactttggaaagtagattcagaaggtttggtctcaaagatcagttagaaaatcaggaaagatgtgcttgaatgtgtgttctgtgaaactgcccccagtaatcagcaaatacaaatgttgctatcttaatcaattgatttggttaatagatgaaggcttttcctacagttttctgttagttacattcttgctctgatatttgtcacccgtgggtgacttggatagttgaaactaaatttactttgcctctcttgctttgtttggggattttttgctccttaatttcttattcgtatcacagaattattctgcagggtatcatggcacttagaccaccttaatcatagtacagaaagagggaaaaggggaaatattgggaaatgttgggaggtgctcaacattagctgcatctgctaaagcagaaagctttaagaagtgaaagtccaagaactacgtaaattatttctgtatgattggcagcagtaataatattcgtgtatgatttttaaatgcaatattcaagtttatcttaaaaattcaggtatttttaaaagtgtctattatgagggattttaatcaggttttgctgcttctcattatttaagcaaaatgtgattgacttttgttaacatgattttactttatgtttcctctaaaaacactgactgtctttctttttttctcccactccacccccaggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaatgaataatgcttattatgcatctgaagtgttattttatgtgttagattataataaagtaagctgctagtattatttttactcaagatagtagtgtcacattcagaagagacatgacggtggtttgttagcataccactttaacaaaaatcacactttctgggtgcaaaactagttgtattactaatagttaaaaatacttttcaaaatttttcatgttgactttattaagtttgttttatgaagacaaaaaatacaatcacttttattattacctacacactgtaacagtttaagatttttaaaagaaatattatgtaaagagatatatgagggaaaagaatacaaactgcatgaaaagaccaggagaaacgatttactataaattacacaagttggaaagttaaaccatgcaaagaaaaccccgcatctagtaatatataaaataagtgatgtgtttgataggaacaggtcagtgagcagtggaaattaccttttaaggtatttgaacacgttggacaagcccacactcaaacctaatgtgtactggagaaagtataacatgaccatgcattcatacacatatgcatgtgtagatgctaaataaatgcatgtgtagtaactcacatgcaaaaatcctaaccatcataggaactgtgaaagttagccaaatatatatttgaattcaaactcctaaacctactaaaagaagaagagtcctgcttctgttcatcacatctctctggtgatttgatcagaacttggagaatcatctttttccttttaatatctttgtaatattataccaataaatgccagaacctgtatctcaaagatgttggtagcaggcccctagcaaatgaccaacaata

SEQ ID NO: 15760 - DNA, 8889 bp, Human
aacgaagaaacttggacgatctcagccttgtgcttgacaacctatcccccacctcccttaagtggttggggagggggatgagcgtgggggaaattccatgtgtggagtccaaagggatacagccacctcccggcccaaatgcaaattcatattcatgagagcgggataaataaagacaaatctccgctgtaatagcacttggattcgcatccgtctttgctggcctttaggtttaggggactgaagacagatgtttgcatcccttttctcctcttgtctggtgaccataaagaaaaaccatttagagcgttgcaatttgtttcccgccgcagtaaaaccttgtatacatttattttcatttcacccccgtgcacaaaaaagtgcacactggtcaccaagggcccttctttatcaaatacgcattgtacaacatacaactgcaataaaactatcagccctccccataaaactatcaccaggatcctcggtaggtccggctccctgcactcccgactttagcgcttcctcacgccccgaggatttgcaaccacctgaaacgagcctgaaactcaccctgcaaagaagcacaaggctgggggaccgctgtccccgtttaatccattactgcgtccgcggcagtttagtgcgcaataaaacacggtggcaggggagagcgggagcccatccactccccggcactagcatcgaattaaaccacttagtttggcaaacactgaacgcctaaatgcccctataaagactttatgagtttgttactttaattactgacttgttacagagcacataaagggggtaatgaatgcaataaaactaattatctacacatttaattcatataaaatatccagggtttgtttacaccacacggcgattcagctaagctttccccctcttgtccaccgagaggaaggatttaatgaaatagtttcccttattctgctagggcctaacaaaccaaatgaaaattaccctccgcttaaatcatggggccactgaagtccacaaatcactgctcgctcctttgtctgtgcctcgctgccagcacccaaaagcctgaggaatcggacaagaaaggtgcccgacctggagcccttgcctgggcatttacatggcaagaatttccctcactacagtccgcaaacctaaaaggcaaacagacacaatccccgggtctgtggaggattgtgggcacctgaaaaaaaaaaagaggcgagaaagagggagagcgcccgaaagagatgaaagaggagatacatttgggtacacttcatgctcgcttgccagttatggtgtaattaaaacgaacaacctcacagaaactcaaaccaaccaaggcttgcgctaatgcaaacagacagaactgagagcaaagaacacaacggtcgagaatccagatgtttcacattcgaaagctttcctcagatttttttattattatttttaagtggctgtataccctgagtctcttgaaagcacatttagctgcaagaagaaatgcaatttataagatgctttctctctgtctctcttttttttaaccccctctaccaggtgtatttttaaagaaatccgcttatcgttcacataaacccccttggcccacttactctatgttacagggcgcctgagtcttgccaatgtcccagtcctttataacatttcatgcacttcggggggtaggcttgttgttaaattgagcgtgtaacactcttacaaaacaggttttctatgacatcaaggtttcttctccctaaccgagggggaaaaaaagaagaggacgaagaagggggaaaacacacacactatctcaatttatgcctaaggtatatgatcagttaaaaaggcttaaaagctcggggaaattggatcagggagaatcgtcacccaactttcattatttccaagtagtgtgattgaattaaagggcagggagctggttagaagggaggatcaggggctcggtgcgtaatggtgtggtattaaattctaattagagatgcaggaatcaatgatagggaggttggacagctcagttccccagtgccagcccaatagacggatgagttattgtcatgtaaaaagcgccagcaataagaccaaccgctttgctattgtccaagtggaaagagccaagtttattatgaggactatatgctctagagacctcagacaaggcatctcataggaggctttttcataaaactaggctctgctggtagtaaggaggccagtttggaggcaggcgttgagctgtgcacatctccccactccagccaccttctccatatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcaggtaaggaccttcagctttctcagcggaggaagccgcctttccgcccgtatataggaagccttgattgcatttgaaaatggaaatgtgtttagtatttaccaaacgaaatttgcttacacaaatgaaagaatttatcacgttagaagcgattgcagggaggggtaattcacttacagggttacactatcctagtcacacccgaaccgccaacaaaattatcttaagctgccaaaatgataggcataatttatttactttgcgatgagacgtaaagcttagaaaataattaaataacaaagagtaaagctcattactggcagtgtctctttttttaagaaccgacagcggctcacacctctttggctggtcatttttatgattatttctttaatttattattatttttttgcagctctttcccccaacttttgagccgggtcaactttctgagaattgaaaagttcccaaagtgggactgtttggtaacttctttcctggctccctgatattccgactgatgtttttggatttttttcctctctggttttttcctgctgaaagcactatctcaagtccgtcacatcgcgctgtttcaatccacccaaaggcgcttgtgccagaaaggactccgccaagcccgaagtttgagcccaggtttccgcagataacaaatttcctcggtttcttcccgcagcttctctcggcaactctctcgcgcgggtgtaggtagcggctgccgtatgacctgaccttggagtcctcacattctagctccacggccggcgagctgccggctgatttgctcactttctgtctcctctgtcatactctagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtacgcgcgcctggaaaccgaccccgctccgccgcactggtccggggaggtgtggggtgaggggcggctggtgaaattcgaagtcctggagcctcgagtgagaaggacctagggccccatggccgatcagaaatactggatttggtgtggctgtgcgttcgagagaggcttagagcgcacgctcttggcattttatttacagttgcgaagtgtttcccacccgagcagagacatggggggccttgggacgtggatgagcgatgcaatttcggggacaggaagtgcctgtggtggaaggtgtgcagactttgctcccgtattataagtttttccttctcccctcccgccccccaaaaaaatgcctcctaactcaagtgcttttaacctggccccatggcatataggttcattttcccggaaactgtgacttgcatcagatttgcaaagggtctgtgacttcatgaaggtcaagaaccatgacttactccaacctgttaaacacaggtgcgctcacgagttggccacagcgcctctctgggtgagcccccgaccgagaagcggtgcgcaccatcgcacgctcttccaggctcaaaggccggggatgggcagcggagcaaacccagagaggatcccttttccttctaccaattagagtttaactttagaacttaggcttaggggtgaatggcgagctcggggcttgctcaagaagccgactgaacagaggcccaccaaaataaggccttcccttttcgggtctttctgggacctgcggctttttaaactctgccgcaagccttcatgtccctggcgtgctcactccccctaagaaagtttctccgaaaatgcacagcaataagaagcggtagacttggtggatgtgcgcgcgggggtgatcacagcgcatggggaggagggtgttaaaacaagccgaagtagaacttgggccaccctaaccggtgcttttctttcccattttcttctttctccccctgcttcaccgtctctccttccgtcttgggccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcttcttgtagtctctatggcgtgtctttatggtgtaataaggttctcacgggttcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaacaaaaagcaagtctagcaattgaactcttctttttcttgattctttttttttttttttttttttggttggtcattgtttttttttttttaagtttttttttaaaaggataagggaagataaaggaaattgtgctaaaaaatagcaagaacctcactgggctctggaaatccaggtgggttgggacatctaaacccatgcagccaaattcagccaaatataaaatttagtgcttgagagagcagggaggcttcttgtccatgcttttctgtcccccagaagcacaccagggcattgataaaagtgttcacatctggatgtggatatgtggactaagtggcagccaaggcaggatttgaattcaggtctttgaggtggacttaaaacgacagtgtggattctgtgtgcaggtgccttcaagaccagtgatatccggcaaggtccaggctgtccagctcccccaaaccctgcagagtgctgacaccccaggacacccgacaagctccatgtgggcaggtgatcaggtgctatatggaacagggtgtgccttccatgcattttctcatctatccttcaaaacaagaccatgaagcaggtacaattcctatcctctgttttattttaaataggtgagggaatggaggcaacagaaacttaacctgctgaagcacccctggtttatgagtgatggggccagccattgaaatgagaaaatctcattcaagaacctgcgacatttaacaataccaatggttctcaaagtgtggctcctgcaccagcagcatcagtatcacctggggatttgctagacacaaattcttgggacccaccttggacctactgaatcagaaactctgggggtggggtccagcaatgtgctttaagttctagaggttataggaaccactaaactaccctgtaagaaatgcaaaccagaaaattccagaactgggactaccttgggaacaggtgaggggaagaattctggcagccttagtgatctcttttggagggaaggggtcctcactacggccccaaaatggaatcgtgcctcctccttggaccctttgactgcgccactttctccaagcagaatccctgtgtaaacttctggtacttacctttatacccctctggctgggcataatcaacacataattcagttctcctcatttgaagggaggccacagtttgccttctctgatttaaggattagcagctgatctggtttaaatttatcagggcttcttgccaaaagcatccaaatgtggcttgcatttgatcaggcagtttgattcagaaatctcaaatatttgcatcatatcaaactttgaatcatctttctagaaggattttagggccaggcgtggtggctcatgcctgtaatcccaatcctttgggatgccaaggcaggaggatcgcttgaaggcaggagctggaaacctgcctaagcaaaaaaaaaaaaaaaaaaaagaaagaaaagaaaagaaaaaaaggaaagaaaaattagccaggtgtggtggcacatgcctatagtcctggctacttgagaggctaaggtgggatgattgcttgagcccaacagctgaggttgcaatgagctatgaacatgccaccgcattccagcctaggtgacagagagagacactgtctgaaaaaaaaaaaagagtaaaataaaaggctttaaaatattcttttaaaaaaatctgtctctaaatgcccctcagtaaagtctccaagacaacattgtttataaagagtgccactaattgtgctagtttaatatgccagcaattcccggaactcttgggttgtagtctttggttgtaaatataacttagaagatctgagacaggcagaccacaaaaacaataatttattggcaaaaagagcaatcaaggtcctgggcctggacacaggaaagttcaccttcctatagtcatggaagcccacgaggtaagtccctgtaagcttttgggcaggctagtggacaggcattctggaaaaggcaagacca

SEQ ID NO: 15761 - DNA, 37710 bp, Human
gagtgtggtgcctagtcaggaattgggaggagtgtagcaagaaaggaaggacaacaggatttggtcattgattggtcagatggatttcagagggattggtatgaaggaacgcttcaaagattttttttttaatttaagttccaggatacaggtgcagaatgtgtaggtttgttacatacttataggtgagccatggtggtttgctgcaccaatcaacccctcatctaggttttatttatatatttttttgagacggagtttcgctcttgctgcccaggctggtgtgcaatggtgcgatctcggctcaccgcaacctctgcctgctgggttcaagcgattctcctgcctcagccttctgagtagctgggattacaggcatgtgccaccacgcccggctaattttgtatttttagtagagacggggtttctccatgttggtcaggctggtctcgaacttccgacttcaggtgatctgtccgcctcggcctcccaaagtgctgggattacaggcagcagccaccgcgcccagccaggttttaagtcccgcatgcattagctatttgtcctaatgctctccctccccttgacccccacgcaaccaaagatggttttaaggcttctaggactggagatgattactttcagaaatgaatagtggtgaccagatgaaataagacttttggatgtagataggaccttagcgatatatttccagctttttattttttattttaaggatgaagaaacagctttaagttggttgcctaaagtcacgcaggtaattgatgcagtatggccagaacccatactaggcttaagggacagtgtaccataaactcgtagaggtcctttaaacagatagaaacgctgtgctccaggcagatgccataacaaacactggctctagatctaccatgggttatatgggtccttagttaagattagatatggagtcacagtgtgccagaatttcagggagagaggaaagtggaagggctttccactaagccttttgaactactaggtacccctcgttttacatctggttatctcatttaaatctatgacgttttaaaatacttattaccatttaagacatgagaaaaattaagtttagaaacggctagatagctcacgctagaaaggaaggactccaaattttaaccaagggcagatgtgcatggaggccaagtcatttccttcccatgctctcatactgacccaacaaacccattctgcacgtgagaaaactgaggcccggaggagggaattcacacacgtttgaagccaagctggggccagaaagtagatcggctgatctccaaacctccacgtcaaaggtcttcccaggaggacatatgccttcaaggattttacaatgtataccaccctacaagtgatgggagagaggggaaaaaagcaaccgactaaggagaaaagcaaggagcagaaaaaggagcaaaagaggagctgtcagaacggtgtgaggagagtgggaaaggagccgcctccttttgcctctcttcctacttattaacaaaacagaacgactatccaacgtatttcagggagctaagtcttagccagcttcagctgtgttttaacccttagctaaatatagacaaggctaaggcaggccaggtgtacacttcaggaagacgtggaaattcccagggcggaccaaaacttgagctgttccggcggtagtgatttgaggtcagtttgaaagagaagttgagaaagcggccgaggggcgaatttggctgcactacacgctcgccacaaagaggaagggccgccggccgccggggccgagtgcgcttccagcccaggcggagcggtagacgcaacagcctccgcccgccacgtgacccgtagtgttgtggtctggcccgcgtgggtggcgggagcgccgagagggcgggggcggcgatggggcgggtcacgtgatggggtttaaatctcccgcagccggagccgcgggggcgccagtgccgcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgaggtgcgcagggtgcgggcggccggaactgcgcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccaggtcgggagactctcgcagtcgctttaaaataagtttctctccccctcttactcttttagcatattgcttttgttagagctttttttttctttttctttattttttattttcattgcttttctcctctaccccccagcacacttaagtctgcaactttttggctgtcccgttggtctgcgttttcaattgctttttgcaaactgacacctgtgcagtttgctttttttggtctatatttttatgactgaaattacaatttttgaaagaggaaagctgtttctatagtcacagcttgcaaaatttaaagaacgtggctgttcctgaagacattaccattctgtaatgcagttaggagtgggtatgggagagagagtacttttagagctgttcatattacttttattctaatcttgctcttgtgcggtaacggtgtttgggctaaacatgctttttttgtatgtatgtagtattgagacacaaacttaacacttctagcataatgaagcagatatgttgcagttgtcatgttcttgaaggtttctttttttttttttttttttttttgagacggagtctcgctctgtcgctaggctggagtgcagtggcgcgatctcggctcagtgcaacctccgcctcccgcgttcaaccgattctccttcagcctgccgagtagctgggactacagacacccgccaccacgcccagctaatttttgtgtttttagcagagacggggtttcaccatgttggccaggatggtcttgatttcttgacttcgtgatccgtccgcctcggccgcccaaagtgctgggattacaggcgtgagccaccgcgcccggtcaggtttcttatttttgatctgaggagtttctatccttgataggtgttcatctttatcaatatttgggtcaggccgggcgcggtggctctttcgtgtaatcctagcactttgggaggccaaagcgggaggatctcttgagcctaggagtttcaggccagcctgggcaacatagcgagacctcctctctactaaaagtaaaaaaagcgggacgtggtgtcgcacacctttagtcccaggtactagagttcgaggttgcagtgagctgtgatcctgccactgcactccagggtgggcaacagagtgagaccccgtctcaaaaaaaaaaaaaaaaaaagtaatatgtgtttttagggactgatttagtaaagagaccctgatttcaagcaacacagttgagtactaatttattatttacctaataataattgtgttattaatactgtttatttaatagaggaaacaatgcagaggtacttgtagtattgtgtaagtttaacgtgcgcattgccaaggttatatttgaatgacgtttttatgtaaatgtccatttattacacgtttcacgaacgctattgtttgtgattgtatgatacattctagctagattattatcttttctttttttttttccttttctttttttttaaaaggtggagtttcgctcttgttacccaagctggagtgcaatggcgtgatctcggctcaccgcaacctccgcttcccgggttcaagccattctcgtgcctcagcctcctgagtagttgggattacaggcatgcgccaccatgcccggctaatttttgtattattagtagagacgagatttctccatgttggtcaggctggtctcgaattctcaacctcaggtgatccgcctgcctcggcctcccaaagctctggaattagaggcgtgagccaccgctcccggctatcttttctgttttttaagtagacttaatttatttttagattttggctgaaactgagtgagcagaattcctaaagatgaagaaactgttccaatgaacagtgcaagctgaccccataggcatgctttacacacgccgtgtaaatgttaaatgctgtactcgatgaaaatgattgctctataaccgttcatacattttaggtgcatgttgttttgatagccttgactgacttggtttcttttgcagataaccttctgttcggtgatgaaattatcactaatggttttcattcctgtgaaagtgatgaggaggatagagcctcacatgcaagctctagtgactggactccaaggccacggataggtatggctcagagctgttaattttagagagtaaatgtacgttttttggtttgtttgttttgagacagagtttcgctcttgttgcggaggctggagtgcaatggcgcgatctcggctcaccgtaccctccgccttccaggttcaagcgattctcctgcctcagcctccccagcagctgggattacatgcatatgccactacgcccggctaattttgaatttttagtagagacggggtttctccatgttggtcaggctggtcttgaactcccgacctcaggtgatccgtccgcctgggcctcccaaagtgctgggattacaggcatgtgccaccttgccccacctcacttgtcccctttttgtgtagtgttcttcatccggttagaatatcttcctccctcacttcatattccttgttttttcactttattgtacacttaccacttcttgaaaagctctgtatcttactttttaaattgtgttgtttcctggtctagaatataagttctacgggagcaggaatttttgactgacttgtatactcctgtcttttcagtgcctaaaaaagtgcctggcacatagtttgtgctcaataaatatttaataaatatgtgaatgaaatgggaaagtatttcgatgtagaaagcattatcagttttttataccaaaggtataaccatcttgaaagtggatctttttatgttctcactcttacaaatggcttgattatttaaacatagtgaagatcagtttctctttggtgtctgtaatttatttatttatttatttttgttttctcaagcctagggagctggtttgagcaatctcagggtaaaagaaaatgattagttctcagaacatcaacattgtatgtattatcttggaagatgggttaagatcaaattgaaaaattaccggaaaaaaattaagatggcagttatgtatagattttcatttctttttcctgtgtggttttaatgataagtagtacaggcttttaggactggtacgatttttctatgtcgtagaacccttttgtaaatacttttggtattatggtgtgtgtttctagatattaaccataagaacttaattctggttgttaattaattagactcttgaaatatatacttacagctgaagggggtcttcccaactcttcattagatcttcctaatctcattgggatatagcattaattctgagtgtaccgagaatgaaataccattaaattgcattttcttactttgcaaaaaaccctcacagaatgctaactcattacttcagaaaataaatgagattttgaattacttgataagttgactttaagccttttcccccttattgtaggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtatgtaagactagtacatggggaggtcgtatatgtattttcttatgccttttccaagtaggaaacatttttctggtttagaaggatttatccttacatgataatggatgtttgggaactgccaaaaactgagtgcagcagcagttgctaaattagttcagatttttaaaacctctccagccttaaaaaaatatttgcttctgcttatttatagcacagtgggtaaatggagttaaggcaagatttctacctacattatatcatagctcctaaaggagatgcagggaattgaaactctgcttttgttaagggatgtcagtctgatggagaaattgggtatttgttagatctttatgagaaactggaaacctaattggtattcacaagtgaaaagcttagtgttgggaagagtaacagattcctaccttccctccatattaattaagatgatgtgattgtggcgacttgacattttctatttgatctaccttagggttgcagctaattagttacctaagactattgcatagtgtgtgttttatacagagtatattacatgttagcaaccagagcaactgctgtagtaaaattttgtcctgttttctgccatttcgagttgcgaaagggtgttacataatcttagatgatcatcaggagtatgttttgctcacagataacgatgtagacaagtttgtttaacttaaattgaccttgactccaggtcaaattggagtcaactctggtaagatgatgaaacaataacttctgaaatctctatttgaaatgtcaggatttttttgtacgattagtgggcacgtctcaaagaaatgaagaattgaaatattatacaccttttttttttttcttttttttggatacagggtcttgctgtgttgccctggctggagtgcagtggtgtcatcatggctcactgcagtctcagcctctcctggcctgagtcttgctctgttgcctaggctggagtgcagtggcaggatcttggctcactgcaacctctgcctcctgggttcaagcaattctcttgcctcagcctcctgagtagctgggattacaggcgcacaccaccacacctggctaatttttgtatttttagtagagatggggtttcaccatattggccaggctggtctgaaactcctgaccttgtgatccgcctgccttggcctcccaaagtgccaggattacaggcgtgatccaccgtgcctggctatacattgttttttttaatgaaaatagagaattgttgtagtattgaggtaatagaatcctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtctaaaaagaaaaaaaacaaaaagccgggcgcggtggctcacacctgtaatcccagcactttgggaggctgaggcctgcggatcacgaggttaggagatcgagaccatcttggctaacatggtgacaccccgtctctactaaaaatacaaaaaatcagccggtcgcggtggcaggcacctgcattcccagctaatcagtaggctaaggcaggagaatggtgtgaacccaggaggcggagcttacagtgagccgagatcgcaccactgcactccagactgggcgacagtgtgagactctgtctcaaaaaaaaaaaaaacaaaaaaaaaaagaaaaaattcttccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatgtttaattttactcagttatttgggagttttatttctgaaataagggtagggttgtatttttatttcttaaaagaagtttcagactaaaattttctttctcaactcttacctaattatatggtaagagagctagctagttcctataaaggtagaagatttaattttacaaattatgccatgcacattttaggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgctactgtggcggagtaagatcactcattatggctagaattcctttattcctagaggaggactattatctacttcattttaggagtgagcttattttcaaagagatagttcatatttttaaaatttgcactgcagcgatggtcgttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctctacaaaataaataataaaatttgctgagcatggtggtgtgcacctgtagacccatccactcagtagtctgaggtgggaagatcccttgagctcaggagctcaagactgagtgaaccatgatctgccattgcactccaccctgggcaacagagcaagagtgtttccaaaatatatgtatgttttttgaagtttactttttttttttttctttttttgagaagtagtcttcctttgtcccccaggctggagtgcaatggcatgatcttggctcatagcaacctctgcctcccaggttcaagtgattctcctgcctcagcatcctgagtagctgggattacaggcgcccgctaccatgcccagctaatttctgtatttttagtagagacagggtttcaccaggttggccaggctggtgttgaactcctgacttcaggtgatccaccctcctcggcctcccaaggctctgggattataggcgtgagccaccgcgcctggccagttttcaccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcgcagatttgttaacataggtatacatgtgccatggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccacctaatcgttagaagttgtgaatagggacttctttaatgaatccagaagttaatgaacctagcttttttttttttttttttggagacggagtctggctctgtttcccaggctggagtgtagtggtgtgatctctgctcaccatacaacctccacttcccgagttcaagagattctcctgcctcagccttccgagttgttgggactacaggcgcgtgctgccatgcctggctaatttttgtatttttggtagagacggggattcactatgttggccaggttggtcttgaactcctgaccttgtggtccgcccatctcagcctcccaaagtgctgggattacaggtgcgaggcaccgcgccccgcgccctgccgatgaacctaaattttaactaaacagtggccttatctactttcagaccatgtggtatatttacatgactacaggagaagctttgctaattcagaataaattatgttacttaaattggcgactgtctttaaaaaaaaagtgattttttggatgcagtagctcgtgcctataatcccagtgctttgggaagctgagataggaagatctcttgaactccggagtttgagaccagcctgcgcaacacagtgagaccctaatcactacacccctccaccccatgtaacttttgttttatccaggttgtggtatattaaatgggcattagtgtaaagtgggaaaattatattaattcttgaatatgattactaaactgaatttgaaaagttttcaggctatcaagagaatttttaacttaaaacttatataatttgaactttttacttcatatatccgtaatgatgatggtcatctatatctagcttttagagcagacaactggttcatacctggattaaataaataatgtaaagttattttttgttaattatggattagtgaagatttactgttttaacctactcctgctagtggcactactgcatggttttgaagaccagtgaagtatgacttaaaggtttcttgaattggagctaggacactggcatttataaaatctccacgtagcgcagacattgacactatcagaagaccagcaagtaactagaagttactttgatcttaaatcaactacaaaaaacttgactcactagttatggagaatacattttttattgttaaactgaaaaaaaattcagtcacttataaggtgtagcctcttctaatcctgtttatataaatttatttattattattattttttgagatggagtcttgctctgttgccaggctgtagtgcattggcgcgatctcggctcactgcatcctccacctcccgggttcaagcaattctcttgcctcagcctcccaagtagctgggactacaggcacgtgccatcacgatcagcacttttagtagagacggggtttcaccatgttggcaaggacgtgtctcgtcgtgacctcgtgatccgcccgtttcagcctcccaaagtgttgggattacaggtgtgagccacaatgtccagctgataaatttaattttgcttttctgagttttcatttatggtaatggttaaatcagctaggctttacagttgttactcacatataattctttgtccatcctttaattctcacattgggaactgactaaaaaaagaaagcttccagtctgggcacagtggctcacacctgtaatcccagcactttgggaggccgaggtgggtggatcacctgaggtcaggagttcaagaccagcctggccaacacagcaataccccgtctctaataaaaaatacaaaaatcagccaggcttgggtggcgggcgcctgtcgtcccagctacgcaggaggctgagacggggagaattgcttgaagccaggaggtggaggttgcagtgagccgaaagcgcttaaggagaaataagtaaggacaaagagtgcaggatagtatcctgacatggaggatggggagggtatgtaaatattgtcgatattttactgaatttctaaatattacaagaatagaatattcataggataacctaagcttttctgtgagtcagtgtactaggcagaaagttcactaaagtggtttatgatttttgctacttatgagaaaacattaaaaatgaagccatgaaaaggaaatattggtgaaatttagatacttcagaaggaaagagagactttcttttttttttggaaagaatttctataccatctattatatcattgattgtatgtgattattgagaattaacttgttttttttttttttgttttttttttttgagacagttttgctcttgtcacccaggctggagtgccgtggtgagatctcggctcactacaaccttcacctcccgagttcaagcaattctgctgcctcagcctactgagtagctgggattacaggtgcccatcaccacgcccagctaatttttctaattttagtagagacgggatttcaccatgttggtcaggctggtctcgaactcctgacctcaggtgatccgcccgcctaggccaaagtgctgggattacaggcgtgagtctcccacgcccagcccttaaatttcatttagactggaaatttcaagtaatggagaggtgtgttaaggaagttattgctctgttagagcagtttcttaaatttggcactattgacattttgggctggatttttctttttgtttctgagatagtttcactctgtcgagccatcacagctcgttgcagccttgaactcctgggctccttgaacaggaggctcctgcctgagcctcctgagtagctgagaccataggcatgtaccatatacctagctaaatgtgtttttgactttcttttttctttgtagagtcaagttctcactatgttgtccaggctggtcttgaaatcctgggttccagcaattctcctgcttagccttacagagtgtcgggattgtaggcataggccactgcacccggccttgggctgatatttatttgctatggggaactttcctgtgcgttgtaggatgtttggcaatgtccctggccggccaggtgcagcggctcacacctgtaatcccagcactttgggaggctgaggtgggcggatcacttgaggctgggagttcagaagagaccagccaacatggtgaaaccctgtctctactaaaaatacaaaaattagccgggtgtggtgacacacatgagaatcacttgaactcaggaggctgagtttgccgtgagctgagatcgcgctgctgtactccagcctgggtgacaaagcaagaatctgtctcaaaaaaaaaaaaaaaaaaaaaaaaaattcgctggtctccacctacgtttgtatccccaccccaagtcctgacaataaaaaatgtcttcaaaatgttccttgcaaaattgctcattgaggctaactgaggtggctcacaactttaatcccagccctttggaaggctgaggctggcagatcacttaagcccaggtgactggccctggccaacttggcaaaaccctgtctctactaagaatacaaaaaatagccagacgtggtggtgcacacccgtaattccagctactcgggaggctgaggcagcagaatcacttgaacctgggaggcggaggttgcagtgagccgagatcgcaccactctactccagcctgattgacagagtgagactccatctcaaaaaaaaaagaaattactctctgagcaccagtgtgttacagtgtgcttagctgtggtaccactttggattctttcacacaagaacagttaaggccagttttaaagctgtggggccatttctgaactgtattttgtttttttttttttggagatgaagtttcactcttgttgctcaggctggagtgcgatggtgtgatctcggctcacttgcaacctccgcctcccaggttcaagcaatctcctgccttagcctcttgagtagacttgattatgggatcttggctcactgcaacctctgcttcccaggttcaaacagttctgccttagcctgctgagtagctgggattacaggtgcccgccaccatgcttggctaattttgtatttttagtagagacggggtttcaccatattggccaggctggtctcgaactcttgaccttgtgattcacccacctctgcctcccaaagtgctggtattacaggcatgagccactgtgcctagccaattttttgaatttttagtagagatggggtttcatcatgttggccacgctggtctcgaactcctgacctcaggtgatccacccaccttggcctcctaaagttctgggattacaggcgtgagccacttcgcccagcctgcactgtgttcttatcctgcataatgacttaaattgataataagttgtggtcatggttctcagaaacctaaaataattcactgatgttaataaaaatgagtggttgtatttagagtcaaggcgaaactgaattaggatgtataaaataactttttttttttttttttttttttaagtaggactgttgttcggctgggcgtggtggctcacgcctgtaatcccagcactttgggaggccacagcgggcggtcaaaagtttgagaccagcctgaccaacatggtgaaaccctgtctctactaaaaatacaaaaattagatggatgtggtggcgcatgctgtaatcccagctactcaggaggctgaagcaggagaatcacttgaacccaggaggcggaggttgcagtgagctgagatggcaccactgcactccagcctgggcgagagagtgagactctgtctcaaaaaaaaaaaaaaagaaaagaaaaaaaaagaaaagggactatactatgttcgaagagtgtagtttctgtcccatactgaattcactgttctttccctagtgattaaaatacaagaaaaggtagagggagaaacacgaactgaattttatgaacttaattccaagaatgtatttttacatttgttcaaaaaattattactttattgataatatgcaaacataccagattatgtattaatagttaaaaatttgagttctagaacaagcttattaaaaatcaacgtcagtaaaaagaaaatagatggtagtcacagtgccattcatctgaaaataatgttttaatactcaacatgtatatggattatatatctatacgtttatagtattgtagctggatttatgttacatttttagcataaaatttggcttttgctgggcccagtggcttgcgactgtagtcccagcaactcaggagggtaaggtgggaggattgcttgaaccaaagagtttgaggctgcagtgagctgtgacctcacctctgcacaccagcctgagtgacagagcaagacccatccctgaaaagaaaaaacttggctgttttactttgctttcaatttgtagtatattctacttaatataataaacttactttctgtgaggtgcttgaatactttttaatggttatttatgaagtggtgaactgtaattctgtatttgtacatttggatgtacaaatagtgttgctacagttgtccttttttggtatgtctccagtgttcttaggataaattcctgaaagtgaatttcagttttgaatttcagagaaacatgtcaaagttcttctttaagcctttaagtctcctgatatgttttgtcgtattgcagcttggaaaggttgaaataaaatcttctattagggctgggtgcagtggctcatgcctgtaatccgagcactttgggatttagctgatttggctgatttatcatgccactgccacctgtatccacccaaaatccacaaaaaccccaggatacattcttagcattaaaaaaaaagttatataaatatatataattatatatatatttgagacagggcctgtctctgatacccagacgtgtgcagtatctttcaaaaatcatatatctatatatagtttgccccttccttcagtctttgctgcccctaatatctgtccttaatggttaccatggtgaaactcttggaaatcattcagggggaaaaaaaatttgtgttgggataggggagggatgtcagcataagtttttaatacttgataaatgattgccaacagaatcaaaaacaccttgttttctatcttttttcaccatataatattcttgagaataatttcgtaacagcacttaacagatataccttatttttcaaagaaggctgtgtagcattctattttaaagttgtttcacagtatatgagtctcctattgataggtatctgcatttttgtctttttgatctagggttgtttttaaggcagtttaaaaactatagtaagtaaaagaggccaggtgcggtggctcacacctgtaaacccagcactttgggaggccgaggcgggtggatcacttgaggtaggagtttgagaccagcctggcaaacatggtgaaacccttctctactaaaaatacaaaaaattagccggccgtggtggcaagcgcctgtagtcccagctgttcggaaggctgagggaggagaatcgcttgaactcgggaggcggagattgcagtgagccaataatatgctgctgtactccagcctgggcaacagagcgagactctatctcaaaaataaatacaattttaaataaaattataaaaataaagcagcacccagctttattttttatttatttatttattttttgagacagagtcgcattctgtcgctcaagttggagtgcagtggtgccatcttggctcactgcaacctctgcctcccgggttcaagtgattctcccgcttcagcctcccaggtagctgagattacaggtgtgtgccaccacgcccagctaatttgtatttttagtagagatgggggtttcaccatgtttgccaggctggtcttgaactcctaacctcaggtgatccgcccaccttggcctcccaaagtgctgggtttataggtgtgagccgccgcgcttggctcaacatcttattgtttgagacagggtctccttctgttatccaagctggagtgtagtagtgtgatcttacagctcactgcagcctccaactcttgggctcaaatgattctcctgtctcagcctcccaagtagctagtactacaggtgtgcaccaccatgccctgctgtttctttgttttttttatatggacagtcttgctatgttgcccaggctggtctcaaactcctgagctcgagtgattctgctgcctcagctactcaaagtgctgggattgtaggcgttaactatcaggttaggcctgttctgtttttattagcgtggatgactgctggttactactggccgtttgtatatccttgaattacctctttgtttttagccatttttctccatttgggtgctttttcacagtgacttctgggaatattatgttcttttcttttgatttacctttcaaattttatttttatggatatataatagttgtacgtgtacattatatattcttgaagagttaggcttattgggattccagcctttagtagtcccatgaaggtgagcaaactgaaatgtacttactagtcttagtcatttggttcgtaatatgtaatagaaatggtgcttatcctaaaagaaaaatagaaaacttgagggtgaaggatcagaaattgaagacagtaaatactgcatagaggtttaaatgctagggtttttaggttttcttttttttttgagatagtcttgctctgacacccaggctggactgcaacctctgttccctggcctcaagcgatcctcccaccttagcctcctgactagctgtgaccacagatgtgcaccaccatgcccggctatttttttttgtatttttggtagagatggggtctcgccatgttgcccagtccagtgctggattttcatatcaaaacagggctctgctacttacttgctcttgtgaccaaaatggcaagttaggtttgttttgtatttgttttcatctgcatcggggtatatgttcacagctggatcagcaaactttctgtagtaaggtagggcctggtagtaaatatgtagtatgctttgcagactgcatagggtctctgtcatatgttctttgttttctttacagccttgaacaaattaaaaaacccagtcttcagccttgtctgtagcataataaagaggaaattaaaagtgcttatgttatacgtggtacatactaaaatttattaagtggcgactggcagtttaactaattgacattctcttgtgttaggttaatacaggggttggcgtactatggcctcagtccaaatgtggcccactccatgtttttgtataggctgtgagctaagcattaagcattaatttattacttaaatcaacaaataaagtttatgtggtgtacaacatgatgttttgatgtgtgtacattatggaatggctaactcaagctaatattcattacttcacatacttttttttggtggtgagaacatttaaaatgtactcttaataattttcaggtatacaatatttgttttgtttttgtttttgttttgagacgaagtctcgctcttgtccccaggctggagtgcagtggcgctatcttggctcactgcaacctccgcctcccaggtacaagcgattctcctgcctcagcctcccaagtagctgggattacaggcgcctgtctccacgcccggctagttattgtatttttagtaaagacagggtttcaccatgttggccaggctggtctcaaactcctgacctcaggtgatccgcctgcctcagcctcccaaagtgctgggattacaggcgtgagccaccgcgcccggctacaatatgttcttaattatagtcagcaatagatctcctgaacttattcttcccagcgtcttcccaatcccacctccaccccctgctaataattaattttaaatgactggggaaaaaattgaaagaactgtttcatgacacttgaacattatataaaattttcatgtcagtgttcataaatacaaacttttattagaacatagccatactatttatatattgaaatacagttgaatttgtcatatgaccaatttattagtattgattaagatgttgagcagtttattcaagtgtggttttgtggaatgaaagagacaggagggattatgaggactctccttagcaggattgatgcatttcactttttttgacaggaaggaaagtttaggttctattttctcagcaactctacttaactgcctccatctgaactatatataggagggggtggatatcagcaaagattaacatcagtaaattttgatgaattctctaaaaattctgatttttaaagagggaattttggctgggcacagtggctcacacctgtaatcctaagcactttgggaggccaaggcaggtggatcacctgaggtctggagtttgagaccagcctggccaacatggtgaaaccctgtctctactaaaaacaaattagctgaatgtggtggcgcgcacctgtagtcccagctccttgggaggctgaggtgggagaattgcctaaacccaggagaggtggaggttgcagtgagccgagattgtgccattgcactccatcctgggtgacagagcgagactctcaaaaaaaaaggtgggtgtgaattttgttatgttgtgcgggctggagtgtagtgcccatccattggcacgatcatagagtactacagctccctaactcccagactcaagtgattctccctcctctgtctccccagtagcaggaactacaggcctgtgccaccatgcccagctttcttagtcttgagggactgcatttacacctatgccttttactctagggtcttttattcatattgctagaaatttggagaagaaagaaaggcataatctctgcagaaaagccattatttctgcagatagttctttttttttttgagatggagtctttctttgtcacccaggctggagtgcagtggtgtgatctaggctcactacaagctccacctcctgggttcacgccattctcctgccttagcctcccgagtagtgggactacaggcacccgccaccatgcccagctaatttttttttgtattttttagtagagacggggtttcaccatcttagccaggatggtctcgatcttctgaccttgtgatccgccgacctcggccacccaaagtgctgggattacaggcatgagccaccacatccggccaatttctgcggatagttctaagctttagttttgaccacgttggttgcctatggccaattcctggattatttgcatgtttccagacacagctatgtgaaagcagggtttgttttaatagtgttttgagcctttgattccagttctgcttccactcttggtctataaggatccctatggcagcaacagaatggcccagccctcatgattggttgcttaaaaaggctttaggatattcaaactgggtggcctgtcttgtttggaataggactaagcatgtcacactttcaccatggaagagttaatccatattctatctgtaagttgtatctccagtcattggttttcaacaagtggtcctatcttaggaggagtggtatattagaacagtccttccagagtaatttttttcattatttcagattttttagttttttttgtttttttgttttttttttttttttaaaggctctcactctgtcacccaggctggagagcagtgatacgatcatagctcactggaacctctacctccctgggctcaggtgatcctcccacctcagccttctgagtttctgggactacaggcatgaaccgtgaggcccagctaatttttgtgatttttgtgttttttgtagagtcagggtttctccatgttgcccaggctggtctcgtactcctggtctcaagtaacctgcccgcctcggccttccaaagtgctgggattagaggtgtgagccaccacacctgtactactacttttagtttgaacactatatttaaatctaataattcagacatggcccatttcatacttgacagaaagtatgagtcaaagactcaaatcattcagattctcacatatgtaaaacgtacgcttggccgggtgcagtggctcacgcctgtaatcccagcactttgtgagaccaaggtgggcggatcacctgaggtcaggagttcaagaccagcctgaccaacatggagaaaccccgtctctactaaaaatacaaaattagctggggtggtggcacatgcctgtaatcccagctattcaggaagctgaggcaggagaatcacttgaacccgggaggtggaggttgtggtgagctgagatcgcgccattgcactccagcctgggcaaaaagagcgaaactctgtctcaaaaaaaaaaaaaaaagcaggcttataaaataaaacaaaaatgtcccttatgatttgtcttaaaggtagttgaattaataagagctaaatctagtgtcccatacatctttgtgtttcttactctaccctttagaaagggtgggggtggacgtggataaggcacacagttaattcagggacggtggagtcttggtacttgctctttttccctgaccttgctttggagttattttattttttaaattctgcatttggcatgctattatcacttgcttactactataggtcctattttatctgttgcctagcatattctcatagtgcctaaaatactctaaaagctatttccagagggagctttaatgagacatacaatgcttaatctctcaaatgtaaatgtactagaacaaagcattctggggaagaaaacagtggttgatttaactgaactcacttttccaaaacagtggcttttgattttctgtaaacattgactttattaagcttttcccttgctactatatgcactctctatttcttaaattgcaaagagttattcatgaaatttgtgataaatatttgaatctaaggcaacgtttttggattctttatacgaggtttttagcagcatgtgtacatgtatgtgatagctgttaacggaattcacttaagttttacttagaagcctgggtagtagaacctagaagttgcagtgggaatttttttttaatttgaaagattaaataggtaaaaagtcatctttaatctctattaaacttttttgtgtaatgtcagaagtgaaagttccccacatctgcttacagcctgtttgtatccttcctgacttgattgattaaatggacatctctatatacatatgcatataatttcaatttttgcttagtaacaaaaacaaaagttacacatactggtgactaatttgcttttttcacgtatgtcatgaaccattttccagggcagttcatctagatctccctcaattctttttaatggctacatattccactattatggatgtaccatatttatacaaccggttccctattgatggacatatggttgtgtctagttttttgctagcattgtgatagattagagcctgtaatgaatggtaaggaagtaagtagatgatagcactactactttgaaggaaaaagtagagaataaacttcctttgccatagtcacttactaaatggaatttaataaaaacactgtcaaaagttgggaggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggtaaggattaaaactttagctttaaacttccagcaggttgatattctaatgaatgataaatcaaaaaaaaattttaaatattcttgtattgacagtgcttttttttttaaatcaccctaccttgatatctgtaattttagtttaaactttcccatttttctttaaagaaaaaaatctgaatttgcagccaacaaaaattagatatcctaaggttgtattacttctgacttttattaaaatatcaacatttcttagagatgtttatgggccgactttgtctttttcttcaaggggccaagttcactaattgctgagttttatgcatatgacagcaaccgtccttttgtaggtgtgtgtcgcatccatctagatactttaaaatgctcatctatttcatttttaaaattatgtgtgtgggattatcagtatttttttgttaaacatatgacatctgtagtttatttcactaatgtaaattttttctaccatttgcttgatacaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttagtaaacttcagagtggttttctgtaatttattttagttttataggaagatatttcctataaagctgactgccatcgagaagtggagataaagcattatttaatcatgttatctcatttatcgataacctcagaaaagtagaaaacaaaaataataaaaacagaagtattggccttgacagttaattatagaaaacctcagatattaatttgcttttgatttcaaaagatgctgcagttgcatgcattcaattattttaaataatcttttctggctgagtgcagtggctcacgcctgtaatcctagcactttgggaagccgaggcgggcagatcccatgaagccaagagttcgagaacagcttggccaacatggtgaaatcccaactctactagaaatactaaaattagccgggcatggtggcaggcgcctgtaatcccagctactcaggaggctgaggcacgagaatcacttgaacctgggagttggaggttgcagcgagccaagattgcaccattgcgctccagcctgggagacagtgagactctgtcaaaaaaaaaaaaaaaaaagaaaaagaaattctgaatacaagagtagtattagctgttaatgaagaaatgtgacatctttagtttatgaaactaaaagaactggatagttgagatgtacaggattcagagattcagaaatgtttaaaacaagtatcaacaggccattaggtatctaaagtgtttctaagaactgccgagctaaggtaatagagttggaactgtccaactctgcaggattttagccctggaggagtgagctgttacagttttgttgaaaagagtagctttagaaggcatcattatattagtgtctcagagattgagaatcatattcattctatgtataaatatataaattcttcatcccctagattctcctgtagtatatcacaaaatctgcagtgtgttctgaggtttaaaatcaaagttaaaaacaaaaacaaaaatccttaaaccctcttaacatttgtgatgttaaactttataacgtttgtggtgtgttcaagaaacagaaatacttctttaataaagcatatatatgttgtttgtttttaggttcctttgcaacagcatcttgcctgatttgtaaatacaaagttgactgtgaagctgtacgaggagatatttttaatcaggtaatttgttgcccatattttaggaattgttcatgtctctgaagtatttcttcttttgcctcaaaatccttttttacccctttaaagtatatatggtacagaaagattcaggaagaaaatagttagcattttggaattttggtaaaatacacgagaacctttcaataccttatatagaaaacagccctataaaggctcttcaaattatgaaattggcttcttagtatctaagccgaacataaaatgtcagatcataagcaagttgttgttgtagtagtttttctccttcctctccctttttgtgcctgtcagatttggaccttaaattagttatggtaatctaaaattatttcatacatgttcattgccaaaaaatataggaaaatttggcagaaaataaaaattatccagaaatatgtcctgtgtgcttagcaatatatggaggtaatcatgtcattacgaaagaggaagaatagtatattaaaatggagtcattggtcgggtgcagtggctcatgcttgtaatcccagcactttgggaggacgaggtgggtcgatcatttgaggtcagaagtgagaccagcctggccaacatggcaaaaccccgtctctcttaaaaatacaaaaattagcctggcatggtggcatatgcctttaatctcagctgcttgggaggctgaggcaggagaattatttgaactcgggaggtggaggttgtagtgagctgagatcatgccacttcactccaggctgggcaacagaacaagactccatctcaaataaataaaatggaatcattttatttgacaaatgtctatttttttttgaaaggatcaattcccatttagtgtatatacacacattatgtttttcctcttaatatatgatggactcttcaatgtcaagtgtttttctacatagatattataacaagagcatagtatttcattgtttcatagtatgttaataaactacccatcattgacagttgctgtttatccatagcttttctgttttgttttttttttaataattctgaaatgtattcttagaggtatggaaatgttgactatttctaacttgggcttactctttgcttctctacctcaaccaaaatctgaaaatatgtaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagtaagttggtgatggtttttggagaacatttctatatataatgtcatgggttgtgggtctgtataatagacgctagtaatcttaactctgcttctgtttgaaagagtggtgaagagctaattttagaaattgtttgtttgtttgtttattgagatggagtttccctcttgttgcccaggctggagtgcagtcgcatatcttggctcactgcaacctccgcctcccgggttcaagcgattcttctgcctcagccttctgagtagctgggatcacaggcgtccaccaacatgcctggctagtttttgtatttttagtatagaccgggtttcaccatgttggccaggctggtctcgaactcctcagctcaggtgatccgcctgtctctgccttctaaagtgctgggattataggcatgagcccccatgcctggccagaaattctttatttttagtagagatgaggtcttgttgtgttgcccaggctggattcgaactcctgggctcaagtgatcctcctgcctcagccccttgagtagctaggattacaggcacgagcctccacatctggctgaactgtttttttaggtggcattgttcattgagactggtgaatctgacattttgatggggggtggagggttgtcaaaacgcaagtaatgttggtggctcgtgcctgtaatctcagcactttgggaggccgaggtaggtggatcgcttgagggcagcagtttgagaccagcctggccaacatggtgaaaccctgtctctactaaaaatacaaaaattagctgggcatagtggtgtgcacatgtagtcccagctacttgggaggttggggcatgagaatcgcttgaactcaggaggcagaggttgcaatgagccgagaatgtgccactgcactccagcctgggtgacagagtgggactctgtctcaaaaaatcaaaaacaaacccagaagtaatgctaaactctacttctaatttatgtgaaaaattaagacaaaggtagagttcaacttagactttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgccataacggtgatatgtcgatatagtttacccaaaagggtgtgtatataaaagtgttcacataaaatttaaatccttattactctcaggaaaatttctttgtcatatatattctcatactgtctgtttcctcctctagtttagaatcagaggaggagagagagagatttcagttgcatcagatgtgtcctttcataagtgagggaaagaggagaggaaaaatattaaatccctagccagagaattgaattagaccccacatcagcagtcaaggcagccagagtaaacagttggaagaaacatggagtcaagctcttcaattttgtgtctatcccatatctcgtggctttagcagttaactcagtcttacctaattagctgtgaaattctgttaaagtagaatacaagacaatttgcaattaaatgaaacatgaaaatttaatatacaaatctctttgttcttgagttgctcttcttaaagcaaaatcaaaggcactctgcttaaaagcttttctttttattttttagagacgggtgtcttgctgtagctcaggctagagtgcagtggtgcagtttcagctcactgcagccttcaactcctggggacaagcagtccttccacttcagcttcctgagtagttaggaccagaggcgcacaccatgcttggcaaatttttaaatttttttttgtagaaacgggattcactttgttgcccaggctggtcacaaactcctggcctcaagtgatccttcctcctctgcctctcaaagcattaggattacaggcatgagctaccatgcctggtccttaaaaacttttctttcaaaagctttctgtgggatagtatgatgtgttgcaaagataattaaaaaaagaaacaggtttataatagcgtagaatatgtttatatgactttttccctccccccctcccctccctccctcccttccgtttgtccttccttccattcatccttccttctgttagtccttccttctgtccatccttcccgtccgttcttccttccttccttcgtccatccttctgtctgtccttccttccgttcatctgtccgtccttccttcctcccaccctccctccctccctcctatcctccctccctccctcattgcccaggctggagtgcaatggcatgatctcggctcactgcagtctcccgtgttcaagcagttctcctcccaagtagttgggattagaggcatgcgctaccacacgcccggctaattttgtgtttttagtagagatggggtttcaccatgttggtcgggttggtcttgaactcctgacctcaggtgatccgcctgcctcggcctcccaaagtgctgggattacaggcgtgagccactgtacccagctcaccttctttatatcaggagctacttaagtagaacatttatgtaccaagaactcttctgtgcacttgactaactcatttaatcctcaccacagtcttgtggagaagtactattatcatccccattctgcagacaaggaaatttgaggttcagagtgggaaagtctgggaagattgctcaggggtaaccaggtgataggagcagaacttgagcgttttataaaagacacttaactgcccatctgcttgcttgatgaaatgtaatggcttggttaagtatttagtgcatgggtcttttttgggaatttggagctcaagcccttgttggatttttgcataatgtatctgttgtggttttattagcttacttcctcctccctttttctaactcttatttttcaccctattttaggttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaagaaaggcagtcggaccattttgaaagtataaatgtcataacagtatttccaaaaaattagctatttcggcaggttaatcgatagggtagctttatgtagttgattctgtttagagaaactgtacagttcgtaatcagaaaggtaaatcttctggtatcttaacatgatatggagaaggaagtgtttaatagtgctctgtatgttgtgtttctctaggggatggaaaaataagaatgggttattagctggcagaaatgatgacagatttgagtgcttactgtaggtcagctgctttacatatgttacctgattttaatctgaggtaggaactattactcttcttcaggtgggaaaactcaggaccatagaggttaaatacctcatgcacagtaactactaagaagtggaagaaccagattaaaatccagtctatttatgcttagagcctgcccccttaactactatgcggtgttgtctcagatgtagaacacatctttgttttctctgaggacttagaaaaaacacgcgtgattcttctccactgaatataggaatagtttctaccctgtttagaacatgcatagtctttatcaataagtgttaactgacatgtgaaatcactttctactctttggaagccgatgttttaagtccaagtagtctgtatggtggaaattcctaacttatgttaaaaaaaagaaaaccactgtaacttagctataacagtcttatataacttagaactttaagtctcattccatttaccatacttggcgaaaactgacaaattttagacaactgtatttgagtattccagtcatttgctgtaaatacattttagttcagttgaataaacctttggcctttttcatattaggcactgtggtaagttatggagacacagtgattaatgttgtgtataattataaatgtgagtgatactcattaatactttggtataggtgctgctgaagaacaaagtactttattattgttttgaacaaaacatcacacaaaaggtagattttttttttttttttttttttttttttttgtgacggagtctcactctgtcgcccaggctggagtgcagtggcacgatctcagctcactgcaacctctgcctcccaggttcaagagattctcctgcctcagccttctgagtagctgaaattacaggcatgcgccaccttgctcggctgattcttgtatttttagtagagacggggtttcgccatgttggtcaggctggtctcaaactcctgaccccatgatccatccacctcggcctcccaaagtgctggaattacaggcgtgagccacggcgcccagccccaaaaggtagattctacttggagattagattacagaaggctttctaaggagcaaaatatttaacaataagtagggatttaaaaagagcagacgtgttcacaggggaaactagaaaaagcatagagggatgcttacgtttgcaaatcgtggcagaagtcagaaagtagaaaaattgctactgacttagatacacagttgtctctagcgtatacaaagtctacctatgcactaagacttgcactgggaacttttcttgaatgtcattttgacagatgtgtcaaacggacaatctctttgcccaggaaacagagttaacctggaacagtcatttttttttaaatttatttattttttgagacggagttttgctcttgttgtccaggctgaagtacaatggtgtgatctcggttcacggcaacctccgcctcccgggttcaagcgattctcctgcctcactctccagagtagctgtagctgagaccacaggcgcatgccctcatgctcagctatttttttttttttttttttagtttttgtagaaacaaggtcttgccacattgcccaggctgataccaaactcctgggctcaagcagtctgccagccttggcctcccaaagtgctgggattacaggtgtaagccactgtgccctgcctgtggtgtcttgggaaactcatgagtactatgtgtctgttgtaatagagggaaataagtggttttcacagtgatttgtagtggactgtgaaattttagggattcaggtcagagttgtcacacaggttgtagtcagggtgagaactgggtcatgatgcagtatgaaaaagttcgagagccactttggagagaacttgagataggccacctaccagtgtggtaaccaggcttttgagaattcgtctgggatacggtacaataaatactatatctattatgtgtgaagagatgttaagttagggacatactgtgaattcaaggatagaaaacttttccatcagtttttagggatcctactctttcacttaaaccccaaatggccaagctaggattgatttggtgtgctgtagaaagaacttcattggtattcatggattcacattacatcttagaggagttttcaaaagcgtcttagactgtatgtgtatatacacacacattctgaagcagtaggtgggtcttggggcctgagatctcgggtgaatctaaatttaggttcacaggtgatactgtagattcacagtgtctacagagtacactatgaatttgtggtgactacattattgacaaaatattttaggtttataatcagaaaaaagttaaaatagttaatgaagatgctttaaaagcctgtgtactttagagaagctacttaacacaaattgggtatctaatgtaggctgggctggatacttcattttcatcaaatctttttaaaataattggtgaaataacctttattgaatatggttttctacatttttcacacttccctccttcatagggttgtgaaaatttatttcatattctagatgaggaaattgaggcacagaggtacacttacaaagatacaataaatggcagaactaagatttgaacccaggactaagtgtattgcttgtatttatttaattaattaatttttaagagacagggcctcactctgttgcctaggctggcccttgaactcctgggctcaagcagtccacctgcctcagcctcctgagtagctgggactgcaggcacaccatgcctcccagttgtttttaaacactaatagtagtctttcataaggacacttataataaaggcagagctggaacccacacttcattccagactgctcagactgagttagtgttagaaaactgaaagtaacatttttattactgtatttcaggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttacattgtttaaggtatataatttttaagtcttgcagaatttgtacagcttcgaatgctatagtattagatgctttctttctcatactacatttcttcatttggtttattacattagtctcaccagaccagtacttgcaaaaccctgatggtgctgatcgtagcaggtgatgcatcaccaccaagcatttcaaaaactatttcagccattctaggctagaggcctgagcaagtaaaacatggagaaaaggcagggcagggcctaagaaggatgtgacatgtcctatgataaaggaccaggagtttgggatttgagagagaacaggaagtggtggatagtgaaaatccatctgatgcaaaggctgggttaactgaaaatctgttctgggatgctaggtctttcaagtctgaagactgcagaccacatttggtatcaactttctgaggctgacctgagaacctacttaagccattaaaggttttgagggcgaaagtattactgaagaggccagcagtgtaccccttaaaatgtatgtgtaacttggtcgggtgcagtggctcacgcctgtaatcccagcactctgggaggcctacacgggcggaccacctgaggtcaggagttcaagaccagcctggccaacatggcgaaaccccgtttttactaaaaatacaaaaattagtcgggtgtggtggcggcacctgtagtcccagctatttgggaggctgaggctggagaatcgcttcaacccaggaggtggaggctgcagtgagccaagatcgcgccactgcactccagcctggtgacagagcaagactccgtctcaaagaacaaaaaagtatatgtaatgaataaagctttagcaatttcctgttcccagttctgcctccctccccagcaaactttctaggtagacctgtcctgtatattgttagcactagagaaattacctgtaagatgatatcctcaaaatattacaaaattaaggaacattctatatatgcacaaattgaagaagtcaggtagttgatacttttaaaggtacatagtcaatttaagtggtcaaaaggtatttggcaaaacctaatttaactcaagccctatgcataacgttattgctgaaccactggctaatgcagcatgtactgtatttcactgattgtaataccctaattaatgtcacatggtttaattagcgtttttttttgtagtggtacataaaatgacggtggaccttcaatcaatggtgttttacataatccccaactaagctttatttgaaacacaacttctgacctgtaatctagaaaggggtgggggagtatgtatatgtatgtacaccaaaacctctcccccaaagatctaaagccattctaggccttcagctcaaactaggatactagtagaaagtacagaaaaatggtctaatgacctccccaccttttgaagtgactgtcaaatgagactattaaaaaccacttgaaaacttttaaaaagcaagaatagcctgagacctcctagaaatacagatttaattggtgtaaggtggggtttgtgcagagtattaaaaacgcccccaggcgattcaaaagtatagccagatttgagaaacacccttagctggaaaagaattgaggagctctgttttgatgacttttaacatacactccttagggctggcctaaaaaaggaggttaacttacattagcctcaattcccaaattttacctagaaatgcttcataaattaggtaatttggggttcataagcaaatacagcagagtagggagctatcaaaatagagtgaattcttcagcaaaggaggacaaaactaccataaggcattctggatggtcaaagtgcaaaagaggttggggagtggaggaagagactgatgacaggaatattttgctcttgttttagcaggcttaccatgcactcttcaggggaagactgctctatgccatattacaccttgattcacagctttactaaat

SEQ ID NO: 15762 - DNA, 7236 bp, Human
tcttgggaataatactttgggatttgaaggatgagtcgtgattgtccacctaaccagagatcagggaaactagcattccaggcaggtggaaaaaaatgcaaagacctgtagggtatcggagtttgactcacccagaaagcattcagtagcttagggtatgtgaaggaggtgacaacagaggggctggcacaataggtagggacccaacttatggcatttaaattttatcttgggttatagtaaggccctaatggattttaatctgaaaagtgggatgtcatcaagacttgtatgacatgttggagggaacaaggggcaggaaacctgtgaggagactttcagtcatggggaacagaaggtagtgacaacagagatggaagcaaagaggctgataaaagagctaaatgtagaattgacctaacttggtgaacactagttctgttattatattggaactctctaaaatgtactcttcagcctcgtaaaagccttcttagggatgcaagtctatgactgaagagaaaaggaaagtcattcactcactcatacctgtttcccaaagtctgtccttgttacagactttgcagatcaggatggggcaggccctggaggtctgttcagaccccgtttctcagtggcccaaataacatcaagctgtattatacataacattcagtcacattatcaaatcattttaagattcaccataaccccttaagttagaacaagtctcattttatagatgatgaaataacggaagagttatgaggagtgctgaagccaaatcctcaagaaatggcagaattaagatttgaactaaagcctgaaatcacgtgctggcaagtggtgggtgctcagtaaatatctgctgaaaaagcaaatgaatgagtgaaggtttttttattcccagctcagtttacctcgagtccataaacaattgatcctagaagcccactgggaatccagagtagacataacacctaccctcgctccattgagaatctatcagtccagttcaactgaacaagcatttgttaggcctaataatgcctggcaatgagccagtctccaccgcagaagaatttcattcctattttgctattctcctctcagatgttaaaatgaggcagggaaatgacatgtgaagctctttgggtctacggagtcaagatcttcacaaaatcctgaatggatgtgcaagaataagccaggtccacaagtctgtggcaaagtgaggaacttcggcaaagcggccagcgcctggactgagaggcggggcccgcagggcgatccaaacgaaggtggacttctccaacagcccaggagtgggtctgtgaccccgccgcccaaggccgggaatcttacactggttctgcggattgggaattaggaagtaggcgttttgaggaaccatggaagctagctagcactcgggcaccttcccctacctcccgcgcactcttcacacgaccacctactacgcgcaagtccctcggtggaagatgaggcagtaaagggaggaccaagacccctaatcgcagcttccactccccaaaggagagtggtgcacacgttcagtgctactggttcccaagggctaaaaccggagcccctaggggcctggacgcaacaaaccaaagcccagcggccggccactgaaaatgggggcaggggccgctgcggagcgatgaatcctttcctcagccgcgctcgggctgccggttcggcggccacaggcctggcaggcgcgttagagacctagacccgttcccaagtaagggccgcacgggacccaggccagcagcggcaactcgcggagcttcagctcccctaggagccagagccgggggaggcggggccgagagccgggggcggggcccggacgggggcgggcccgcggtgacgtcgggagggcagcgacgcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatgggtgaggcagatcgagcgcgcggcccggaccggggcgccggccccggcgcagcccttccgcccccgcgtccctccagccccgctcacctgggtctctggccccgagtcacccacctcataacgccccggggcctctgctctcgggcgggtcccggtctgcatcgccgaccccggggcctgacacccggagctgcgggcctgggtggggtgaagctccctccgccccagcccggctggtaagaagggaggattccgcccttggagacgacttttaaaacgagcgcggcctacctcccgtgccccttgcctcccagtcctctcccgctccgcgccctctttggagttggctcacgccacccgactgccctccaggcctcaaaggtagataacgacgcgcacctggaggcgctcccgctctccgccccagtcaccatcagctgttgtggcctctccctttccctggtctctagggggctccctcgctcccatctccatccctgtgcccctttccgttgcagttggcttggatgcggctggcaagaccacaatcctgtacaaactgaagttgggggagattgtcaccaccatcccaaccataggtgagcccggggacgaagcagggagcgggagcgccgcggcgggccctcgcggggtctgctcccagttctgccacttttctggagctgaccctgacaccagatacagctatttgagaagtgggtcagggtatctctacgtggataccggaggcagggtggatgtgacctagccccgccctgttgaccgccagttctggggttctgttcccctgggccttgatcattgccttctggttttgtgtccctgctgaaatctaagtagttttagtgagttcctttctttcaggagttttctcatcttttttttccaattatctgcaggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatggtgagtacccagagccctgggaactgagccctcagcttggggacagagtgatctctgtagtggtatagaagtcagggagcccccaacaggcattgaagaccaggaatataagtttttctttgtggacagacacattgtgtatctcaccctgttttggatgggagtgactttttcactttttctgtgcattgtcttgtctttttttttttttgaaatgggagttttgctgttgttgcccaggctggagtgcaatggtgcaatctcggctcactgcaacctccgtctcccgggttcaagcaattctcctgcctcagcctcccaagtagctgggattacaggcgcccgctgccatgcccagttaatttttgtatttttagtagagacggggtttcaccatgttggccaggctggtcttgaacccccaacctcaggtgatccacccgtcttggtctcccaaagtgctgggattacaggagtgagccactgcgcccggccgcattctcatgtctttacatctgagtctgagaagttgtgggagagatgggacttatatgtggcaaagagaaacattttacattcctgccttttccatttggaaatgttgtcattttgcctaggcaagtactcaaattaggaaaaggtctttcttttctggacttatgggctcaggtcacctcaagctcatttacaactatgtcttgtcttcaacggcagactgcacaatactttttttttccaatcaagatgctaggaggtagaaagggaattccccaacacagtagaggagacgcagcctgggtcccaccttctcttctcctctctcagctgcaggaggacgagctgcgggatgcagtgctgctggtatttgccaacaagcaggacatgcccaacgccatgcccgtgagcgagctgactgacaagctggggctacagcacttacgcagccgcacggtaggggtcctgcccacctggtgctgaatcctgcctcttgagggaagctgcaggctgggacagagatataaaggcattccttttgttcctggttgctgacctctttctttccttttccccacagtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacggtgttgtctgtagcctgcaaaggagaggctaggttactgggtaccaagagacaacgtgggagaggatcaaagcagctaaggctgcagggcaaccccacccacacataccctcagctcagcttctccctccttattcttgggctggaaatactgtagggtttacagtggtgcaaatctcattccttcccagctccaaggagcctttgctgaagattacaggatctcccttcatagttccatgaaccacgtaattgtttcccatcattctcgtagctacttagagccgttcttaatgtttgccttacacattaaaattagagggggagagaatgtgcgttaataatacgaatcctgaggtacatttcagaaaatgtgattcatcaggactagtctgatgcccaacaatatgcatctttaaaattacccagaggaggccgggcgcggtggctcacgcttgtaatcccagcactctgggaggctgaggcaggcggatcacgaggtcagaagatcgagaccacggtgaaaccccatctctactagaaaaaaaaaaatacaaaaaattatccaggcgtggtggcaggcacctgtagccccagctactcaggaggctgaggcaggagaatggtgtgaacctgggaggcggagcttgcagtgagctgagatcgtgccactgcactccagcctgggtgacagggtgagactccgtctcaaaataaataaataaattaaataaataaataaaattacccagggaattctgccactaatagtctattacccttattttataaaacatcggtggggtctggggcttgtagttccttgctgcacaccactgagactcttgctacttgggaagacccctcctatggggaataggaaagcaggtataaggaaccacgggtggctgggcactgtggctcatgcctgtaatcctagcactttgggaggctgaggtaggaggattgcttgagcccagaagttaaagaccagcctgggcaacatggcaagaccccatctctacaaaaaacaaaaataaaaaattacctgggcatggagatggacacctgtggtcccagcacctcaggaggctgaggcgggaggatcgcttgagcttgggagatcaaggctgcagtcaactgagatgcactccaacctggctagcagagcaagaccctgactcagaaaaaggaaccaggggtgtggcttattccccaagtgtgatcgactgcccattttcccttggatcctagccaggcttaggcagaactcatcatcacttgtttttgcctttgtttttctttcatgtcacttttccaggttctgagctgggttttctcctcaagctttgcaggaagtgagtccaagagactataactcagagattctttggaggggaaagatacccttgcaggagctctatctgcccagccagatgtcctacccactggcagagcagctggggttgaggaggggtgcttggtgctctctccacctaggcccttctccttacccaggtcctgagccagccttcctgatgaatatgagtaatttgatgtcaactgattaactagggtttcctcatactccctgcaaaatagcatctggaacattttgacctcatcctcctaagggccataaaagctgatagatttttcttggttatcttgaacttaacaaaatacttgagttgcaagggagccaggcagaactcacttccttgggagaaaggaggttgctttctatcctgttaccagaatgagaaacggaggtaaagaaaggaaaaaacttgcctaaattcacaggttgaagttccggatcctggtctcagctcagcctactttggtgcccaaaggggaataggaaggcaaacaccggaggctctgcacccgcctcctctaggccatggattaatgctgctgcgccagggccctttccccactgtggtgtgataagaggctgccctcacagtcacaatgctcccgggtcacaga

SEQ ID NO: 15763 - DNA, 4447 bp, Human
ccctgggagtgtctgcctcatgcacatgtagataggaatgaaacatgccctactctcctgcagcacccccaggcttgctaggattaggaaattccagcctggcgaattctagtcagaccggttctctgctcttgaatcctgttaagatgtttatcaatgacaatgtgtgcacagcaggacgtggacgttcattagtgattctagtttcaccctgaccttgtgatctcgccctaaccttgtgatctcaccctgaccttctgccttgtgatcttttgttgcccttaaagcatgtgatctctgtgacccacaccctattcgtatactccctcccctttgaaaattgctggtaaaaacttgctggttttacggctcagggggcatcacggaacctgccgacatattatgtctcccctggacatccagctttaaaatttctctcttttgtactctttccctttatttctcagaccggccaacactgagggaacatagcaaaggacccacattgaaatatcgggggctgaatttcccccaatagcagaactcaggcccctctcacaatcctaatcttgtggcctttcattagttttacaaagatggtttttagtccctgagaaagaaggggtttagttttagagagggactattatcatctttgcttccaagttaaactataaactaaatctttgccatgattagcttgacctatgtacaggaatgaacaaagacagccagcctatgaggctagaagcaagatagagtcagctatgttagatttctctgtcataatctttgcaaaggcagttttattgttgttgcaatggttaattacctttcttggcacacaaaaaaagtacaatatctgacctctgtttttatttactaatccatgaattccaaagatttgaaaaacactcgtttaaacaatcccatttctttacctatcaaatgtgaagaatcacagcttaaaactaatagcaaataatctgttttatctaaaaaataaattttgttaagaaatacctctagacccttatctataaactaggagacacttgctttcaaaagatccttccaacttttctaaatcccttatgattaatctaaacccctcatatcaaatctaaagcccttagaccaggccaggcatggtggctcatacctgtaatcccagcactttgggagaccaaggtgggtggatcacctgaggtcaggagttcgagaccagcctggccaacatggcaaaagcctgtctctattaaaaatacaaaaattagccaggtgtggtggtgcacgcctgtaatcccagctactcaggaagctgaggcatgagaatcacttgagtctgagaggtggaggttgcagtgggtcgggataatgccactgcactccagcctgggcaacagagtgagactgtctcaaaaagaaaaacaataaaacatctaaaaaactagaaataccatttgacccagccatcccattactgggtatatacccaaaggactataaatcatgcttctataaagacacaggcacacgtatgtttattgcggcattattcacaatagcaaagacttggaaccaacccaaatgtccaacaatgatagactggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagaccacatggacacaggaaggggaacatcacactctggggactgttgtagggtggggggagggggagggatagcattgggagatatacctaatgctagatgacaagttagtgggtgcagtgcaccagcatggcacatgtatacatatgtaatgaacctgcacaatgtgcacatgtaccctaaaacttaaagtataataataaaagaaagagctctccggtccgtgcctccaagatgacaaagaaaagaaggaacaatggtcgtgccaaaaagggccgcggccacgtgcaacctgttcgctgtactaactgtgcccgatgcgtgcccaaggacaaggccattaagaaattcgtcattcgaaacatagtggaggccgtagcagtcagggacatttctgaagcaagcgtcttcgatgcctatgtgcttcccaagctgtatgtgaagctacattactgtgtgagttgtgcaattcacagcaaagtagtcaggaatcgatctcgtgaagcccgcaaggaccgaacacccccacccagatttagacctgcgggtgctgccccacgtcccccaccaaagcccatgtaaggagctgagttcttaaagactgaagacaggttattctctggagaaaaataaaatggaaattgtaaaaaaataataataataataaaagaaagaaaaaaaacaacatctaaaaaaaaataaataaaaataaaaataaaacccttagaccaaatataaagccttgaactgtctatgccttcttacatcctgttttaagaactgagatgagtctagacccaaatgaatacaaatgggatttgaaaagcataaagcttttttttttgtttgcttgtttggaaaataatacatacacatggtattaccataatcttatcaatattatgaagtcgttctaaagcttttttcttctaatatcagctaatagcagatctttgagtctttcttcctaggtattttccaactaaatgcttagtttaaatttccctaagccaacagcaaatactccttaaccttgtacttatgagactgaaagtgaagatttaccaagcctcttgtataaacacaaagatcactgcaccctacctgggcttccaatctgtttgacactgtgcaacaaagactgagaccctaaagtggaagaaaaatcttgttgttcatcatggaaaagggagcaacggaatggcaaataagaatttctagagaaaagcttctacacgtagccacaaagtcaaagaagataccagctttccacgccatattttcagcctaagccatctcttccgccttcattcaatgtgtttcatggtgtgatagaaaagtctgaatgtttcttgggctattttccatctattctataaagaaaatgtttttcttgttttgccctcactgtaataatacagaaaataaatcttaaaaatttagtgtattacttttgaagcctcataatatatctaatgttgaataaatccttaatatatgtttactatctgaaaaaaaatatgtgttcccatgctgtcttacagctttacagtattccaacttcaattacagaattcaattcacctcatccttacttctgtgctactctccactcatcagctgggaaataatgtaacaaaactgagagggcatgaggagacccgagagttcaaggtgtgacacaagctaagagactctgaaccattctgggtcagtttcctcatcagtggaatacaggtaatctagagatgggataattcccttgaccttgatccccctcttgggtgggaactcagtggcctgtttcactcagcctgtcactggccactcctcacgagagagaacatgcaagcaagcaattgtagagactggaacaaacgattgctggaacggccagttgctcctctcttgtgggagcaggctctgtgtgggccctggagcagctcccagcccctgtcctcttggttcttgtctggcgtccaggaagaatcaggtcacatgaacagattgaagggtagtgtatgtggatgattttatttggtgatggaagtggttcttggcgggatgagagttggaaaggggatggtgcaggaagaaggtgatctttccctgaagccacgctgtctgaagttagccacatctatctgtagtttctgatgctcagttgctgcttctcagcttactcctcagccacttgtatccctgatgctcagcagcttatgtgttgctctgccagctgaagtctttttaagggcacaggatagaagtgtggcaggccaaaaaggcaacatttgggtgggaaaaccaagaaaaacagggtcagttgttttctcttacaaccaccattccaggcttaagggtgggggtttagcttggaacccagtggttctgtatcaatatcacttttaaaaatactttttgtttcgtaacaattttatatattatggggtacaacgtgatgttttgatatgtgcttacaaagtggaataactttctcaacatattttttttaatactacatgacatagtgaaataaattttaaaatcactgctacttaaaatgttatctgtggaccaatgacagtacccagactgtttcctgtccctcagcaagtacagaagggcggtcctctaataagcttgctttgatataatgtt

SEQ ID NO: 15764 - DNA, 41523 bp, Human
attccggggagctctgctccagctacactgcacataaaagtgcgcaggaagtggatcctggagaggaactgttcttctggactgagcttgctgctcatggcagccccacctgcaggacccaaagccttatgtgatgtttgctggacactcagccacgtggctgcctgttgagctctgcaagtccacgcgggagccaggaattcctccccagaagtctctccattatattcaccaccccctagtaaatcacaacctgacttgctgcagaggatggagtgcctgggactcgtctgaccccagctcccctggggaagtgggggtggtacgtccctgcacccggccacgtgctgccttctcctgggctgcctgtccatgccgagcagacaggaaagtccagtgaggtccctgcctgtgcactccaccaaccacatcgtcccttcccggcagcctcacctaggcccctccagctacgaccccttgtcccctgcaccgatgcctggccttggaggttgctgctcatttttccggaattttttcttagatctctgcagggctgcccctccccctacaagggctccacacgtgttccctccttcatgactcccactgggcttccccgacagggcctcaccctccccaaagctctggtgacacctgccaggtttcctccaggccacagctcggcagcccgatcttagaacagaacgtggcacgcagggcaggtctggctgagggcccagcattgtcagcggggtcggaggtcttcccgggcctcgaaggggagacgtaggcttctcagggcagcccaggacgcgtcctcacgaaccacagcgaaattacagcaggtatctcgcggataggagtctgcatcattccgtctccatgccgtggtttctgaaattatgcaactatctcggcattccagagggctcagagtagccacgcgcagaggccctccccatggggtggatggaagcgtccactcgcggcgcgaggaatatccctgggcccctcgggagagtctgcaggggcagcccctgggtgagcaggcccagtgcggcctctccctgaagggactttcgggccctcccgggtcggggcttcaccggtagcaggcagggctttgatattaatgcttaaagggaaagcagagctgagctgtcaggacgttggttagctacaaaccctactcttgttaaaagagaaatggggtcggggagggggttctccagccctgaacttcccgggccgggcaggacgcggtccctccaggagtcggggctcccccgcctggggacgcactggggcaggcgcgcttctcctctcggggtcccatgtgccgccggctctcggacggtaaatcagggctcgggtgggggcgatgggggacccgcggcctcggtcgcccctggccagcctcggaggcgcacgggccaggccgcggggcgagaagcgagcgcgggagggcggcagctggcggagcgggaagggagcggggcggctgcggctgcggcgcggaggagcgccatttacgttcgggcccgcgccaggcgctgacgtgggcggccctgtctcggcttccgggcccgcagggtcctcggggcggacggcgctcccgccagcggcgctgagtccggcccgaccctgcccgacttcctcggggacaggcggtttagaacgtgcggaacaccaggcccggggcctccgccgggctgcagccccgcgagcttcccgccaggctcccgccccgccccgccccgcagccgcgtcccggccgggcgggccctgagccgcccgcgtgagtccgtgcgccgcccgcgctgggaaccaggagaccaaccgcgaggccccgcccgcgcgcgccgccgtgtccccgcccgcgcggtcgtcggagcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttggtaaggccgcgcgcgcgcgcgtttccggccgcgggcgggggcggggcggggcgggtgccgcgcgggcggggggcgcgggggcggaccgagcgcgcgcccgcgggccgccggctttgtgtgcgagtgcgcgtgcgcgccggcgtccgcgcgtggccgcggtcgggggcgggaccgcgggaagggtcttgcgcatgcgcgggccgctgcgtgtgcgcgagcgccgcagtctgctctccccgcccgcggcccgtgcaggtgacacaaaagggcctgtgggcctctgggctgccccgccggacccccagctccaccgaccccagccccgtcggacccgggacggcaccccgggtcccgatccccggccgctaccccgtccccggtcatgaccccgtggctgggcctgcggggccgggatggggcgggagccgtgcgcagctcggggtgtcctggggcgcgcgctcccgggccactcgcgggagcgcgcctcccgcggggaggccgccggcgaccgtggccgcgcgctgtgggggaaggggacggggcgcgggtgccgggtatgaccgtggaggaggccgctgccctcagaccgggcccaaagcgcagcccccggcggtgacgcgggagggcccggggtctccgttcccgcgaactccgcgaggtcccggaccggcccagcgcccccacctgcccttgcctgggcccgcccaggtcccggggcgccttcctcgcgggctgcggccgcggaagcagggagcacgggcgggcgccgggcttgccaccatcgccatcttgcagcgcccgcgtcctgggccggcccgagccgctgcgcggagcctctctttccctcgacccggctgcaaaggcagagtccgtgcgcctgagccccgggccgagactggagcgttctctggcggcctccaagggcgccggtgtctggaagcccggcctgggccagatcccttttgctgtcgtctccgtgattgccgggacagaattcccttccagtggggaaaagggaaggcggtcgcgcccttcccggtgccctgagtggggaggtgaaaccctgagagttggggcaagagggcctggagctagggccgaggcggcgggtgcgcagggtgttccgttgagcccgagccccccctcccccctccccggcctctccaccgtttctgtaggagcgcggcagggagcacacgtccctcgggaagaaaacggcgctggcggctgggcctgcaccgcggccgtcctcgctgagctcctagcgcgtggcctttgcgcgtctgtgtacccgtctgcagcttggggcagggttgggggagaaccgtggggtaactatttgccgttgcagctgaggatgacagctgcggtttgggggtccccctttctgtgtcctggaactttgtagggcgtggctctgccctgggcctcagcacccggcctcccaggtctcccctgcctgcccgggcctggccacctccctctggggtctgggtttggctcctggttggggctgtcggctccgcagacgccttttgctctctgtgattctgttgcccatctttgagcacctgcttccatacaggcgtcctctgcagagctctgggagggacacgcactgggggtggcatctggtcactcctgggggtgcctcgtccgcctgcccggccatttttggggtgtctgccatgtccccaacatgcacttcttcctgtcagccttgaccagggcagctgttagttctgagaggtgggcgtgtggttggggatgtcagcgagtaggatcttcccttttattcgcttgtcattaacctgagaacgtggcagtgggggaggagaggcttggcccggggtgcacaggactgtgggctggtcctgtccctctgatgagtgggacgagccttggtccagtcctgtgggcttggcgcagagccggccccctgccatgtcctggtgggattggaagtgctggctcgtcctgtctgcctcccccaagggctgggagccccccactctttggacatttgtagtgtaagcagacagcaactgttaaccatcattctgttaataaattttttctggaggaaccctggacagaagtagtcatgctctccaggaaacgggccccaggctcgagaggcccagtctcttccctcggggcttagaggtggccgtcaagccacacctggttccccaccagcctggcagtttttctggtttttctcctctgactgtcacttgccctctcaacttcctgtggccagtacccccagaatgtgacctggtctgagctgacggtggtgtcactgagccaagaggcgtgtggctggcaccactagtgttgctgagaactcttcaggcagcactttgtgcccggctgtgccctggtgctccccatgcagtgcccaagtcaaaggtgtgtgccctgtgaggtgtttaccccggttgactctccttgtagaaggacttaatgtttcccactccactgggggctggagagggctccatccaggtggtgctgacggtgcaggcctggcccagggcccaggggtggccaggaggtggtagaggcagcaggcagtgtcatacgggttctgtggttgaactgcatcgcccgagggaacgctggtcggagcgccgggtggagcgccagggtcctctggtggtcgctggatgttggtagttgtgggtaagagctctgtgccgggagtgtctggacccccgggtcctccattgtcagctgcagtggccggagcccactgctctcccccgcactgggtcgtggtaacccacaaggtgccacctgcgtcactgaccatcgtttccagaagcccctccggccacacattccatgtggtatctcccacaaggaaatgttcgtttttttccctgtgaagccagaaatttcttggtggctctttgccgagccaaacgttaaccttgagttgtctctctgggcggccccaggtggtaccagttctcacgggtgttgaaggagagtgaggatggccctgagggaagcccagttggtttggttggggaggcgttggggctatggccctgagagaggtgtgggcggtgttgggaccaggccccttctgcaccctcccctggcaccgccgttaactctccaggcctggtgtggcccaagccaccctgcctacccgtgctaccctacccacacgtgccaccctgacctgcttgtgccatcctgcccgcccgtgccaccctgcccacccgtgccaccctgccctgccgcccgtgtcaccctgcccgtccatgccactctgctatgccgcccgtgtcaccctgccctcccgtgccactcttccctgccgcccgtgtcaccgtgccctcctgtgccaccctgacctgccgcccgtctgtggtgtgggggctcctgggctgccctgtctgcgtggctggcaggagcctcagaggcatccgaggctgtctctccagtggtgtcgtgtgtagactgtgttgggaaggggaggaaggtgtagccctgataccccacatgtggtaggagccaggaaggtggcgttctgggggttcctggagctcacaggttgtgtgcatgtgctcgctgaacaaacagggaaacgtgcggctccacggatgtcctggagaggaatcttgctggcaaatccatgcctttgatcacagcccctgcgctgtgtcctctgagctgtgatgcggccctgcaggccccgtggagtgcggtggctccctggctcacagggatgctgccgtccaaggtgccgtatcggctcgtggatgacttgggcagtgtctgtctggggtgctgtcgtcggaggagctgtttcaacctgtgggtgacgggctttgtctgtctgggggaggttctgttggccccgtgctctcagcccagtggctccatgctgctgtgcggctccctcttgggggcctgccttctctgccattgcagggcagggcctcagttttctctgggcggcaggtggctgtatctcaggactggaaggctccgggtcaggctgtgcacagccttcgttcatgtcagcccctggctgggcagcaccgccaggccctagtctttgggcctccaggcctggacagccagagggggcatctcaccaatgcccagatggctgccggggactcacggcagggcagctttgtcacgagagggccactcgagcccggagtaatcagggcttatggggacagggcagggtgagggccgctgagaccacccagccttagggtgcccttctggtggtcggggagcccttcctgggcagcggctttaggggctgctgtggggagggggaagaagatggggttggtgaggaggagcttttgggacactgtcctggtggaggtcgtgagggaggggagcggaccggttggcccagcagggctggccagtggagggacgtggagggttggtagctgccgagcctgggtctgagcaggcggggatgaggaccaggtgctgaggctggggaaggaacaggggtagctgcttggtcctggcgcatcttggtgccccctgggacttcctggaacaccccccccccccagtgcccagagacccactgtggctgtctggatcggggcaggtcccagcccatggtgacccccagtgtgccggggcaacccggtccctctccagaccagaatggaccgatgcccagcacacacgtggatcggggcggagtgggcaggcgtggccaacaggagggaggatccggcaggcagatggtgatgtgcatccagagacagggcgttgacatgtggccaggaggctctggggtcatcgggccgccaccgtgcagccccccgggacttgatgcctccagagaacctgggggctgctgcccctcacctcacccccatttactttaaaatcagtttttgttttagagcagtcttagatttacaggaaaataggaagcacaagcttccatgtgctctacactcacttccctcgtgggtcccttgagtgctttcttacaacatgaggttaagcgtctgcagggtgagaagctggagactgtcctcgtgtcgctgggctgagagccgtgtgcggctgtgagtttttgatgaggaaaagcagtgtgggtcctggatttggacagcacaggcccctctgggagccgtgtgccttcacctcggagtgtgtgggcaaggtacagagctggagcccttgaccctgaccggccagccaggaaggccgtaggaggccagctccctggcgtgaggtgcgcagggcctctggcattgccctaggtgagggctccaggactcggacactggctctcagtggggcaggtgtggcccggcagggggcgctttgtgggtgcacagtggccccagggtggtgcagatggtgggcagacctaccccagggctgtttctgagacagaggtccctggaggagaaccaggtgctgggcctcaggtgtctgtcctgaactggagcagccttggaacaaggaaccacaggaagtccctgtggcatggggtgcagcccctcaggtctggcagggctagcccagggagtgcagggccccaggagccctgccacaggttcctcagctcgggagctcacggcctcctcactgcagggtcctttcaggagggccagggtggccttcacacatctgcttcctcctcagagacacaggtgtgggcacgtactggccagtatagataagcattgagcagcattgatgggtatcgatgatcctccaggagcagcggctggtgccatgctgctgtgggcagtattgagtattggccggtcttgacgagcagcagccggtactgggccaccgtgggtagcattgatgagtattgactggtatcaatgagtatcagccggtatcaatgagtattggcccgtatcaatgagtttggccagtattgatgagtattggctggcattgatgagtatcggttggcgttgatgagtatcggctggcattgatgagtatcggctggcgttgatgagtatcggctggcattgatgagtttggctgggcgtgggtggcgcggtgccttgccccctggccaggctggctcgtgggtgaaatgtgacatttaggcggttttctcctgtccttttagtttgtttttatgtggtatccgggtaccatggggagatctggcattcagggcaggaggctgcagcgcaggtcatgggggctcaggcgcaggtgatggggatcccgctccacagtgttgctcttgggccctccgtcagggagtcccacacagcacctgccatgaggagtggtgttggggaccctggatgggaggtgcgtgcgtggggctgcaccccagcccctgtgatggtgtctctggaagctggagatggtcggcatgtatgcttgaatcctgcagagggagttgagggttggagatttgtctgcgaggcctctgcgcaggggcggcctcacagcacactaccagggtcttaggcttggctgagtggccccttctggcctggcaggcagtcgtctcagcccacgcctgccacgctgctgggctggtggtggccggctcctgtcctggtcagcctgatgtcagctgcacgttggggtcagcctcggtgctgtgtcttcatgccagagcaggggccaggtgtgggcagctcagtgacaccctcccgagggctgggcgatcgtgtgcactctcaagcctctactggaaggcttggccctctcaggggccccctgcccctgtgcattcagccactggggttcgtgccctcagcttcccgccaggccctggccgtagcggtcaggaagagctgagcagtttttttgggagaattgagggagcgtcgccaggatgcactgagggtcggaggtggagccggcgcggctcagtgcaggcagtgccaggctggatgctggaaagccagcagcacctctcccggtggctcctgggaagttccacgtccttgcctggtcacagaggcccgggaatcagtgacatgagatagaagcttccagaacaggaggcagagcctttccgcagtttccctgcccacagcacacaccctgtgccctccgccccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggttggtaggggttcctggcgtcggcggcagagtgaagccggccggtctctttgcgaccgtgtggaggaggcactgcctcggatcaagtcgagggacctgggctgcatgggcgtcgggccggactgctgccacctgacccccggtgtgctctgggcgaggtcaggtgcccctcgagggagggcttcctgcacacctggtggcagagcacagctgtggtcaggcctgtccgtggcatctgctgtctgtttctgtcggaaagtgtctgagaggcacggagggcctccatgtggaggccgccagcacgagggtggagccccacacggaaccctggaaatctcaggtgtccacccggctggcccaggagcagggccgtggcccctgtggagctgttccttgtggttggtctgcgctctctggcccggaagtgcgtgcagtcggaaacagccttgggcttgggggatgctgcaaagcctgcttcagcacaggccgtgtgactgtgaagcctcctgggtgtgtccccaagcctgcaagggtgggctgtccggggaaccctggcacggtggtcaggggcagctcatgggtgatgtgaggaggcaccttgggtgcctgagcctgatggggcttggtgtctccacctgctcccccctccccaccgttcagctgagggacccggttcccactcacccagcacccgggagtcccccacgcggttccgacgagggacccggttcccactcacccagcacccgggagtcccccacgcggttctgacgagggacccggttcccactcacccagcacccgggagtcccccacgcggttccgacgagggacccggttcccactcacccagcacccgggagtcccccacgcggttccgacgagggacccggttcccactcacccagcacccgggagtcccccacgcggttccgacgagggacccggttcccactcacccagcacccgggagtcccccacgcggttccgacgagggacccggttcccactcacccagcacccgggagtccccccaggcggttccgacgagggacccggtcccactcacccagcacccgggagtgccccacacggttccgacgagggacccggttcccactcacccagcacccgggagtcccccacgcggttctgacgagggacccggttcccactcacccagcacccaggagtccccccaggcggttctgacgcagccgagcggtctgcagtgatcccgtgtgtccatgccttcctcatcagaagtgaaatccaaggatactgagagcggatgtctatccactcactcagaaacagcaacataaacctttctgctcatgagaagtcatcaccaccacacacagcggggagggaggccacgtgcagagggaggccatgtacagtgtcactgggcggcctgtctatggtgctcgtgggcagctcccgtccagagggaatgaaggaacaggcgaaccaggacgcggttttgaccgtgcagacctcacgtttgggatctggtttcctatcttgaaggaaagtgggtggaatggccagtggctcctccgaggacgccagggcgcgaggacctcacgggaggggcatgggcccagccgtactgggagccctcggctttggggtggtcagtggagacccatgccccgtcccctgcaggcgtgtgctgcaggcccactgcacccctgggctgtccaccagagcatttcttttctctgccatgggttccaggaggcacttccctgcttcctggatactggcagctcggtggcctctgctcacctgcaggcggatggggcagcggatggggcgggagactgggccgagcgtgcttgtggccgcggccactggagagcctgctgggtcactctgctccttggttctgtcctgcgcctcccctcctgctggccgaacggtcctgggtactgcttggtctcctgtggccggtctttggaggaggaggggagggaccggctgggccctggccccagctccgcctctgcccagctgccgtggggctgacagtggccccacctggtgctccctgcctggcacggggcggtcgggcggtgcctggaagctgccatgcttctgtgacgcctcagagcccttatttctccagttggccccgatgaggcttagttgcgtcatacgcgaaaggaatgggtgttaatgagctttaatcatctggttctgggaaggtcaggggcacagagtggactttaacaggttttaacccttttcttcctttgttctgtttcttttctcttcacatctataattggaagtaatgccaggcagagggttgggggcgtcctacgtgaaacactggtgaccccatcagggattccgggcagccacgcggtagcccaggcaggaaagggacaaccatgttcccaaagtcccgtgctgtcatcttgtgtcctccagtgtcctgggtccctcctgtccccctgcctcatggagctgccctggggtctcggacggtctgggagggtctcggggggtctcagagggtcttggagggcctaggagggtcgggaggtgtctcggtgggtctggaaatgtcttggggagtctcagagggtctgggaggttctcagagggtctggagatttcttggggggtctcggagggtcttggagggtgtgagagggtctcagagggtctgggaggatctcggaggggccttggagggtctcggaggggacttggagggtctcggaggtcctgtgcccaagggagatggtagtgggtgtccacagtctgtgtccacttgagtcagcgagctgaggcacacacgagttgtctttcacgtggatttttaatttactttttacaaatatcacaacatatagaccagaaaacccccggcggtcggccctcgttggcccgtgcacagtgggtggcgtggagtgggttgtagccacggggccgcagtggtgcaaggctgagcacttgcctctgtcttgcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacggggttttccctgagccccatcaggaggtggacacggggtttgtcctgagccccatcaggaggtggacacggggtttgtcctgagccccatcaggaggtggacacggggtttgtcctgagccccatcaggaggtgaacaccgggttttccctgagccccatcaggaggtggacacagggtttgtcctgagccccatcaggaggtggacacggggtttgtcctaagccccatcaggaggtggacacggggttttccctgcacaccatcaggaggtgaacaccgggttttcactgagctccatcaggaggtggacacggggtttgtcctgagccccatcaggaggtggacacggggttttccctgagccccatcaggaggtggacatggggttttccctgagccccatcaggaggtggacactcggtttgtcctgagccccatcaggaggtggacaccgggttttccctgagccccatgaggaggtggacactcggtttgtcctgagccccatcaggaggtggacactcggtttgccctgtgccccatcaggaggtggacactcggtttatcctgagccccatcaggaggtggacactcggtttgccctgtgccccatcaggaggtggacactcggtttctcctgagcctcatcaggaggtggacacggggttttccctgagccccacactcggtttgtcctgagcgccatcaggaggtggacactgggtttgccctgtgccccatcaggagatggacgctcggtttctcctgagccccatcaggaggtggacacggggtttgccctgagccccatcaggaggtggacaccgggtttgccctgagccccatcaggaggtggacatttggtttgccctgagccccatcaggaggtggacaccgggtttgtcctgagccccatcaggaggtggacattcggtttgccctgagccccatcaggaggtggacaccgggtttgtcctgagccccatcaggaggtggacacttggtttgccctgtgccccatcaggaggtggacacttggtttgccctgtgccccatcaggaggtggacaccgggtttgccctgagccccatcaggaggtggacaccgggtttgccctgagccccatcaggaggtggacacggggtttgtcctgagccccatcaggaggtggacactcggtttgtcctgagccccatcaggaggtggacaccgggtttgccctgtggcttcttgattcattttcagttttttcccagagagcaggtcctcgggatgccagcttttgtggcgggggtggagtaaggtgcttcccccggccccagttgcgcggcggtcttcacacgggcggtctcggcattgcccgcggcctggctttggtccagcagtgagcagcctttgggcagctttcctgattcttgtttgctcaggagacccacaggctcctccgtgatgagaactaggttggtctggcttctacttgtagccagggatcagtgattcagagcagcttttccctgaagacagacgaagaagctgggcccccaggagctcacaggatagggccaggcccaggctgcagcctggagaggcctagaacctgcaggaacgggcgggccttgccaactctggcctggggtgttggctgttctggaagaagtagctgagaggctgaatttggctttggtggcatcactggcctgctgggtgtggggccctgccgggatatccatggcctgaaaggtgacatctggagtgagggtgacctggactctgacgcgccacacgatcggcacccagcctgctgatgtccaggaaaccttgaatctggatttttggggaccccgcactgccggccccaggtgcctggcaaaagaagtaagacggcccctttagaggaagacagcgtcagccgaggcctcgggtcatttctacaaatcaccatctggtgcggggtccatcacatgcaaacagaggtaaccaggcagtcaaggagatgcgcaaaacgcagaagccagggaagcagtgccacccgcaggagctccccgtgctgcccacgagccgatcaccccagcccagcccccaggaggctgggccagacaccgacgaagagctgatgactctggaacggggcgtagcagcgttaggggagaaaatgagatgcggatctgagaaaacggcgaagctgatcggtggaactgaggggcgggtttaccagctgaccaggcggcagcggacaggagggaaggagagaacgcgggagagggcgagatgaggaagggtcgctcttgcagaaacttcagaacaggagagggaaggggttggaagtgatgatgacagcaaaaccctttccaaaatggacggaagaaaatctgatgttaaaaatgcgcgtggtctgccgggagcgtctgctggggcgttcgctctggaagattcttcacggtttctcacacgggtagatgcgtgcttgtaatgcagcccagtggccacactcctttatcccggagactcggaatgcgcgtccacacacagacctgcacgtcatgctccctagcagcttaactcaccatagcccaaaccagaaggacgccccccaccggctgtccttcagtgggtgagtggccaggcaaatgctggccacctccctcggtgtcctcctcagcaacaggcatgaacgctgggtccctgccacaccctgggtgatctcggcagcatgatggcgagtgaagaagctggtttcaaggggtgcacactgtatgatctcttcatccccaggtgataggattagcgtgacggaaacagtggcccggggtgtaggtgggggggccgccggcaggccggtgtctggaatcggcacatgggcacgttggcacgtcacgtgggcatgtccacacgcatgcaaggggctgtgggtgaactgcccgtggtgcacacctgagggagttgtgtggcaccagctcggtttggacagtgccctttgttaggtacggttttctcattgggaagctggatttgtattaaagatgcacacgtaagaataaaaaagaggctcgtagaaaacttttggtgtcgtaaacaatactcaaacagttttgccaacaaattggaaagctaaggcaaaacagatgtttttctaaaattgcagtaatcccaaactgccttgacaggttcatataaaatgcagatcagtggttggggtggggccggcgtgggccctggcatgagacagacttcctgctccccacccaggctgcacagcccagggcagagaaaggacaacataaatacacagaaaactgccccaggggatgcagctggattcttggaagagacgagagtgttgggaaccgtcctggcatcctggaggggcctgaagcagcccctaaccagaagcagagccggcgccacagaaaggagcccccaagaactaggagagcttgaaattaaaaacatgagtgaaaatctcataaaaacaggaagctcaaagacacagggacattgcagaagccagagaggtgaagagaagccgtgacctcccggggctgtgtgtggagtctgcaggggctgcctggatgccgagtccacgtttcgcagtgtgtggtcctgtgggaggacttggctgcccacgctttcttgccactaggggtggccaaaggattgagctccagaacagaggggagcagggcctctccctgccgtcccctcctcgtccctgctggctggaacccggggtagccaccttggactgtgaggggagccacgtgctgggaaccgtggagcaacaaggcaggaggcagggaccctcgtggctgtggagagggcagcggggccgcaggctccctgtctccaggctttggcgtgggaggaaactgaacacctgctttgtgtgccactgttagtcaggaattctgcctcctggggcagaaacttcccgcatagctggttggaggtcgccgccgtctgagtgccgtggagggagagaacgtgataccgtcagtgcggtcacaggaggagcgggaagaatgtcggggcctgggaggcgccccagtgttcaggttcaggactaggattttactgataccacgggtgggggatgtcacccaccgggacacaagactcagcccagccccactcgcctgctttggaatttccacaggagaagggttttcagcccagcactgcacatctgatcaaactgctgagcaagaaaaaggaagccctggagcctggaggctgcgtccggtgtgggctgcggggcctggagcggcagggcggctccgggagggcacaggacgcagtggcctgcgaggacctgcagccagctggacagttgcactcctgcaagacaagcatctccacgccttgggggtggggaggccaccagaaagctccgccagacagaggtgctggggctgtgcaggaaacgaagtgattagaaatcccggaaaaacacacaagcaggcgttgtcatggtgactgggaaaaacacacaagctggcgttgtcatggtaatggagtgtaggacaggcctggagcccctcggtctcttgctggcggctggcacagagacgggctgccgtgggctctgaccttaataccgggtcacagtcgcttctaggaccaagaggacagagaccccatcaccgtatgcaggggcctgtttccaggcagactgcccagtgcccagctgagcctcgggtgcagtgcgacccccgcagggcatgtccagaccccaggaccccctctcaggtctagaagatccagttgggcagtgttggtaccaccaagagtagacaggacagaggatcagagacaatcccacccagcaggacccaaggactcaggcagtggcttttcaggtgtgtgggccgaggactggggagtcggtgaattctggggcccctggggtggccgttcaggaactgcagcagctccccccaccacagatgctcgctgcctactgaagcggccacgtgtttgaatgaagagcagttagaggaacgcttgcaagagaatgtgtttattacctgaggttatgacaatacagaacatacaatgttttctgtggaaaatgtgatactacagaggaaaaggtcactttaattaaatggcaattagaagtaacagcattgcaaggtggggtgcagcagctcacgcttataatcccagcactttaggaggctgaggcgggtggatcacttgaggtcaggagttcaagaccagcctgggcaacatggtgaaacctcgtctctactaaaaatatagaaattagccacgcgtggtggtgcgcgcctgtagtccaagatactcaggaggctgaggcaggagaacctcttgaccctaagaggcagaggttgcagtgagccaagatcgtgtcactgcactccagcctgggcaacagagcaagactctgtctcaaaaaggaaaaaaagaaagaatgacatagcaaaataaatttaaaaaataaaaacgggagaggtaggggttgggtattttcaatttgtgtgccagcctaagggtgaatgtctgataacactcagagctggtgcaggggctgtgcctgtcatcccagcgtatccagaggccaaggccagaggatcgcttcagcctaggaggtcaaggctgcagcgagtcatgattacaccactgcagtccagcgaggtcctgtctgtaaaataagtaaatgaaaaagtttatatattcaaagactcctcccaatcagtagaaacagaaaaatcctgacagaaaatggatgagggcggtggcgtttggtacagacagagcggtgtatgagaaccggggtgcgcctcccgggttctcacaggtgcagcaggcaccgccggtaacccctggcctggcctgcgctgagccctgcaccagccgtgctgagggagcctgggcctggcccttcatgtgggatagaaacggccgtgccggtctcgatggtgctttggcagtttctctggaaatctgaaacctgcggtcttcagcccagccccaccctgggcctgcatgtggctgcgtgtcgtagagaaacatctgccctgatggtgacctgatgtgagcagcagtttcacagagtaagccacccctgtgcacgaggtctggaaaggtaagtgcgacgtcgagtcctgagcacagaagcaggtggcagaactgcatggcaggaggtgggcttggcgggccccttcctgacccccaagagccagctgccaccaggagcgtcctggggtctgtttccagcccggtggcagccgagcttcctgggcacccagctttccccagcctgctctgagcactggagttgagggcactgagcagagtggggctgagcccctggcggtggaggggacacatcagtgggtgttggcttgaggtggtttctgggaggctgctgggccccgatctaaagggacacacctggctgcacccacctcctgcagactttctccgtgggagaccaatgcaacaggcggggtggagcagccacgtggcagccacgagggggaaaggaaggtagaccctgaggctgacgagccgctgtggcaccctggcctgtggacctgtggatgacgtggccgccacgtggtaaagcgcacatgctagcagctctggccctgcagctgagcacaggccaacctggtacgtggtggaggtcggggcatggggtgccccagccatgttcagattcctgtagtgagaatgctttcacctaatactatgttgttaaacctgtattcagtagggaaaagggcaaggacctgaaaaaagtgtattaagaatcgtgcacaggcaagtgatgaaagcctcgtcggggaggcagcttgcgcttcacagctcagctgggtgggcgcgcccggagcccaaaggagggcccttggccggcgcatgcttcggcttctccgaacttacctagatgagatagattttcatcacggaagagccgatgcgggaagcaaccttaaggctgcgcggatgaatattcgtcatattcatgtgaatctgatcgctgtctcctccgaatgtgcgggaggtgacgtgccgcggttcagaatcgacttttcgaggcccgtggccagtgctccgggtgaaagcaggctgttgcctgcgtacacacaagcctgtgtggtgtgggtctgtccagcctgtccatgccgagcctctgcacacacactgtggaagtggcccctgcacatccagctgcccaggccagccccccgggctcacgtctggcaccaggcctgtccctgaccccagggcccatctcccactgcgcctctgcccaccgctcgcatgcgcagcccctcctgcccacagtgggtgccgacgaagcttcatctgcaggtgactctctcttagctgcggctgctttgccaggctgcccgaagcacctccttggtgtgtgggcgcccatctccagtccacgcagcgcaggggtcttcctggccgcaccgctcgcctccaccacagctgtgcaccagtcgcccactgctggcctctgcctgcccatgctgtccttgtggcctcaccccgtccacactacgtctggtcaagtgtggtacaccagggttcaccccgtccacactgcatctggtgcaccaggggtcaccccgtccacactgcgtctggtgcaccaggggtctgcatgcatgcagcctcaaagccctcccaggaggcccggggcagccatcagccctgtccatgaactgatgagtgttacacacacctgttcctctgtggtccgggtagatgcctccctgcctcctgcagccgaggtgctccaaccttcccttcttcctggagaatgcccaggctagcccagggctcccctcccctgctgcccagcctctgctgtggccctggtctgtgtggtcctccatggtcctctcctctaggtcccctgcggtgggcaggagggaagggaggctgtgccagcctcaaagggaatcatctgttctggctaagctggaggtccgggcactgtaggagaaggggttgcagctgggtggtgagcgtcttcctgggggctgccctcaccctgcccacgtatgcctgcccaacaccagctgctctgcccaggacccaggcagggtcagctcccacaggacgccctgcggtccagcaacccaggcactgccgcccgggatccacaggctccatgctcggcaggaagggagggaaagacgccacctaggccccggcaacctctgtgctgagcctgcgccattgatccgtcaggagtacctggggccccgctggacaggtggtgggtgggagtcatgtccacatgggaggctcactggtgtctccggggactcggacatgcccatgtggacgaggcctgcatgtcctggtgtcctcagccacggctgttcgcacagagcatctctgcacccgtgggtgggcgttgtcatgcacgggagtgtgggatggacgtgtgcgggtggatgtgtttgggtgtgggtggatgcgcaggtggtgcacacacatccccaccctgtgcccagtgctgcacctggttcttcggcctagggcacttcctccacctgtgtgcctctgcaccccacactgcccctgccctccctgggctgggggtaactgggagcccttggcagggtggggttggccgtgaccacagcgatgccatgtactggctgagtggaggcgccagggttgggctgctgtgctgtgtgccaggtctgtgttcgcgggagctgttccggtctaagagttgtcatggacactgaaattaaaaacgtgactgttgtgaacactgctcagacccaagcctcgccagccaggggcagcatttctgggcaggttcttgggcgacacgggggcagtgcatgctcctgtggatgtatccttacggctgggtggcgtctgcctgcctccgccgacgtgcttgtgtgccgcggggacttaccactttctacctgcatccccgggcctgcaggtctcaggttccctggccgccccacccagctgcacctgctcagtgtccttcctgggtgtggccgcacccccctcctgtgtcctcgccaggcgggaccccgtttcttccacaaggctgagcagagtctcggtggggcgcacgctcaaaaggagacatctcagccaccacagtggggagcgggcaactctgaccagtgccggcctgcagcctacatgcggctgaggaggctgcggtgggaattgctgggactcaggacgcctgggcagaggttgaggggctgcgcgtggcggggaagccttcatgtagcctctcccagtgtccgggctggtgcttggggaacaagcctgagggccacaggctaatttcccagccggggcagccccacccccgaaggccaagcccgagggtcttcaggttccgggctgagcctgtgtgctttctcgctgcaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggtaggccggctccgagttctctcctgtgcccattcatgcaagctccgtcccgtcttgcttcgtccatggaggcttcactgccacactgaggaccccgttgcacattgcctggtgtggctggcggtggttcgtggtcccgtctggggccggcatgaggttgcagccattcagttcctcacagagcctcatctcagggcacttcctctcttttgggcagcaggaaatccagctgtggcttcacacaggtctgcatgcatgtctggctggtgccccttgcttgggtactgggaccctgggggtgagggcagggccgtcagtgtatggctgtaatagggctcataggtctctgtcccgagacacagcgggaacagcagcgtgttgcaacccagtacgtgtgcactcagcacacagaacacacacgtctgcacctgtgcactcagcacatggatcacgcacactcagcacacagaacacacacggaacacgcacatctgcatccgtgcatgtgcactcagcacatggaacacgcacactcatctgcacccgtgcacatgcagttagcacacggatcttgcacactcatctgcacccgtgcacatgcactcagcacacggatcacgcacactcagcacacagaacacgcacatctgcagccgtgcatgtgcactcagcacatggaacacgcacactcatctgcacccgtgcacatgcactcagcacacggatcctgcacactcatctgcacccgtgcacacgcactcagcacacggatcacgcacactcagtacacagaacacacacagaacacgcacatctgcagccgtgcatgtgcactcagcacatggaacacgcacactcatctgcacccgtgcacatgcactcagcacacggatcacgcacactcatctgcacctgtgcacacgcactcagcacatggatcacatgctcatcacacagaacacatgcacctctgcttgtgcactcagcatatggaacactcatggaacacgcacgtctgcacccgtgcacctacacgcacatggaacatgcacatgtgtctgcatccatgtacagacactcattagaacaaacttggggcggtgcttggccgtcctgcttggagcgcactttctgttttctgccaggctcggtctgttttttctcctcctctcgatgctggtaacaggcgaggttgtaccctgcccttgcccacagttggccagcgcctcacggttttgcttcccttttcctaggatacagtttatggcattgcaaagttggaaccgtctgtgttcctgcgggggacgcaggtggtgtcggaagccatgcctccatctgggggtctcctgcactggcttcagctgcttccgccggcgcccatgggccaaacctgtgtgccagcctcctcccgcctttgtctctgtggtggcgtcccaggaagggccggctgcggtgtcgggtgcaggcctgggtgtgtggtgtcgggtgcatgcctggtgctttttgaggggtccctgctgtttaccatctctgttacccgtggagtttcccaggcctgggctctgttcttcagccagggatggtctggggcacccctgggatctggcccaccctcaggaggtctttgttccaatctcgtgtggcgcctggcttggctctccctcagtctcccttgtttaacatttttacgtccaagtgagttgtgtctaggggctatgcagcccctgcctgcgccgccccacgtcaggccctctcccggcccccgggaccccttgcggaaccacacggtcctgtccagcttccgggcctatgaatgcagccctgtcctggcctcctgccccctcctcctccccagggagacggatggccagtcggacacaggaatgcaatcatccggatggggtgggaagtgccgtgcaggggcggccctggccagggacaaggcagggatgagggtaaataggctcagggaggggcactggctggggaagggcctgtctctggggacaaggccgggagcggggagtaggggtcacacatgggcgtgcctggccactcgggagaaatgggatggacttgctttccaggaatggctccagcttcagtgttaccgactgcaggggtggggcatggagggcggaaggggcttcggggcccggctgggcctgggggaggcctgaggacatgtgcggatgtccacgtaggggtgtgcaggcggggccggcacccagattctgacctggccacagcctcccagcagggtacccccgagaggaatcggggtggcgaggtgacgcggggagacacgtgcttgtctcttcctgggctgccagcgctgagtcgggaggggtcagggcagcgtctcacaccccagccctaccacacaccgagcagttgccgtgtgtgtgctgccacgtgaacctaaagtggaggtggggctcctggagttgctctgttgcgcccgacctgtgagcaacgtgttcatctcgtggcctcccggggtggccttggggacacggcctttggcttcttccttgggaagcttcaaacccgctccagtcacggcggccccggtgtcctcccggaggctgggcccggcccgggggtgaccgccgtgtccttgtccccacaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtgcgtcggccgcagctccacgcctgtgtccctccctgtgtctggcgctgccgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacacagataacacacggatgtcacagtacacagcctcacacagaaatcagagcacacatgtgggcctcacacagacatcatggcacacacagacatcacacaccgatgtcacagtacacatactggcctgcacggatgtcatagatgccacagcacacatgtgggcctcacagacatcacagtatacatgacctcacgggcgcacacagaaatcacacatggacatcacagcacagacgtggacctcacgggcacacacagataacacagatgtcacagcacacagcctcacacagatatcacaacacacccatgggtctcacactggcctgcacggacgtcacagcacacagggcctgcacagatgtcacacacaacaccacagcacacatacaggcctcacacaagacatcgtggcacacacagacatcacacacggatgtcacagcacacacgtgggcctcacgggcttgcacggatgtcacacgccacagcacacgtgggcctcacagacatcacacacggacatcacagcacacacaggcctcatgggcacgcacagataacacacagatgtcacagtacacacagcctcacacagcacacatgggtctcacacaggcctgcatagacatcacacggacatcacagcacacacgtggaccccacacagacatcacacatggacatcgcagcacacacatgggccgcacggggacatacagatgtcacagcacacacacacgggtatcacatggcacacatgggcaccacacatggatatcacaccatacacatgacctcacatggacacacattgatgtcagtcatgggcacgtacgcagatagataccggcatatgtgtgggcacgcacatcaaccacggtctagcacgtgctcgccccttgagtcccctggagctggctgtgtagatcctgctggggccggggttcgggcagccgtgggcttcctccgtggtcaccagcagctgcccctggcgctggccctatccccggggagtggtttgcctttcagcgacccctcgctcttcatttgcccactcgctttgcagccgcctatcctgggcccagcactgtcctgggtccggcatgcagcggtgaaccggccccacacagccaggcccaggttgagctcagagcggcaagcgtgtgcatgtttgtgcacgtgtgtgtgtgcgtgtgtgagatcctgggagtagagccatgtcttaagggaaagtagagctgggagaggccaggtgaggggccccgtgagggagggggagcatctgggcggggcccaggtgtggggtgggaaggtgctccctgagagggtgggcgggggtggtgtaccttttctgaagactccctggacaccttggcccagctgcctgtctccccagatcgcgggttcctcaggaggccccatggggatgcaagggccttgccatgccagggactccccttgaccggccggccccccgcttcccaaacatccaggcagcccactcctgctgaccgctgtccttgtcccgccagcgtttggggaatcggacgtttcgggtggtctcggtgaggcggccacacctaggttagtgggagaggttggttcacggatgtgcatggaacacgtgcctgtctcttcctggacacgtctctcacggtcttgctggtgcccccaccaggaccccagggctggctggagcctgtgaggatcccagagccctgaggtgcctgttcctcacacctctgcccatctgaggcctgggcggcccctcctatgtcagggccatggcccgcatgtgtggtttgttgaggggaggagggagggtgggcaggaagcccaggttggggcagaggtcgggaggggccggggactcggggctctgtggaccttcagattcgtggactgcctgctggccttgtccaggggcggtgcctccgctgtctccagagcaagcccacaggacaggaggcgcctcatgtgtgccttgcctgcaggtcaccgcctgtcctgcagccacaggtctgacacctcacctgaggtgtacgagggactgtgggatgtggggggggtatgggctgtgtctgtgtggccagggatgtctgtagttcccctggtaagagtaggtgggtgtgttgcccccagagtcatgtgtcctgtctctcctggggtcggggtctgtggtcccggccctgaaggccccgggctcttcccgtggccactctatgaggcctgagggcggcgccttcccaggctgattgtggagctgggcccaaccagcccctcccagggccccgtgctgagtgggggttggaacacccaggtcgggatgccctcagagggtagggctgtggccaccccgttcgttaaggaccccacctgccagggcccccgcccaggcctggcctgaggagtgtgggtggggactgcaggtgcggggaccccggcgtcctggggagtgcagggtggacctggcaggttgtgggggtttaccatgggcgttctgccctgcactggcccaggtcgtcctgtgggctctcgggcaggcccccctggagctgctggggggcagctgcttccctcgctctcggcgcgggcccctctgtctgtggtgatcttgtgatgaaccaggccaggtcagcgctccctcggcctcgggagctgaggagagcagttctgtccttagggacacgagccccctgacgctgcagcctctaccttgtggacgggacccctaccccaccccggctgcccacctggcacccttgactgcagaacacctgcgtcccgtcccccgccccgcccctcgcccttgtccctgagccccatcccaccctctgtggaagagcctcatgctccaggcggggccggtgctgggcaccagccactcaggctctcccagggtgtgcatgtccccatctgccctctgctgtgcacacactgtctgggttgttcttagcgtggaatccgcgtgtgtggtggctacaggaatgtggaagccctgggcagcgtgtggctcacggtgttggtgccactcggcgcagactagggggcggccgcttcctctgctctacgaggctctggtgcccgtgacttacatctccttcttgtttctttctttcctccctccttcccttccttccttccttctgaaaaatgcactgtcttaggtgcacacaggaaaacattgtacacattcaccccatgaacccgccagcacgttgacagagcaggctcctgcacacagacagctccctcgggcccccttctcccgtggcggccccgcgacgaccctgcgaggacccgggtcccgcttcctagagcagagggccttccccagctgtgccgaggtgggatcacgggcacgcagccttctgtgtccgcctcccgtcagtcggggtgatgcctctgggtctcacctgtgttttcatacgacccagcagtttctgataacggttccatcacgtgaacacagcacgatttgcttctccagactcttggtgatgcattttgtaagtttttggctaatattacaaacaaaacttgtgtgaacacatttctgcccgtcttttttgtgcacatagactcacgtctcttgggtttgtacctaggagtggaatttctgagtcccagagcaggacattgtttcgcctggaaggagtcgctgttcttcaggcaggggcgcggcgtcatgctctggcagccgcgtatccttgccagcactctgtgtaattctagcccttccagcaggtattttgtgatattttaattttaacctatagtttcctgataagtgaggaggctgagcacctctttgtgcccttggccactcggagcacctccggccgtctttttcgtgttggttacgaagccctcacgtggtctgcgtcaggttcttgtcagatcgacatgcattgtggatattttcataatttcaaaatttttgttttttcttgtttacgaatatctcaggccgtggcttgacttttcactttcttgacctctctctgtgacgagaacacgttttcagtttttatgaagcccagcgtatcacccgttttttaggtgaataccttttgtgtcctgaggaatctgtttaccccagggtcatccgggtaacaggttctctgtgttttcttctggaagcttctacctctaggtccagggtctcctgggctgccactcacacgtggtgtgaggctggggtggtggcccaccctttcccgggatggcaggtcgctgcggcacgatgcgccgaggagccctccttccggttggcttggctcctctgtggaaaggcagttggccacatgtgagtgggtccgtctggactcttctgttccgtggacctgtttttcttccctttcctcccatgtgacgctgtctgcacggctgtgagccttgagatcctccaccatgttcttgacgagggtcttggctgttttaggtcctgctgtgcatttccatttccattctggaatcagctcatcaattttcattttgttgagtccttaaaatcagttttgggaatgctgacttcctaataatattgaaccttcgggacataaatatgatctctccatttattttaacttttcttaacggtgtttcgtcgttatcagtagaaggtttccacgtagttcattaagtttattgttaggcatttggcatttgtaatgctgttataaatgtttaattctttttttctttttttttttttggagacagtcttgctctgtcgcccaggctggagtacagtggcgtgatttcggcacactgcaatctctgcccctttttttttttttttttgagacagagtcacactctcttgccaggctggagtacagtggcatgatctcggctcactgcaacctccacttcctgggttcaagcaattctcctgcctcagcctcctgagtagctgggattacaggcacacgccaccatgcctggctaatttttgtatttttagtagagacaagtttttgccatgttggccaggctcgaactcctgacttcaagtgatccacccatcttggcctcccgaagtgttgggattacaggcatgagccactgtgcccggcctaattgtttcttgacggttggttattagtaggtagaaatacacttgagttttgtaaaccaacctcatatcccacagcgttctaaattctccatgttaggccgggtgcagtggcttgtgcctgttatcctagtgcgttatgaggccgaggccggaggatcaccaggagttagaaaccagcctggatggcgtaatgagacctgcctctgccaaaaacagattctcttgaattttctcttgcacacactgctgtgtcatctgcagataaacacagatttacattttcctttctgatctctgtaccttttatttctttaatttctttatttttgcctttttgcattagctacaatcatcagcagcagtgagtgtgggtgttaccgtgttgatgtgggagaaaaagtttctgacatttcaccattaagtaggacgtttcctgttggtctttttgtggtctaattaattggtctgatgttgaggcagccatcccagctcttttgatcagtgtttgtgtggtatgtcttttttcatccttttaattttagcttatctctgttcttatattcattcattcagagacaaggtcttgctctgtcactcgggctggagtgtggtggtgcggtcacggctcactgcagccttgagcactggggctcaagagatcctcttgccttagcctccgaagtagttaggactataggtgcgtgccactgcaatttttttaaattaattgttattattattattattattttttggtagagacaaagtcttgctgtgttgctcaggatggtctagaactcctgggctcaagtggtcaccctgccttggcctcccaaagtgctgggattacgggtgtgagccacggcgcctgacttctgtcttttatgtttaaagtgtgtctgttattaatagtatagagttagttcctctttcttttttcagtctgacagtctttgcctcttgagtgttcagttcatttatttttagtgtaattgctgatgatttggatttcggtgtcatctggctacgtgttttctgttcatccttgtttttcctttctggccttcttttatattaatcaggtgttaaatgattccttgcatctgttgttgctttttaacctatactctgcttagtgatcgtgtttagttttactttagagattaggatacgccttcataactcactgccacccagcataacctgtgaagactcgtccagggcggccagaggcccgcggtggctcctctcaccctcgggccgattttccacgtctattatgcagaaaaccgtacaagaagctattagtcatgagtctgtcaaggaatttttcagtaatttttcttttgaatatcaaccgacacatccaccctttctgccttgtttacgccccccgattctggctgtcctcgggcgtcacgttcctgtagcctaaagactgtcttagaaatgtggctcaccagtgaccgattccttttgcttttctttgtccgaaaatgtgttgccttttttttttttgtggaaggtagtctcgctctgtcgcccagtctggagtgcagtggcgcgatctcggctcactgcagcctctgcttcccaggttcacgccattctcctgcctcagcctcccgagtagcttggactacaggcgcccgccaccacgtccggctaatttttgtatttttagtagagacggggtttcaccatgttggccaggctggtctcgaactcctgaccttgtgatccgcccacctcagcctcccagagtgctgggattacaggcgtcagccaccaaggcctgttctttaaaatttattttttaaattcttttctctctgcttctgtttggatgccatctgctgactttgagcccctcccttcaagctcccgatccttttcttgcagttagctttgtccagggagttccgtttcagagggatgttttcgttctggaatttctatgtggttctttatagagttaccattcatcttccggaagcctccatttttctgctgtttacatccacacttgttgtcatctctgagcatgtttatagtagttattaagaggttttgctggctgattccagcctcggtcatctgtgcgtctgtccgcttccagtgttttgttctaattagaaactacatcctcctgtctcttcacctgcatcatcataatttcttatcctaagccagacatcatgtggaagagaatggcagagacagaagtgaagaatggtctcgccccgaacagccgctgctctcccgtgtcaggcgtggccggcgccggcccgcggctttagctggttttcgccaccggcagcccgacttccggggctttgtgttgtgcgcagtgggaaacagcgtgtcgtccgccttctgcgctgtgggagacgcctttctctgtgtctgcctgtgttctcttcctccccatttggtgggatccctggcagggggcgttgacagacgggctgttctgcacctggggagctgcccgggtactccggccgtggctgcaaccctcagaactgctgctcccacctccgcctgccgagccctcctccctcctgcagcagcctcgtccctggggatggaaggagccaccatgttccttctcgtagaacaggcgcctccctttctaggatgtagtgcgtttagacggtcctcagctcttctgactggcctcccagcctcccccagtcctcttcccagagtgactgggggtcccctgggcgtttgggccacgtccggccaccctgtgtgcctggcggtctggtctccttggccctcaggccgccgcgggcccctcgcacgtgttgttccagctctctggctcccttcctgtccccttatgtctccagcaagcttggtcttctcagggaggcctgccctggctgccgcctttgaaactgcgcccacttcccacccgccccggcgctcaacctgcttccttcctgtgtagcggttccctctgaggcaatgcaggagacaccacgttcgcgggcttggggtcctgtgtcctttgcagccatgctgttggctcacagtgggcacgagcactctgcagacccttccccgaggaggagccggccccagccagacacggtggctcaagctccacggctcctgtgctgggacccgtgccagccttggactgctggggtgggggcaggcacgtctgcctgggatggctttctctgccgctccactcgaaggggtcaggacctgagcccagcggggcctccctggtctggaagtttccctcctgccccctttgccgtctccacgtagtggtggctggaattgagatgccggaaacattgatgggtggatcgaaaggccagcggaggggcctgggcacggaggacatgtgttgggtgggtggagacccactgaccagtccgtttgacactgagtggttcatgtcacgtcctgtggacaggctgcaggggagtggtgtggctggcagctggtgtgggccgaggggctagtgtaccctttccacccctgtgcatctcctccgccttggcagtgggcgcgttggagcggacgtggagcgctcgtgtggagcgtgcgtgggcaccttggcttgaccacagctggtgtcatccttggcagatggtcaaactgaggcacagaggccactccgaccctggctttcggggccggcctcccggccacgggtgagcaagggtctcacactgtgtcttgacgccaccaggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcaggtgcgtggagccggggacacaggactctacttctgcggggcaggtacaggtgggggtgtcaggcaggtccctcccagcagccatctgcacctgggcaagaccctgccttcagcgagccacatggcggcggctgccagccctgctgggggaagccctgtctgcccagacagcgttttctgtgttctgagttctactcaggacatctaaaatactctctggacaagacagaacctcatacctttgaacaccaaattcccctgaagcccttgctgttgtcacagtggggacagatgcagctacctgggggcgttgggtcggcccttgtgacttccgtgctgccaggttcaggtttcacatctgcagctggaacgggctgtgctcaggtcggcctctgacatctgcagctggaaagggctgtgctcaggtcggcctctgacatctgcagctggaacgggctgtgctcaggtcggcctctgcctcagcacagctcgcagtgcagcctcagccctgcgttccccttgagtgggtggagctggggatggctgcctcccgctggctccaggcccttcagagagtcatcgtgtgtgcacagtgatgtgtatgtgtgtgggcaagtgtgcgtgggtgcatgtgtctgcatgtttgtatgagcttgtatgtatgtgcatgtgtgtacacacgtgtcagaggccacccgcccactctagctgccccagcagcctgtagccacaaggaggatgaggccaggttcccgctgccccttcctttgttcacagagtcagtgggtttggagccttctaggggacagggtgtggcacgtggatgctggtcagagccctgccgtccctgaggaccttgggtgtgaggctttaatgggcagcagtgcaccaaagaaaagccaccgtgacctgcccagctgtcagccaagcaccgtggctgggtggacttcttggaatgaaatgggggggctgcaggaaagccctggccacgaagccgagggagagccacccgcagggctttttgcaaaagtgcatgaaaagcgagcctgttccgaagacggaggctctgctgcaggccccgctggggttggagtcaaagaccacgcctcagaacagacggccctgggctttgccgtcccagggagtcccacctcgtgggctgaggccctgcgtgggggaggctgggctggaggggacccagaaaaggggtaccacagggggaccaagccaggagcccccgcccagtcctcagctcagggcttgggcaggagggtggagctctctaggagctgtggggccgtgcaggtccatacagggcagatcctcagccagcctgtcagggccgcggtgcagcacgcccgaggccttcagtcctagcgccgtggtgagcccagggtggggctgggaaggggctagggagctgggccttcccaacggcgtgcgtgaccaccttgcttccctggctgcccgccctgtgcggatccctgactgggcctggcctgtccttatgtcttctagatgagacaaggggccttcctggtgaacacagcccggggtggcctggtggatgagaaggcgctggcccaggccctgaaggagggccggatccgcggcgcggccctggatgtgcacgagtcggaacccttcaggtgcccccacggccagtgccgcccccctgctcttccctgtccaccatcctgccggccttgacctccagacggcgcctctgccaggccggacacttgcctgtactcaggcctctcgctggccagcagtgggggagtttgccgcccgctgcggggtgaggatggagccacgggctctaggcctgccttgcctcggtcctgtgaggggctgctcaacctcctcagcccttctttgggcagggctcctgaccaaccaggagagagtgaggccccagtgtctgtgagtggtccccatgggccctggccatggagtcatggcatcccgtccagacctgcagcccctacagcaccttgggaccccaggcagccctgggttggatgttcagccgcaagaggagacacccccacaggggcagtatcagcctgcagctcctggggctacagaccctttggctggaaggggccaggcagcatgtccccccatcagggctcctcccacgagggacttggagattaaatcccttgggctcccacacccgccgctgtcaggagcccctggtgtgtctgatggtcccggggctgtgctcttgagctcagccagcctgccgagcagagcggggccgtggggtctgtggttcccaggcagggccccccacagggggttccagtgcccagccacctcccctccgtacccagccacagcactcaggctgcactgaccatgcctgtgctgttcccagctttagccagggccctctgaaggatgcacccaacctcatctgcaccccccatgctgcatggtacagcgagcaggcatccatcgagatgcgagaggaggcggcacgggagatccgcagagccatcacaggtgggcgtgggggccgctcggtcaggcctgggggtcccttcctgccagccccagatgctcatgggctcgcatccgcctggcagccaggcccatgttctgccagctcagggcccgtggtgctctcactgcacccccagcagggacctctaaggccaaagtcaagttgagccctggcgtcgtgtcttacacacaggacctgctgggaagttgctgggctgagcagacaggtccctcagcaagctgggcacgtgctctgggctgggggtccccacgctgcaagggtgccagtgcccagagagacaggaccctgccgtgccttgggagccccggggctgagagggaggagcacactgccaagaatcctgctgcccgtgtcttcaacccagtgggccacgctcctggggccccctcagagccacagctgttccttcctcctgcatctcccaggccggatcccagacagcctgaagaactgtgtcaacaaggaccatctgacagccgccacccactgggccagcatggaccccgccgtcgtgcaccctgagctcaatggggctgcctataggtgagcaggcccgctggcccagaacagcctccaggagggccccaggcttcccctggatcccagcacagcccctggtgggaggggcggcgtctccactgactgacctggaggatctgggtagaattggtaaggccaacctcacctgaaaggcccatgagaaccagggcctcttggaaggagcctgggctggggtggccttcagggctcagtggacacaggagtgccatgggcacggggcctgtgggaggagggggctttgggtgaggcgaagacctcatgttcaagtcacctggagacaccagggctcccctccccagccctgagaagtagctgccataggcaggaacatccgtgtaaaggccgggatccttaccctgactgctggtcctcctggagaggccccctcggtgctgccgatgctaggagggcaggtggggcctggccaggccgcctacaggtgggcctcacggatggaccctctcccagcaggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagccagcgtgcccagcatctattctggtgactttctctcatgaggacacgggtgagcctcagtcctggctctggtgacctccacggctcagctcagcctctctgaagtgggcggcctaagagagacccagagacagtgcagtggcaggttgggcagtggtctctgtgtgtaccgggcctgtccctctgcccactgggtctgtgggacgctgtagggtcctggcttggaggcggcctgcccgcagtgccccagtgggagggaagcagtgtgccagccgggccgttgtgtggatgatggtgtgactggctgaggtcctgccccactgcccacccctcccttcttggcatagctcctgcaggccggcctgcaacctgggaagactgtgggccacaggaggaaggaaagcagatgtcagggctgaggaagctccccagaccatgggtcagccagcctacggaaatgggcaaaaaagccaaaaggggtcatgcctcaccttggcccacagctgagcctgtttaccggcgtcctcttcaaaatcccagcctcctggtttctcagagctgcttttggaagcgtggtccatgcaaatcagcagagtcccaactcatttatgagaaggggctgcagcgggtccaggcggtgcgaggaggggctgcagcgggtccaggtagtacgaggaggggctgcagcgggtgctggggaacccgggtcccctcgggatgtttccatcccaagcctttccctgcatgcaggtgggttatcctgccaccccaagtgtccagaccctgccgcgtcatccgccaagtgtcaacctccccttgctccctgccccatataaagcagaaagaagcggggggggctgctgcctttggtggggtgccccctcctacctggctctgcaccccagtgctcgcagaggtctcttgggtatgggcagtggctcccagtctcgaggcccacgccgaggacagccccacctcatgactgaggcctctgctccctgccctctccggaggtgagtggcagaggccgcccagcccatctctgacctgtcttgggctcttcaacttggagccccctgggccactgagggaggtggcctgggcagggtgggaagggtgggttctggacacggttaacaagccggccctggttttgctgacgtgggcacgggtgtgaggaggggcagccaaggtgacttcaagtgtctgggctgcaggctggagctgatgttttctgatatctctggtgggggctgcagaggtggcagtgggaagaccaggagttccgcgctgacggctgactccagcctctccacaggcaagccctgggctgggtcactgggccctggtcagcccccacggcagccgagggtggggctggcctctggcagggtgggccgccctcccagctccagctggagacaggccccgccctgagaggcagccagacactgggaactagctctggacacaggcctggaggctcccactcagctggcctcattgtttccatgtttccaagttgaagggtcggggcaggaatggaatgcctccaagggctgtctgtggtgtgagcctggcggccagggagccgggacgctgaagtgtaactgagtctgggatgtaagggacagaaagctgtcagaaaagtgctctgagcctcgaaacgaacctccccttggtgccacctccggggagtcaccccgcccagcaaggccccaggaggggtgcggggtagcaggaggtgggtggggggccctcagcctcggtttcctggcctgtgaaatcggcagcactgtttatctccctagaggctggtattaggctggaggttgtgccaaaacgcttaagacaagaacatgaaggaaggtttgcatgttggaagggaagagataagtctctggtatttgctgacaagcatctgtgtacaagacccaagaaaatcagccaaagcctg

SEQ ID NO: 15765 - DNA, 6421 bp, Human
gtcctagccacacatcttagccttctctatcattctttctctttcctgaaaagcaattcctgagtacccaaccagaaagaacctttgtccctcacacctggctgcattgatttctagatttgctgattgccaataacatattgaaatacaaactgctctctaattgtcttcttttttaaatggatggcttattttaattaatgagtaacttgtggatttggtgggcaaaaaccatggaatgttcccagtcaagggaagggtgacacagggagcaggccaccatgtctacaagggctgaggtggaggtggcataaagagagacaggaattcttaaccttgggtctttagagagattgtttgggagtgtatccctgatctgaagaggtatgtgtgtgtgtgtttgtgtgtctgtgtgtgtgtgtgtgtgtgagcacacatgcagaggagagtatttacagaggggagtactacaacttctgaataatctatttttaattgagtttttattgagataattatagattcacatctagttgtaagcaataatacatgcagctcccatatatcctttatgcagtttccaccactggtagcatcttgcagtgctatagtccaataacacaagcaggttattgacattgaatcaatccacctgtcttattcaagtttccccagttttttgtgtactcatgttgatgcacatgtgtgtttagttctattcaagtttatcaaatgtgaaggctcttgtactaaccatcagagtcacaacacacaacagctccatcaccaaaagtacctgtcctgtctcccatttataaccatactcactccattcctccagccctgtcctgatcctaaccattggcaacagctcatctctcctccatttctaaatttttgtcttttcaaaaatattacataaatggaagcctatagtatgtaacttttggagattggctttaaaaaaaaaacctcaacattactctctggagattcatcttagtggctgcatgtaccactagttagttcctttttattgctaagtaagtatcccatggtatagatgtatcaatttgtttaaccattcacctgttgaaggatatctgagctgattccagttttaggctatgacaaataaagcttttatgaacattcacatacaggtttgtatgtgaacagaagtttttatttctccgaaataaatgcccaagacttcaattgctgggtcatatggtagttgcacattttacataatccttaaaactcactatttaaaattgcttcccaactccacacttctgtattatgacataaagtttggttgctggaggagctatgactctgataataatccctgaattcaacctttttacttttaaaagtttttttgcctccttcaaaataatcttaagacatatgtatcatattatactttcagcaaaaatataagcttagtggaattttataggaaattgagacacagagaaattaacaacttgggtcatacagagaattaatgtcatggtctgaaacaaatcccaagacccttagagtgttaaagctatatttggtgacacattaatgggtcatgaaatcaactatgtcagccacaaccagaatgtttctacaaagatatagaccaaactagaatccaaaatatcactgggcattgcaaatagcaagagtatgtattatataatttttgttgcatttttatgtatatgtgtgcgtatccaattacctaaaattggatgatggttagaagtgctggaaaactctgttcttacagcttagctcttttcattgaaattcccagataattatcttgtaatttccctgtgcctaaaaaagtcttatagtagtcaaactagaatagaggtacaatttgtaattcttaattaatatcagaataaatgtgagttagaaagagatcttctcgccggtggggccggctgggactcgccgctcgcacgcccttgggcagcggcggggcgcctgctcttccttccgcttgcgctgtgagctgaggcggtgtatgtgcggcaataacatgtcaaccccgctgcccaccatcgtgcccgccgcccggaaggccaccactgaggtgattttcctgcatggattgggagatactgggcacggatgggcagaagcctttgcaggtatcagaagttcacatatcaaatatatctgcccgcatgcgcctgttaggcctgttaacattaaatatgaacatagctatgccttcatggtttgatattattgggctttcaccagattcacaggaggatgaatctgggattaaacaggcagcacaaaatataaaagctttgattgatcaagaagtgaagaatggcattccttctaacagaattattttgggagggttttctcagggaggagctttatctttatatactgcccttaccacgcaccagaaactggcaggtgtcactgcactcaattgctggcttccactttgggcttcctttccacagggtcctatcggtggtgctaatagagatatttctattctccagtgccacggggattgtgaccctttggttcccctgatgtttggttctcttacggttgaaaaactaaaaaacattggtgaatccagccaatgtgacctttaaaacctatgaaggtatgatgcacagttcgtgtcaacaggaaatgatgaatgtcaagcaattcattgataaactcctacctccaattgattgacgtcactaagaggccttgtgtagaagtacaccagcatcattgtagtagagtataaaccttttcccatgcccagtcttcaaatttctaatgttttgcagtgttaaaatgttttgcaaatacatgccaataacacagatcaaataatgtctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaagtatgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggttttatttttctgtaaacagctgaaagaataattagatcatattctagtatgttctgaaatatctttaagactgatcttaaaaactaacttctaagatgatttcactttcccatagcatagagtttactttgtatacatgtttgaaaccaactactgtaggagatgaggaatttattgtaattttttgctttactttcatctgccagtggacttatttgaaattttcactttagtcaaattattttttgtattagtttttcatgcaaacataaaaatagcaatcattttaaattgtcaaaatttccagattactggtaaaaattatttgaaaacaaacttatgggtaataaaggctagtcagaaccctacacataaaatgtagttaccatacagattaatatgtagcaaaaatgtatgcttgatatttctgaactgtgttaatttttctgctgtattccagctgaccaaaacaatattaagaatgcatctttataaatgggtgctaattgataatggaaataatttagtaatggaccttataggatgttaataatgaagccatatgtttatgtctggatttaaaaattttaaacaaccatttactatgtcatttttctttaccttggagaacataaactgttatttcacttctacaaatcagcaagatattatttatggcaagaaatattccgttgaaatattgtgctgtaacatgggaaaatgtaaatgtttttcatggtttctatcaatgtgaaataaaatttaattctgaaaaaaaagagatcttcttttatcagaaaattattaaaatgctatttgttgctttatggaactttactttcttcatcacttaaaacagacttcttacacagatccttccagattatagaaaaaagggaatactagccaatcatttgataaaattagcttaactttgataagtgatataatttggctgtgtccacacccaaatctcatcttgaattgtagctcccataatccctacggtcagaggtaattaaatgatgggggtggttttttcctgtgttgttctcatgatagtgaataagtctcatgacatctgatggtttataaagggcagattccctgcacacgctctcttgcctgccaccatataagacgtacctttgctcctccttcaccttctgccatgattttgaggcctctctagccatgtgggactgtgagtccattaaacctctttttctttataaattacccagtctcaagtatttcttcagagcagtatgaaatggactaatacaataacaaaacattacaagggcagtacaagcagttagatgctagaggacttccccaagtttacacatttagaaagtgttagggccaacacccaactccaaactttctgacacccaataatatggttttcctgaaactgtactctgactctttgtggggtattttcaaagcagcatattatggttaagttgattttgttataaacagactggatatgccagcactttcacataaggtttatttaaccgacaaccaagaagattacggaagccagactgactgtctacaaatactgggcagggctatcaggtgggaaagggataacattgtttctgccttacagcaaaggcagaattaaggtctaagtttggcagttagaagtagggaaactggttcaccagaaaaaaagacatttctaagtaagctgcccaggaatgaaagaactgcctaacacagtcttagactaatcaaatgaagtattcattaacttatgagaaaaccatgtattctggctgctggagacaaattctttcattggaccaaatgttctttaaggtcttttccaaatccaagttcctaggaatcaactgataaatgacttttccccattagtcatttatctctgcacattctgcccacataccacattttcttgcaatctgtttagagttgaagaaattatttctaattgaaacctttactaccatgattttatttcaagtagacataatttatcaaacactgagcttaagaaatatgcatttttttcctcatagcattttgagttgggtcataaactaattaattcatattgtggaatagattagaatggaatggaatggaatgtgaaattcagtattatcaatataaaatagagcctgcttgctcataatcctcaagaagtatgtagggacaggttggaatcaattgaaaattgcaatagagagaggaaaggtgatttgcccattcatggggacaataagtgattacatagctaatatatggttatacaactaatgagttctggacctgttaatattctttggtgactccttgaataaatattaaactttccacaagagactacacacaaaccgaaactactgacttctagtgagggcattttcaagaggttctagtccaaatgaaagttatttattatttatctaataaaactcacttctactttgcctactagtatgctattgaaatgttaaaaaaatagaagatgctctcttcttttcagagtgtttcttttggaaaaaaaggaggttgctttatagagagacatttctattctgaaagcaaagcattctaaaccatatgattttaccccatggacttaaattttaaatttctctacatagcatattgaagcctgtgccaagtgctgtctggaaaaattgagtataattaagacaatcaagtgattcagtccctacctttttacattgtactgtcaactaggaacaacatgtatgtttcttcttct

SEQ ID NO: 15766 - DNA, 31231 bp, Human
ggaacagtggctcatgcctgtaatcccagcactttgggaggccgaggtgggcggatcacctgaggtcaggagtttgagaccagcctggccaacatggtgaaaccgtgtctctactaaaaatacaaaaattagccagcatggtggcaggtgcctgtaatcccagctacttgggaggctcaggcaggagaatcgcttgaacccaggaggtggaggttgcagtgagccaagatcacaccactgcattccagcctgggcgacagaggaagactccatctaaaaaagaaaattaatgcaaaagaagacaatttgggggtcttttcaataattcagtggtaacacacagtatatggagagtttgtgtattgctccaattcccgagtttaaaaggtttaaggtctagttccatatagaagtcctgcagttctaatagactgtgttttgatgaaatatcctcagtaagttagtatgaggtatgcacaacatttctgctgaaatccttatcctgcctatcattttgcagtggacatccatggttcagtttgcctggcaatcctcccttctcataagaacatcatcgctcttcttttagggaactaacagatcctccccaaactccaatcaggtggtcctaatccaggttgccaatcgcagtgcttcaatcacaggagtaagcacaggtcctaggccaggccaatcacagctccttcttggattttccaatttgataaaatccaggctggctggataaaatccagagggagagtttactcccactcctagtgagagaacagctgccaaatttctagtcttatggagctggtgtctgacaaactgaagctgagatgcagaaaaaagctgagatgagagacggggacatcttggtggtggccaggtggctagtgccatatacatccctgcccaacctcattttggttaggtgagcaccagtcattcccatttattcttttaacaacaggaagtatttaatgagcatctactattatgagccaatcattgaagacacagtgatgactaagccttccagtgaacacaaaatatatattaatgtaaaaagtactgcaagttatggacatttggaacctaagtaggcaaaccatgacttaaatctcatttaggctgggcacagtggctacacctgtaatcccagcactttgggaggctgaggcgggagggtcacttcagcccaggagttgagaccagcctgggcaacatggtgaaacccccatctcaaaaaaatacaaaaattaactggtcttggttttgcagcctgtagtctcagctaatcgggaggctgaggccagaggacagctagagccccggaagtcgaggcagcagtgactgcagtaagctgagagcacaccactgcactccagcctgggcgacagagcgagacactgttaaaaaaattaaaaaaaaaaaaaaaagaaagaaagaaagaaaagaaaaaagaaaaaggaaaagaaaacttatttaattctcaacaaatcctgttaggaagctcagagagggtcagtaattattgcaagtttctagcgctaatatatagcggaaccaagacttgaacataggttttcgactcaacaattgttttaattactctgcgctgcgtaaactgagaaacctctgaatccttacaattttaaaagaacaacttacagttttcagtttccatcagattccaattttctaccaaattgcagccctgaggtatgaatggttaccaaactttagttaaacaaacaaaattagctcattaagtaacagagaaaccactctgcccagcctgcattttttttttttttttgtatgagtttgcctcctttatgcgcaaggctccttgggagttgtagtctgaggcatagtcctgtgggtggaggcgctgactcactgggacccaatcagcagagagtcaacttgctctccgcgcagcgattggctggaagtcagcggtctcccgcccgcggcgccatcgcgccattcctagttaaggcggcacagggccgaggcgtagtgtgggtgactcctccgttccttgggtcccgtcgtctgtgatactgcagtgcagccatggcagaaccgcagcccccgtccggcggcctcacggacgaggccgccctcagttgctgctccgacgcggaccccagtaccaaggtgggcacaggaccgaagggaacggctcccccagctccgctgggccgggaccgggccgcattctatccaaccccatcccgccgccgctgcaggtccgccggcctcgggcggacgggagtgtgatgggaagagggataatggtgtttgatggggcgatcgtggggcccgcgaagtgtggaggggatctgttgcctcagctagtttcaaagactgcgaccctgttttgaattggcttgtttatgttgcgacggtggctggaagccaggccaacccagggtcagctttcccaaatcagtcgccaaggcccacgagaacagtagtttcagaactcccagaaataggttcaaagatgcctgtcctgtaccagtcctgcccagcctcgtttttccttaccaccctgactgcagtcttaactcctgcaaactaatttgatcgctctaagtttaaccgcgcccagaatttcacttttgcttgcttggcctttgctgtgggtcacaacagcccttcttgccttcctcatcttcgtggggcccaggagagattacagaatcatagagtttggatctgaaaggaatcttagaaattccttctcttaccctctcgttttacagtaatgacccagtaagagaaatgacctgttgcatacaaaggctttcacttaccgaacatgtctttactgagtaagaatcagtgtaactcactcaggtgtggtgtttcggttgccttgttaagatcagacacagttggcgggcgcggtggctcacgcctgtaatcccagcactttgggaggccaaggcgggcggatcacgaggtcaagaggtagagaccatcctaacacggtgaaaccccgtctctactaaaaatacaaaaaaatgagctgggcgtggtggcgggtgcctgtagtcccagctactcgggaggctgaggcaggagaatggcatgaacccgggaggcggagcttgcagtgagctgagatcgtgccactgcactccagcctgggcgacagagtgagactctgtctaaaaaaaaaaaaaaaaaaaaattcaggcacagtaaccgctgtttattccagtgaagtcatcagtgtctgtaaacacctttgtatttatttatttgactacatcatttgtaaattccttgaagattgaatatgtgcttcgtgcagacctttaaaaggggtagataagtggtccatgactctggtccctgcttgttctttaccttcagggcaaagagtcagacacatctcattgctaaaacttttgactagcacctggtacttggcttaggaaaaatgttagtcattgcaaaattaagggggaaggtaaaaaaattccgtcatgcccatctcacttgtatatcccttaatattaatacctggttttttcatataatgtaaattgagtcactcagtgtaaagtattttcccagataactaggggttttatgtaatggggttttcaaataaaaaggattccagggatatctttataaaatatactaagtaaatgtccttgcagcttaatttacattccacagtatctaaatttctcttgatgattcggagtaattaattttgagatcagtaatttttggccatgggaataccacgtggagacataaaatggaatacataataatagctggtatatattgagtgtgccaggccctggcttggtattttaagtacattgtttaatttaatcctaacaacaaccctatgaagaaggcataattatgatcttcattttacaaataaggacactcaggcacatagaggtgttgagtgatttgcccagggaggaccccacacttccaacctccaccctgttctgcttctggggtgctgactccagcagtaattttggaatttgccataaaggaaaataaaaaacctcaatgaacgctgggtgcagtggctcatgcctgtaatcccagcactttgggagagcgaggtgggcagatcacctgaggttagcagttcgagaccagcctggccaacatggcaaaactctgctctactaaaaatacaaaaattagctgggcatggtggcgggcacctgtaatcccagctacttgggaggctgaggcaggaaaatcacttgaacccatgaggtggaggttgcagggagccgagatcatgccactgcattccagcttgggtgacagagtgagactttgtccaaaaaaaaaaaaaaaaaccctcaatgaattaaattcagtttgatcacttgatacatttatgctatatgtaaagaagatggtaagtactttggggatactgggataaacaagatgaggttccctcccttcaccaacttatatcaactctaatatacaatggacctggggttagtgtgctattgaaatataaatcaccctgagagcaccctgggaggtagaggtttttaaaggtagcattagtggaatggggtatgcacagggtatttggagcctgaagacctgcatttgaatccccacttctgttgttggctgcagtgaccttgccagggcacttgggctcagtttgtagaaggagcataaagatatctcagagagctgctatgaggataaaatgacatgtattatgttctctaaactatgaagagtgatacaattcaaggttgtatttcagctgtggggatcagggcacacatcaaaaagatggtggtgatgggcctatgccttgatagattgggtaggattccagcagagtacatgggaaggcattctgatgaaggaaacatcttagcaaaaatgtgttttgatacggggggaacccaccccaatatttcaacgtaggttctttctattttccataagtattggccagctgagaaataaagagtacaaagagaggaattttacagctgggctgccggggggtgacatcacatatcagtaggaccgtgatgcccacctgagtcttagaccagcaagtttttattaagggtttcaaaaggggagggggtgtaagaacagggagtaggtacaaagatcacatgcttcaaagggcaaaaagcagaactactaataagggtctaacaaagatcacaaggcaaagggcaaaagcagaactactgataagggtccaacaaagatcacaaggcaaagggcaaaagcagaactactgataagggtctatgttcagcagtgcacgtattgtcttgataaacatcttaaacaacagaaaacagggttcgagagtagagaagcggtctgaccacaaatttactagggtgaagttttttccccaccctagtaagcctgagggtactgcaggagacgagggcgtatctcagtccttatctcaacctcataagacagacattcccagagcgggcgtttatagacctccccccaggaatgcgttcctttcccagggtattaatattaatattccttgctaggaaaataatttagcaatatctctcctacttgcacgtccgtttataggctctctgcaagaagaaaaatatggctctttttgtccgacccctcaggcagtcagaccttatggttgtcttcccttgttccctaaaatcgctgtttttctgttgtttttcaaggtgcgccgatttcatattgttcaaacacagttttacaatcaatttgtacagttaacacaattatcgcagtggtcctgaggtgatgtacatcctcagcttacgaagataacaggattaagagattaaagacaggcataagaaattataaaagtattatttgggaactgataaatgtccatattaaaatgaaatcttcacaatttatgttcctctgccacagctccagctggtccctccattcggggtccctgacttcccacaacagttttaggatggtagaattgcaatgcagggcaggtactggagagttagttaaatgttattggttgcagttcaggttatctaagcagtggtggaagaggctaacatggtaggttggggccagattgtggagacagctttgagtgtcacatctaaggaagttagattttatatacatagtggggaatgagtcagggttttgaagtattctataaagtagattggagggatccaagtctggaggtgattaggccacttaaaaagctcttccagaaggtgagataagtgatatgagggtctcgtttgtaaagaagacagcagcaatggcacaaagtcgacttgttttttgatcatttgcatcttcattataaaggaagtccagagaatgtatggctatgtcacattttgggcaatctctctgggctaactttctttaaaaggtcagattctcctggcaacagagagagactccgtctcaaaaaaaaaaaaaaaaaaaaggtcaggttctccttccaagtagtgatctggagatcttttcttttttactatctgtatctgtctccactaatacagtagacaatgtcctcagtgttgccattatttctaccaccactgccaatgtccattttcacatcgttccatatataaatatatgaatatataaaaatataaaaaattaatatatattaatatataaatatatctataaatatatgaatatatatatatatgatggggtccctctccaatcaggtagattggtggaattgaatgcagtagaaaggagaatagggaatggaaaggaggaaggaagaaggacaatggccagataaatggctgactattcaaggcatagagaatcataatatatataaaggcataatgacatcagagaactgaggcagggacctacgggtaacacagtgaatgaagttataagcagtgggacttgagggaagggtgaccaaaacaatcattagggtactcaaagaaaagatgagaattcccattatattcatttgtttttctcaccctgtaatggttgctatttaagtgataagggtatgaaatagaaaatgtttgagatgaccggtttaggggagtggtgataaccgttggtgttagagaagtatgcagctacatatgtggttgcttttgggactgtctctcaaatgtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacctagtaataaagagttaacaaaccctttccccttttatgaaaatttgacttttcgttaactccctagtttcccagaaaacaatgaaaaattgtgtttgttgcttatggtaaaaataacccaattggtaaattgcatctggagagggagaattgtaaatacttgaaaggaagccatagctttggacttccctgattgtagtgactcttataactgtcccttgtggaaattctagaagttctgcctatggagttgctactagagatactggctcctgtggtacatggggccttctgccctagggtgattctcattcatatccagtgtgaatcttctccctgtacctgatctgtgtcgactcctgtaaggactcccactgaagaggaacacctgatacttctttgttggcaatctgtgttttcctaacagataccgttttgagtaaactggcaccatgtatggcctatggctatggttgtcttataagtctggatgtttagttgagccttaagaagactttctgggccaggcccggtggctcacgtctgtaatcccagcactttgggagaccaaggtgggtggatcatgaggtcaggagttcgagaccagcctaaccaacatggtgaaaccctgtgtctactaaaaatacaaaaaaattagccagacatggtggcgcgtgcctgtaatcccagctactcagggggctgaggcaggagaatagcctgggaggcagaggttgcagtgagccgagatcgtgccattgcactccagcctgggcaacagagtgagactccatctcaaaaaaaaaaaaaaaagaagaaggctttctgttgggggcaatataacacttttgaaagttatttgagagacaaagtagatagtctctaaagggaattggtctcagtcttattaaggtcgaaagacaacattttttaaaccagagaaattttttaatttctgaaaatatggctaatgcaagtgtggaacttctcctttctgcagactgagggtaataaaggtgctatggtctgaatgtttgtgtcccctcaaaattcatgtgttgaaatcctaatccctgaggcaggtattaggaggtggggcctttcagaaagtgattaggtaggtcatgaggacaaagtcttcatgattaggattagcatcctataaaagagactgtaaagaatgatcaagcccttctgccatgtgaggtcacagtgcaaaggtaccatctatgaggacagacactaaatctccaagtgccttgatcttggacttcctagcctccaaacctgtgagaaataaatgtctgttgtttataagccacccagtttatggaatttttgttacagcagcctaaatggactaagataagaggcaatggagattttaactttaagatgtaacctcttacaaagctctctagtaatacttctagagaaataagtatcttcatcactagaagcaaatttgagattttgtagggagaaaacacaaagtcaaacaacgtttttatcattgttgtagctttttgaccagttttgattcatcctgaaaatagacatattgtaaccaaatacactcatatcccattgtgggaggcagttgtataaaattcatttagagactctgcttctgacaagatgaagtagacatacttttccttattcctcctgctaagtacaactaaaaactctggacatgatatataagacaaacattggaagactctgaaaggtggtgagaagaaggtagactggctagggaccttgagaccctaggaacaacaaggcaatgagtttcctaagttttctttttgcctcatattgcccagacttgaagctgaagaagctagtaacctggaaatgctgatggacacagaccaaaaaaaagcctaatgaaagcctgctctctagccacaggacctggaaatgggcagcatttcctggcaagaaagaaaacttttagacaataactgctctactccaactaaactccatagagaaaactgtggcctcagtcccacccatgccagcaaaagctgagtggggagcctagattttcacccaaccagatgtaatgagctgcccagccttcccctgccaaggtgatgtgggggaaggctgggtagggagccaggactttcatcctgccaggctttcccctcttgccatatcaatggagacacatgaggaacctaaaattccaccccaacccagcagtggaaatatttaagataattataagcgggagaaggtacaggaatgtaaagagaggtgaggtttctgtaccttgttcaaactaataaaatgatgtcaccaaatgactgataagttatgtgtgtgtgtgtatacatatacatgggtatatgtatatacatatatacatgtatgtctgtatatatgtgtatgcgtatatgtatatatatgccatatgtatatacatatatagtaacacctagagccaccatttaaaaagctatacaaagagatacatgcaaaaacactacagataaatgaaaattgaattttaaaaagttccagtgacccagagaaaggcaaaaagaagacagaaaacattaaaaaaggaagaacaaacagaaaacaaacatgaataaaatggccaacttaagccctaacatttcagtacttacattagatacaaatacattaagagacaatgattgatagaatggattaaaaaacatgccccagctgtatgctgtctacatgaaactcacttccaatatgatagagacaaggtaaaagtaaaagggtagaaaagataattcatgcagatattcatcaaaagaaagcaggagtggctatcttgatatcagataaagtagactttggggcaaagaaaattaccagacataagaagtacattatacagtgataaaagagttgtgattgaccaagatgacacagtaatcataaatatatgttactaaacagcagagctagggaacacatgaagcaaaactgatataactgaaaggagaaatagaaaaatctaaaattatagttggagacctcaacactactctttttttttttgagatagggtgtcactcctgtcacccaggctggagtgcagtggtgccgtctcagctcactacaatctctgcttcccgggttcaagggctcctcctacctcagcctcccaaggagctggggctacatgtgtacactaccacacccagctaatttttctattttttgtagaaatggggtctcactatcttgcctaggctggtcttgaactctggggctcaagcaatccagccacctcggcctcccaaagtgctgggattacaagcatgagccaccaagcccagccaacgctcctctttcaacaattgatagaactagacagaaaattaacaaggaaacagaagaactcagcaataccatcaacaaataagatctaattagtatttatagaatgttctaccgaacaacaacagaattcccctttttttttccaagtgtctgtagaaaatataccaaagtagaccatgccctgggtcctaaagccaacttcagcaaatttaaaagaatggaatgatgtattcttcagcaacagtggaattaaactagaaatcagtagcagaaacataataagaacatcttcaagcactgggaaaataaacagcacacttctaaataaataatccatggattacaaaggaagtcttgggaactttttaaaaatattttgagctgaggccgggtgcagtggctcacgcctgtaatcccagcactttgggaggctgaggcaggcggatcacgaggtcaggagatcgagaccatcctggctaacatggtgaaaccccgtctctactaaaaacacaaaaaattagccaggcgtggtggcgggcacctgtagtcccagctactcgggaggctgaagcaggagaatggcgtgaacccgggaggcggagcttgcagtgagccgagatcgctccactgcactccagcctgggtgacagagctagactctgtctcaaaacaaaacaaaacaaaacaaatatatatatatatatatatatagagagagagagagagagagagagagagctgaatgaaaatgaaaaagggatcatagctaaacagtgcaaagggggaaatgtatagcactgactgcatacattataaaagaggaaaagtctcaaattaataacgtaagcttcctcctaagaaactagaaaatgaaaagcaaagtaaacccaaaggaagcagaaggaaggaattagagaagcagaaattaatgaaattaagaacagaaaatcagtaaaacagagctggttctttgaaaagaccagtagaatagacaaacctgtagcaagactgacaatgaaaacaaagaagcacaaactaccaatatcaggaatgaaataggggatacactacagacctttctgacataagaaagataagggaatactaaaaacaactttgtatacataaatttgacaacttgaattggaccaattcctcatccaatatgaactaatatgatgagtcctataacttaaggcaattgaatttatgattaacaaacttccaaagaagatttgtccagacccaggtgatttcactggagaattctgccaaatgtaaaagaagaattaacatcaattatacacaaccccttccagaaaactgaagacgggagaacacttcccaattcatttgataaagctaatattaccctgataccaaaaacaaatgaagacagtacaagaaaactacagaccaatatctccaatgaatataaatgtaaaaacccttgacaaaatgttagtaaacagaattcaacagtatatatagaaagaattatacaccttaaccaagtgaggtttatatctaggatgcaagcctggttcagtatacaaaaatcagtcagtataatccaccatattaagagggtaaagaagaatcacatgatcatatcagttggtacagaaaaggcatttgacaaaattcaacactcattcattattttttttaagttcagaaaaaaataggaatgggggcatttctttaacttgataaagagcttctcttgaaaagttagagctaatattacactcagtggtgatgctttctccctaattttggtaataagacaaggatgtctgctgttaccactcttatttgacaaagtgctgaaagttctagacagtgcagtaaagcaagaaaaggaaataagagacatataggttggaaaggaagaaatcaaactgtccttatttgaagatgacatgattgtctacatagggaataataagtaatttacagaaaactcccagaattcataaatgagttcagcaaggttgcagggtacaaaataaacatacagaaatcaatcgcgtttctatatactagcaaagaacacacaggcaccaaaaattaaaaaatacattaccatttacaattgcccaataaaatgaaatacttagatataaatctaataaacatttacaggacacatatgctgaaaacagcaatggcgatgcaaaaagtcatagatctaaataaatggagagatttattgtgttcatgattggaagactcagcacagtaaggatatcaattctccccaaatcaatatacatgtttaacacactccttatcaaacttttttagacagagacagggttattctagattgaaaggcaaaaaaactagaataacaaaccattttggaaaagaataaagtgggaagaatttttctacctgattttaagacttacatagctacagtaatcactactctgtggtattggcagagagatagaacattgaaacaaaatagagaaccccaaaatatacccacactagtatgcccaacagctttttgacaaagatgaaaaagcagttcaccagagggaggatagcctcaacaaatggtgctgaagcaattggacatccttaggttaaaaatgaagctctactcaattctcatcccttataccaaaaaaaaaaaaatccatttactggtgcttaaaggggccttaatcctttggttcacatccttgcctcacttttacagttttgtaaggattgtattgtaggcaggtaggacatgcactagaaacatccttgattgtacctttaaagttttcttggcggttgcggtggctcacacctgtaatcccagcactttgggaggtcaaggcgggtggaccacaagttcaggagtttgagatcagcctggccaatgtggtgaaaccctttctctactaaaaatataaaaattagctgggcgtggtggctggtgcctgtagtcccagctactcaggaggctgaggcaggagaatcgcttgaagctcgggaggcggagcttgcagtgagccaagattgcgccactgcactccagcctgggtgacagagcgagactccatcttaaaaaaaaaaaaagttttcttacagtagttttcttaattaaatttggagaatgacacttcccctccccccgaaaaaaaccttattatttctattgtccaccttttgataaggcacaggagcaaatctttgtcacccagtagccatccctgtaaaaccaaagatagtttaggcataaaagacaccttatttttattgttctaaatttaaagcatgataagggaaagacaaaattaaggactatcaggtgagacaagacatgagcatagcataagtcttactttttaaaacaggagatacatgtattttaaacgatattttagaaccataccaataaagcaataatttttaggaacttaactttttaaaacaggaactttttctcaagatcatgcaagtgttcacaagaggcacatggagttaacagactattttggtgataaaaataaaactgttatctgagcatagaataacttgatcattttcttaaaaataagcccttcttgtttttatatccatttaacaatttgtagcaaaggatttataagcctctattttatcaataaattcactaacattgaatatatcttactttttttgccacgtatagactttttaaagtgaattttaatattctttatgtgtatgtgtttaggcagatacagtacatagttctcttaataataaagttaaagtctgtaacattaattttaagatataattaatctcaatagcatattaagtggtatttgttttcatatgcatgtgtgtgtgtatatatatataatgtttttaaaagctaatataccattttatatattcccatgccattagacttagtataccatctgtatatatctccatgccatttaatatacctcgacgcagcattttaaatgtttttcataatattcttttatgcctgtgtcatactatctaactattcctttgttagaggcagttagtggtttaaaagcaaggactttggaatcagattgcttgggccagaattttttctctgccacttactttctcagcagtaaaatggggatgataataatatgtatctcatgggcttgttgtgaagattacatgtattagtttctttgaatctcttagaacagcatctggcacatagttattgtgtaagtgttgtgatggatgcctttgtacataaatctttgtcagagtaattatttccttagaattttagaaagagaacatcttggtcaaagaatatgaattcttaggccaaggcaggcggatcacgaggtcaagagatcgagaccatcctggccaacatggtgaaactctgtctctactaaaaatacaaaaattagccgggctgggtggcgggcgcctgtagtcccagctactcgggaggctgaggcaggagaatcgcttgaacccgggaggcgggttgcagtgagccaagatctcactgctgcactctagcctggaaacagagggagactctatctcaaaaaaaaagaaaagaatattaattcgtgcaccaccactactggctgattttttgtatttttagtagagacggggtttcaccatgttgatcagtctgtttctcgagctcctgacctcgtgatccgcccgtctcagccccccaaagtgctgggattacaggcgtgagccactgcacctggccaagaatatgaattcttgaggactcttgatattccagttgttttccagaaagattgtaagataaggatatgatagactatgggatagaatagttaaggttgtctaactttggcaagtacttggcatggcatctacaacaaaaaatacatgctgtgcctaagatatatggatttgagtatagcctgtatagtgtgaacagaagtaatgataaagtcgttggtaaagtaccaatactaatgttggtactagaaagatgttgaagaaacaaaacataaacagggtcactacaaagcagattttaaaagatagtttttagattttatccttttttaaaaaaactgagcaacaaataatgttgggtgcagcttggttggaaatatattatctcataattccataggctagaggtccgacttgggtctgtcccactgtattgacaggactgtgttccttactcagaggctctggggaagaatctgcatctaaatccatttagattgttccctgaattcagtttctttccactgtcggacaggggtcccagcttccttgctggctgtcaggcgtggatgggtatggtggggtgggagcagagggcagctgcctttaactcctggcacatgtgccccatgtctcagagccagcacctgcaggttggccccttctcacacttggaatctgtcccacttccctttatgccacactcctcttctactttctttgcgcgcgcacgctcgctctctctctctcctgcttttaaggtcttgtgtgattacattgaatccacctcagtaatccaggctaatcccattttaaagtccactgatgagtgaccttaatttcctctcagagtctctcacagcagcacctaggttagtgtttgagagaataaggaaggacatctttagaatttagtccttgcttgcacctccctccagggactgcagtgctccctcctgagactgagaaccagtgctgggaggacagatctcccccatgaggcctgccagctaaagtctgtgtgattgtgtgtggtcgggcctgacagatcatacataagactttgtcctgcaggtggcttcctcaagcaaacattgtaatcaatagagaagcagctaccactcatattagctgggaaagaaggatgtttgttattttggtagtgttcatagtgccttgttttaatgtatacttagaccggaatatgaagtggacatggtcttgctgctttaaattttttttttttattttggtatcacatcatggcagccacagagtgactttatatatgttcaacaggagaaaaccaaggcccagctgtgagtaccaggccagcacttggatgtgcagagctacttttctctttctcagctgcttgataaaatcgagacctttaggactgtagcatctgactgagaaaagcaacccaaatgttctagaaacatgtaacctgcctggcatgtgattataagctgcgaataaagaatttaattattatatttattaagatcagttttaataagataaagtagtttttaggctagttttgttttaaatgagaattttaatgcctaaaagagtatgtttcatttacttaaaatttagcaaaagagaaaaatataatttcctaatgaggctgaatgaactatatttgtattttatatgatgtgagttatataggagaaagatggcatgtggctccaaagtaagtggtcagaattttcaggcctgttttgtcaagccatgggtttaacagaaaaaaaaaaaaaatctgttaggaagcaccagtgaggttcacagacttatggtctggaaggtacataccaatggtaaagggagaccaaaacttagaggccttaaacagttaattactcagtgtcagcttctcatctacaacatggggtatgaatatcgacagtaataccatatagagttattacacctagttaagtcctaagtagaattattaatgctattaataatcttaactccatgaatttacataccttctacccttttctcagtcaagccttctgtttcctgataagtaagttgaatttcccaaaggtgttagcaacagtaactttttacccttttagttatttaggagtctaggatcttgtgagtaactctttgctaatttgcgtggtcaccagtaaatggttctagaagggcatttatgccttcattcaacaaatattgtagtgatcaacctctttatgtgtaaaatcagtgtcttagtttgggtagccccaaagcagactagagagaatggtgtggttttaagtttttgagaagtggtcacagagagctctgcagagttagggagagagggtgatcataggtgtatacgagtggattaccactgtgggcaactgaggttcaatcctgctggggattctttgagggactttgtggtacctgcctctgaattgtcccaccaagggacagggatgccaggttttttatcgaccattggttgaaggtcattcctgcagtggaaactttctgacactttggacttgcatcacacaggggcctgcaaccagaagataccactgagcagagagcccttgcaagttgtaggtggtaggttaacaattgtgtttgtatcttgttacagaaagcacaattaatgttggtaataaatggtaaaagtgaaagatgtttaatataaatatttttccataggattttctattgcagcagaccatgctacgagtgaaggatcctaagaagtcactggatttttatactagagttcttggaatgacgtaagtcaagtacttattggcaccttaatgtttaaatatatagctttgcaaatctagagagtgttttcagacccatcttaaagtttgtttcagaagtaacagaagttcttttggccaggagtctgtgattaggcctggctggacagggcttctctcgtaagttctttttcttctctatcccagccagcctgaaagggcaaaacaagacacaaatagttgcattttctccagtctgccttctctgagcgctcccagctaaatccttaatgtgttcagaccccttttgatgttctggccacttttagcctcttgtttacttcagaaaagttatagataataagaacttactactcagaaaaccaatgggtttacttaaaactgaccatctgttctatttttctaggctgtgttttcttttgctcaacaggtcatatccactgatcttgcaatcctaaagcatacttatttttctaaagcatgtttatttttctttttttctccagctttactgaggtatattgagaaataattttgtcatattgttgatttgtttccctaagttatgtgagcattttgcttttgagcatatagatacatgaataataaaataatctttaaatttagtgcctagataacttccattcacattgagagaaaaatttaagtaatatatgtctatatttagaaaatttgaccagttcagaaaaatacaaaatgaaaagtaatagcttccctccccaagttcttctccccagagataactgctgtccagtttcttgtgatttttttctagaaaaaggtattatgaatatatttatgacatatttaaaggacaaaatgaaaacagatttattgaacacttttgccaggcacttcaaatgttattttgttcagtcttcacaccagtcttaggaggtagcttttatccccatttcacagacggagaaaccaaagcttaatgagatgaagttactagctccaaatcccacagttggcatatggcagggctggaacctgtatccattgtctgatgggctctaatgtagacttcctgtgcagagcccccaaatagggtacaagttgacagtaagctggaagatttgaacagctgagaaaagcaagttgcaacagtttcatttccttcagtcccaactgattggtccatgagggttgtgtagtctgctttagtaggtgcagagattgtttttcatgattggagtatttgaggtgtttgatactttattataaacatgttagagtaaatcttatttgtgataagtcaatgcaaggatctaagtgggccaaggtctattatatagcagtgataatgaaataaaagattggaagcagaactctagaaactttccatttgctatatggcaataacagccatttgctcttattgattatgaacaaagtcatctttgaataatctaaagaaaatcatatatgcattctcatgccaccttactccttgccaaataatcctataccatttaaagtcatttaaggttcaggacttcagttatctttcttaaaacctcaggattcataattcattcactctctctcccatcagtctcttctactgtctctttcccctcagagaagcgtaagtcttctttgttccagaatatttcttgccctctgctccttcgcctacctccccattgtcactgccatgcttgctactgttttacctgctcacctgccattctctctccccagtacagtgtaatccagctgatgcttccccactctgctgacattgctctcatgggacctttccatatctcatgaccttttcttagtcttaatactgtttgacctttctacagtatctgatactgttagccaccttactgttgacattcacgtcttctgtgatactagtctgtccttcctccttctttcttaccacctatccttaatttcctttcctagatgttttggcatagtaagaactcaataaatgtgtttatttaactgaatgacatatttatatatgtgtttgtatgtgtgtatatatatgaaatagcaacaaggttctttatatttttcagtacaaataaacacagttctcttttggagatagccgtttctatttattaacaagtaccataatttcagctaaatgttactatatttacagaattgatgaattacagaagttttcatttttgtatttcaaatatttacagatgcatttttcatgatattttttcactgatttttcctcctgcttattccattaaaataggcttactacatatagctcttctttttagtaaaacttgaatattaagttatgttgattatagtatgaattagcctttcctgttgttaatgattcaggcttgttgttttttcattgcaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacagtgagtatgagtttctatatttatatatattatagattttttaaggtagtttttaaaaatcttttttgttttgtttactgaccagtataattcaaaccagatctgcctatgacttcacatttttaataatatattgaagtgtttttcatgcatcttttgatctttgtattgttcttgggcaaatgagatgtgttttttttagagacaggctctctgaagcctctaacttctaggtagtcttcctgcctcagcctcctgagcaccttggactacacatgtgtgccaccacacccagctagtttttgtttgtttgtttttggtagaggcatagaggcaaggtctcactatgttgcccaggctggtctcaaactcctggcctcaagtgatccgcccgcctcggcctcccagactgctgggattataagcatgagccaccacgcctggcccatttgtcttttatttttatttatttatttatttattttttgagacagagtcttgctctgttgcccaggctggagtgcagtggcgcgatctcggctcactgcaagctctgcctcccggattcactccattctcctgcctcagcctcccaagtagctgggactacaggcgcccgccactacgcccagctaattttttgtattttttgtagagacggggtttcaccatgttagccaggatggtctcgatctcctgacctcgtgatctgtctgcctcggccgcccaaagtgctgggattacaggcgtgacccaccacgcccggcctccatttgtcttttagataagagaatataagaccctgaaattgtaagatatttgcctgtttgtctctaactaatttttaggtactataattagtctttcagcatccaaaattttgttcttttattattttgctacattttggatccagaaatgtgatatcatgtgttcctttaaaaattcttcaaaccattttgtaataattaacattcaaatttggtatttttataacttgagcacttaaaaatgtaggcaatttctttacattgtttatctgcatactttaaaagagattgatttcagagtgtgtgatttcgtgtgtcccttgattcaaaataaagctttggaatcaggcaggcttagatatgagtctgtgactctaaacaagtaagtggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtaagtttgcctgtttttatgtgatatatgtagatttgtgtgattttgtattatgtatataattatgattttaataaacctaaaacattaatgtcctaattaagtatgatcaatttattagagatatgattatttttattttccacaaataatcttatttaggagttgtttaatttcagagtctcgatctaaaattacacttaccatctcaccatgatttacttttaagtctcagaattaatttccagtagacttttttttttaaaaaagctgtagttaatactaatcccagtttctgctagcacatacacttctgccttgatctccagtctctcaatcaagatgacagtattgcaggcttcagctggctgctatagtcaatgccaaccacaaacctattaagtattagtaaatgattactgttttttggtgtcgattattcttaactgattagactgtatatgagctgatattgattaattttaaataatttataattcaaggcaactaattaactacttatacccagcccattagatctatatttgttctttaatgtattatagattttgaacctacctaagtctgttcccaagtgccttatgttttgaaataaacaagttttggaatctacttgtggtacttggacaccctgttataattatttcttccttctctctgcttttttcggggggtatcacgtaaggtcatattggaattgctgttcctgatgtatacagtgcttgtaaaaggtttgaagaactgggagtcaaatttgtgaagaaacctgatgatggtgagtctactacttactgtgttcaggcctgtctttagttgatatttactaaccacctacagaggccactgttgtagtaaaacccttttggctacaagtaacagaagtctccacttcaaccagagttttaaaaaagagaaatgattggaagaatatctgggtattttagggaactgaaagacagcaactagggtggctttccaaggcactagacacaggacctggacagccatcaaaaccctacgcttcctctcccactgcccgaccccaccactttctttcattggccaccagctttcactatttcagtgtatatctttccgcccaaaaataagttccttaaagtccattttatctgatgctcatataatgacaccagctctctttagtttataatcacatggtatttctttttcatcttttataacctttgtatgtccttaagttttaggtaggttttttgaaatagcctacgtatggattttgctgggtttacatgtattgttattattttacttagatctctttctgaactatttcaaattaaaattgaaatattaaatatttcagagtctcaatctaaacatttgaaatatttcactgtttaatttcaatccttttttaaaaaaattaaaatacttaatatccagtgctgggcgtggtggctcacacctgtcatcccaacactttgggaggccaaggcgggcggatcacgaggtcaggagatccagaccatctgggctaacatggtgaaaccctgtctctaccaaaaatagaaaaaattagccaggcatggtggtgggcgcctatagtccgcctactcaggaggctgaggcaggagaattgcttgaacctgggaggtggaggttgcagtgagccaagatcgcaccactgcactccagcctgggcgacagagtgagactccgtcacaaaaatatatatatatttaatatccaaatcttctccccaataagaaaggaatttgcttcactccgtcctcattgtgtcactattacctagagtgggatagtattgattttattttttaaagataataataaatatatcacggtgtttgatcactttttcttcatatatctcttgtagtgtctcctttgagacaggatctcactctcatccaggctggggtgctgcaatggcactgtcatagctcactatagccttgaaactcctgggctcaaacaatcctctgcctcagcctcctcctaagtagctaggaccacaggcacatgccaccacacccagctaattgttttatttttttgtagagatgagttcctgctatgttgcccaggtttgtctcaaactcctgagctcaagcgattctttcaccttggcctcccaaagcactgggattacaggcgtgagccactatgcccagcctttttagcatcttttggatttttctgttcttttatttaaatacctcaaccaaaatggtctttaaaggggttttgtttttgttttttgagacggagtttcgctcttgttgcccaggttggagtgcaatggcacggtcttggctcaccgcaacctctgcctcctgggttcaagtgattctcttgcctcagcctcccgagtagctgggattacaggcatgcgccaccgtgcctggctaattttgtatttttagtagagacggggtttctccatgttggtcaggctggtctcaaaatcccaacctcaggtgatccgcctgcctcagcctcccaaagtgctgggattacagctatgagccaccgcacccagccctttaaagggtttttaaggcaaaacttttgagattctgtgtaactgaggatgatgcctttatgtctgaaggacagttttatggaaaagcctaggtttaatttccttcagtcttgaaaatactcttctattttctttttgcatatgatgttgctgttgaaaaatctgtcaattcatgttcctttgtatattcttctgttttattctagaagctttttatattatttctttgtcactgcctgcattctgggagatttcctcaaactggaataccaattagctaattttctcccaaatgtatctgttctgatatttaattcatctattttgttcttaaacacctgttataattttgatctctaattttcgcttagtttgcttaatatgttcttgttctttttttcatattggtaatatttcatattgtttattacttttttttttttttgagacagagtcttgctctgttgcccaggctagagtgcagtggtgtgatcatagctcactgcaacctcaaactcctgggatcaaacaataatccacctcagcctcctgagtagctgggactacaggcaaatgccaccatgtatggctaattttttattttttgtagagacagggtcttactatgtatctcaggctggtctcaaactcctggcctcaagtgatccttctgcctcagcctcccaaagtattgggattacagatgtgaaccaccacacccggccggtcattacttttacatgtctaaatagtccttgggtctgggcatggtggctcatgcctgtaattgcagcactttgggaggccgaggcagaggattgggaggttcgggaggatcacttgaggccagcagttcaaggctgcagtgagctatgattgtgccattgcattccagcctgggtgacataggaagaccttgtttctacaaaaaggtttttttttaaattatctgggcatggtggcacatgcctgtagtctgtatgcctagctactcgggaggctgaggtgggaggattgcttgggcccaggagttggaggctgcagtgagctatgatccactgtacttcatttcagtataaacgacagagcaagaccctgtctccagaaaaaaaacaaaaatagctcttggtccattattctaatatttcttctgtttgaatctacagtccattgctttgggggtgttttatggttatgtttctcaaattattattttttgcctctgagcttttttcccctgcaactgttcgctattctaacacatcaagcagtgtgaataggagaatggccagatccctgtccttaacaacccacatgatctcaggacaatgggctggataagcctaggccagagattcctaggcacctagaaatgagacttaaatttatttcaccttccacaaaacacctcttcaggttggatcttcccacttcatccctcagggaagagtattagtaggagacacttccgatagtgttattccctagccctgggcgtggagagagggctggggagatcattcggccctaccagtttttctcagtttctcacaagcacaaggctcctgcactgcccttgtttactggtaaggacatctgaacaagtgagagggcaggtgccgatgcacacagcagtgagggaggagcaagagcaaaactctgttctctcgcagccattatgcactgccttctggtccaggccagaactaccacctcccacacagcccaagttaaaacagtcacccggccccatcctcacccattctccccagctgtcactagccgggtttctttctttctttccttttcttttcttttcttttccttttcttttccttccttccttccttctttccttccttccttccttcctctctctccctccctccttccttccttctctctttctctctttttctttctctttctctttctctctttctttctttttcctgcattttccatctatgttcctctaggattgatcttggagaaaggaggcagagataagagtcaaaccaattcaacataatggtccccaaataaatttctgaggtcatatttttccatttaagcaaacagctctgacatactagactctcaatctcagttttgaattcctgggagaaagactctcgcagagcttgggttgcctaggatagtatttaaaagggtttgtatgacccaagcatctgggtcttttggttgtgggggtaagccatgctaccagctcccttcagcacctccctattttctttttcttctttaaaataagacaatttctgtaactactgaactggtagtgtggtatcatgaaggtgaggcaaatgcctgatacctaaaagatgcagccagtcccacagtttatttcaggagggctggtatttgcaatgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaacctttgtccatcatgttctttctttaaaaaaaaaaaaaaacaactccccttagtgagtactgaaaggatttgaaaaggcttgtaggctcattctgaagagagaacaattgtgattctgtacagcccgtaaagcaggtagtgtctatggataagggagtgtgggaaaggtgggaagaagaaagtgaatacggaataaaggattgtggtagataaagtgcaaacagaagaatatcaaaaggtaaggaacttatgaagaccaatttcacatgttgagtgctagaactgacaaacgggagggctaatacattcacaaattcagtaatttaagctttatttccaaggaaagaagccttctccacttgctgagtaaaacttgccaaaagatagcccttgctcattctttaaattcattcctatatgcattttttttaaatgtacagttggcccttgaacaacataggtttgaactccactggtttatttatacagggatttttttcaagcaaatgtgggttgaaaatacagtacaaagggggctgacttttcatatgccaactgtgggacttaagtatgcacagattttggtatccatgggcagtcctggaaccaatcctccacatacaccgagggacaactgtatatggtaacactacgccttgttagggaaaagaacaattcacttccaaattcacttacctgagaagttgtacgaaagtacaaagtaggtcacaagaagtaagttttcttattttccatgatcatggtcaatgtaaaacaagtcagtctcctatgagccctacatagctaaggctagaatgattataatacaggtggtttgaatgaagagcagatggctgaaagggaatcacttgaggctttcccacacagtattttgaccatgattgcatagagtgtgtcttagttgaggcaattttaataaaaataccatagaccgggtggcttaaacaacaaacatttatgtctcacagttctggaggctgggaagtcccaagatcaaggcaccagcagatccagtgtctggtgaggacccacttcctgacttgtagacaggcaccttctcactgtgttctcacacatccaagataaatcatctcttaaaagggcactaattccattcatgagggttctaccctcatgacattacctcccaaaggccccacctccgaataccatcacactgaaaattaggcttaaacatatgtatggaagggagccgcaggacacaaacattcagtccatagtacagtatatataaataatcctcagccatccaactgattatgaagagtgttagtaaggatgcttgctattggcaataagaaaaaaagccagcacttaagagattgtaaaatggattggttgaccaggcgcagtggctcacgcctgttatcccagcactttgggaggctgaggcaggtggatcacttgatgtcaggagtttgagaccagcctgaccagcaagatgaaaccctgtctctactgaaaatacaaaatttgccaggcatggtggtgggcacttgtaatcccagctgcttgggaggctgaggcaggataatcacttgaacctggggggtgagctgagatcacgccattgtactccagcctgggcaacaagagcgaaacttcgtctcaaaaataataataaaatgggttggtagagggttcagagataacaagaaccccagattatttccatctttcccatcctgtcatttttagcattttttctcactggaccaataatatgatcaaagatgcctaccatgattctaggtatcatgtgtagaccaacaatgttgataggatttggctgtgttcccacccaaatctcaccttgaattgaagttcccataatccccacatgtcattggaaggacccagtgggaggtaattgaatcatgggtgtggtttcccccatgctattctcgtgatagtgagttctcacgggatctgatggtttg

SEQ ID NO: 15767 - DNA, 19728 bp, Human; identical to SEQ ID NO: 12506

SEQ ID NO: 15768 - DNA, 6419 bp, Human
ttcctccctcagacagagggcacttcagtcactgcagagcaggtggcagcagcccttcagtggatgagtttctcctttcccagggtgactgggtgggtgaaggaattgagcaacaggtggccaggctgccgcctctcaccctgacacattggtccccatcccctcatcctacagccatctcagggacagatggagacattccaatgccctccgggtcctccaccaacccagacagagcctggagtcacaatgcccacctagccagagggatcagccagctagccaagtgccccctgtgtctttcatctgttcttcacaagacccacaagtgaaaaatgaggataaaccgcacattctacacacgataacaacatagcaagtccttatactgctcttactgtgtgcccggcccccttagcagtaggtactattattattcaattttacaaagaaactaactgagggacagagaggcaaagtaattccctgcaggtactctaatgagtacgtggcagagctgggagccatcctggttgtctgcctcgaaagaccacactctttgcactgcatcgcggcacttcctgcggggtggggggcacaatgggagaagcatctgcgtctaatgctgctttacttttgaggccagaaaaatgggaaggctcccctctgactctggaagagagacgcaaaccgtaatctcaacaacacaatccccacctccaacctcagccgccctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggggcttcctgctcgctgtgcgccgaggtccaggctgaagcggagatcgcaagcctctggctcccgcctctcccaaggggcctcgaggaaccggctgccgcgcccccttccccaagaggagaagagcgggcgctgaccccgcgagtcctagaaccgcgggcggggggcaggcagggggcggggggcagagggccagctaccggcgcggaacgcccatcccaggggctggttcaagacttccacaccgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcttcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgagtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccgcggcgcctccgcccaaatcaataaactgtgtctgtcccaggaggccgagtctctttactggtggggggtgcgtggaggcgcgcagggccagagcagaggggagggtgaactgggtctccaagtcccaatccagacctaagccaaactaacacgtaggcacctgtagctgtttttctacctggaaaaggggataggaaggaagcaaacccaacaaaggctgtcacccacggtcaccaaggagcaccatgctcccctcagcccaggatagaccctcttttccaggcctagcgcagagcccggggatgccgcccgggggagcctgaggacccgctccagctaggcacgccaggccccgccctttgaggacacgccccacaccagcctcagagctctgaggtgcctgggctgagcttcccttcagaccagaatcccgccccgttgaggctttgagaaaggagtaggagccgagcattccggcagaggaagaaaaacggcccatcttttagagtccgacctctggaaatgtgtgtatgatgtgatgtgtgtgttcattagagaacttgtcctaggaggagtgggggagccgtggttggtgtttgctgtatccctgtcagtcccgagggtctgagtcttgaagggagagatgcgagtgtgggatctggtgccaacccccactgccaccctgtcctgagtgggagcagcggcccaggactgtcaggaaagtttcccatccttagtcccagccctgagagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgctatttctgtgtgggggtctctatctggggtgggggatgcttttgtctgagaggagagcctgcctcttgccgcagtccttaagcatcctcaggtctgccatcaggattgtcccaagtctgtagcaccccacctctgctccccaccccatagtgccagcaggaatgggatggtaacagaaagggaagtcctgcagtgaatattgatcccagttattgtttcttattattattttgaaagatggtgtagcagggtttgagactggcctggatggtggggagaggagggcagcgagcagagacttcctcagacccaaccctctccaggattcagcagcagcaccccaaggctggaataatggggttggggaagtgcggtgactgggaaatgctgagctaggggcaggaggcatgggcgggacagtgttctgtgcccccttctagagcctaaatttgttgcccgagttcctccgggaagcgctccgggtagattctgggggccgggagctgagatccctgggcggggagcgggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtgagaagaagggctgggctgggctggcggagcgcggtgccgggagcaagggcggcggtcgggggctctatccagggacagcaccggggccgagaggccccaggactcgtggagtcctctgagtcctgcgcagcagcggccgtcgggggtcagctaggaagctgcaggattgcgttgcttcggtgcctgggcttggggaggcttaaccatcagggcttcgggactccaagcgcatgttctcact

SEQ ID NO: 15769 - DNA, 4623 bp, Human
acttaatacaaaaatactaaagtttctcaataatgttatatttattgttgaaatgataatttttatatagagttaaataaaaacatcattaagattgattgttacctgtttctttttactttttaaaatgtggctactagaaaatttaaaattacatgagtgactattggaaatgtaaattgtcaaccttaaaaaaaagacactagaggctaggcatggtttctcacacctgtaatcccagcactccaggaagatcacttgaagccaggagtcagagaccagcctgggttaccaagcaagaccccctctctacaaggaattaaaaaattatctgggcgtggtggcatgtgcctgtagtcccagctactcggaggctaaggtgggaggattgcttgacccaggggaagtcaaggctgccatgaattatgatcacactgtcacagaagggctgggctcccagctaaaccccacccttaagcctggaaccatggccctaagtgaaaacagctgaccccatttttctgcccaaatgttgcttttttggcctgccccaccccatcctgtgcccatgaaagacttaagctggcaaagcaacataagcggctgagcgtcgggaacacgagcggctgagtggcaagcaaagaaacaactaagtgttagagagtagatgcagctaattttggacgtgcagcttccgagaggggcctagccagagatgggtgggcttcaggtaaagatcaccttcccaccccctttccagcctctctttccgctgagagccacccactgctcaataaagttgtctgcattcattacctttcaacccgttcatgtgacctgattcttcctggatgccagacaagaaccaggaagcccctgagagtataggggctgccaccctgaccctccactgagctggttggcacttggccatccctggaaggcagagcggacagagcattggctgtaatatgcttggatgctgctgcagggcccacatagagcctgctcccaccagaaaggagcaactggctggttccagaattcgttcactccagttcccacactcgctctctcgcacactccctcccgtgaggagtggccagcagtgggcttagtgaaaccagtcactccacttcccacccaccaagggggtcaagggaactatcccatctcatcaccactgcactccagtctcgatgacagagtgagaccttgtctcaaaaaaaagaaaaaacggccaggtgtggtggctcacacctgtaatcctagcaatttaggaggccgaggcaggtggaccatttgagatcaggagttcgagatcagcctggccaacatggtgaaaccctgtctctactaaaaatacaaaaattagccgggtgtggtggcatgtgcttgtagctccagctactcgggaggctgaggcaggagaatcacttgaacccgcaaggcagattgcagagggccgagattgcaccactgcactccagcctgggtggcagagtgagactgtgtctcaaaaaaaaagcaagagaaaattatctctaacatgttgggtttacttgggaatagaaataaggattataatccagaatgcaggaaatggcaagcctccagtgcactcagtgagggaaggggagcttttattaacaaaaaagagatttatataaactgcttagaaacagatcattgtttctagaggctcaaagccagagttgtcatttcattggtggagacaccttactgggtaagtgttctgagaacattttacctgaattacagcagtcctaaaaaatgtctagtgataaaccttatcaaatcaggagatgcttgaaggatgcggaagagctttttgaacatccttggaaacaattcttagacatataagcataggcctcctctcctttcaaccttcctggcccttttttgtctgtgtctgacaaaaccgatttcattttggcatcttcaaccttcacaaagtctagagtaagaagtatggaagttgtcagcttaaggtgcagacatggccaagtccaagaaccacaccacacacaaccagtcctgaaaatggcacagaaatggtatcaagaaaccccgatcacaaagatacgaatctcttaagggggtggaccccaagttcctgaggaacatgcgctttgccaagaagcacaacaagaagggcctaaagaagatgcaggccaacaatgccaaggccatgagtgcacgtgccgaggctatcaaggccctcgtaaagcccaaggaggttaagcccaagatcccaaagggtgtcagccacaagctcgattgacttgcctacattgcccaccccaagcttgggaagcgtgcttgtgcccatattgccaaagggctcaggctgtgccggccaaaggccaaggccaaggatcaaaccaaggcccaggctgcagctccagcttcagttccagctcaggctcccaaaggtgcccaggcccctacaaaggcttcagagtagatatctctgccaatgtgaggacagaaggactggtgcgaccccccacccccgcccctgggctaccatctgcatggggctggggtcctcctgtgctatttgtacaaataaacctgaggcaggaaaaaaaaaaaagaagtatggaagttgtcaaaatcaaaatggagtcactagtgttaaaaaactcacacaaaaagagctgaggaaggctataaaaagagggttctcacacttggatgcctaataacaaaaactatcacaaaagactctgcaaaaaccacaactttgcataaaggccatcccaactgtacacaaaaaaatacttctacaaggacatctacccagcaactgcctgtatgactctggactggcatcactttttttattgatctttgtagccaaggataattatctcaaaacaattatccttctcatttttcctttaaatacctttatctttttttaaacctccctggatatgcacataatttaccacatatctttttcttttacagagactctctctgttatttaggctgacagaaaaaaagcgaacctgagactaagccttggggaacatttaatgaatgagtggggtagatgaaccttcaaagaggactgacgaggtaaccagagagggaggaaatgatcaggaggcatttcttattagagaagccaagggaagaccttctcaagaaggagggcatgattaactgtgttaagtgtagctaggaggtcacgcaagaggactgatgtacatagtaatttggatgccattggtgaccttagcaagagctatttaggtagagagatggaaaccagactaaagagtgttgaggaggctgggcgcggtggctcacgcctgtaatcccagcattttgggaggccaaggtgggtggatcatgaggtcaggagttcaagaccagtctggccaacatggtgaaaccccgcctctactaaaaatacaaaaattagccaggcatggtggtaggtgcctgtaatcccagctacttgggaggctgaggcataaaattgcttgaacccgggaggcggaggttgcagtgagccaggattgtgccaaggcactatagcctgggcaacagagcgagactccatcacaaaaaaaaaaaaaaagtgttgaggaatgagttgggggagtggggaaatagagaacctccccatcctttaagtttcagcttcagtgccactttttcagggaatccttccataattttctaaatcaggtcctcctctcacaacctttcattgaattcttaactttttttcatggtacttatcacaatgtgtaatgaatttatttatgtggttatttgttttatggctgtctccccaggagccctgcatattacatttccctttccttttctttctttctttttttttttttttttttgagacaggtagtctcactctgccatccaggctgcagtgtagtggtacaatcacagctcactacagcctcaacctcctaggctcaagtgattcccacttcagcgtcctgagtactgggactataggtacatgccaccacacttggctaattttttttttttttttatttgagatgatgtttcaacacattgctcaggctggtattgaacccctgaactcaagcaatctgcccacctcggcctccaagtactgggattacaggtgtgagccactgcacccggcccctgcatattttctgcactatcaccagcacctgcctcaaacctaaggcatagtaggagctcagtaaatactcactatataaatagcacttaagcacccagcatattacattcattatctcatttaatccatttctgagttgaggaaattacagagagagtttaggcaacttgccccaggtcatacagcaagtgaatagtggagtcagaatccaaagccaggttatcagataccaaaagtttaatgattttgaattctaccttcccagttgaaatttcaaatcaattcagtaaatatttattgaggttgcagtgagccgacatcacaccactgcattccagcctgggtaacagaaactccatctcaaaaaaaaaaaaaaaatgccaggcacggtggctcacacctgtaatcccagaagtttgggaggccgaggagggcgg
